United States Patent 11,098,302 (IDENTIFICATION OF POLYNUCLEOTIDES ASSOCIATED WITH A SAMPLE) - sequence listing, part 39

SEQ ID NO: 131778 - DNA, 750 bp, Homo sapiens
  misc_feature: GYAE6OF01ALD5Y.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggactccgtggcctcctatgagctcgactcacgcccaccctctagtcggtccgtcgtaccccgaggaccagaccgacgccacgcactccacctcgccttacgacgggaacgaacggtaaaggttacgggggtaaattaaagtatcggcgttcggcgttaggttactacgacgacgaacggacggccgaacggcccgtaccggttccccgttggtttcggttcgttactacgtttacctaacgtaacgaaacgtaaccgtaaccggaacggtccccggtacccgtaccgggaacggtacctcccggtaggtaccgtccgttacgttccgttcggtaccgtaccttacccgtaccgttacggaaccggacctacgtaacccgaccgtacctacgtccgtaacacgtacggcggtaccgggtactcggacgttaccgtacgtacggtacgtaacggcgtacgttacgttactttaacgtacggtcggtacggtgggtaccgggtacgccgtacggccggtagtaccggggttggtaaccgggtccggggtacggaccgggaaccgtcggtcggtacccgtacggtccggtagaccgtacggcccggtaccgtacccgg

SEQ ID NO: 131779 - DNA, 594 bp, Homo sapiens
  misc_feature: GYAE6OF01C8URD.49.85.H08.1.454.CMB.1.raw
  modified_base (455)..(455): a, c, t, g, unknown or other
  misc_feature (455)..(455): n is a, c, g, or t
  modified_base (580)..(580): a, c, t, g, unknown or other
  misc_feature (580)..(580): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcacgccaccctcagtgtcccgtcgtccccaggacagacagccagcatcacctgctcgtggagacgaaaggttggggaataaatatgcgtggcttgtatcagacagaacgccgacgccacgtccctgtgttgtcatctatacaaagtactaaccgaacggccgcctacgacggtactccgtagacgcgtacttcgtcgcgtcctacctaactcggtacggaacacgacgacctactcgtacaacctagtacgacgggtaccggtactacggacgtactacgtcgagtggacgtnttaccgtaatttaccgttacgtggtaccgtagggtcggtacgaacccgtggaccacggtacgggtcgggttacgtcgggacgggacgtaaccgcgtacccgtacggcccgtttcgacgtcggacnccgtacgtacccgg

SEQ ID NO: 131780 - DNA, 716 bp, Homo sapiens
  misc_feature: GYAE6OF01DRB5H.49.85.H08.1.454.CMB.1.raw
  modified_base (349)..(349): a, c, t, g, unknown or other
  misc_feature (349)..(349): n is a, c, g, or t
tcagagtcgagagacacgaccggtgctcgatttagtatcactcagtcggcggggctgggcctcaggaagcagcatcggaggtgcctcagccatggacatggactccctctcttcctcggcgtccttgacttacgtgcacaggactccgtggtcctcctagtgacgctacgactcacgcccacctactgtcgtcccgtcgtaccccgaggacacgacacgaccagacactacaccgtgctacgtaggaagtaacggtaaggtaggggtaattaaagtagtcgacgtaggtacgtagtactacgaagacagacgccgacggtcctacgtccgtagtcgttgactatactanacaacgactaaccgacgccgaccctagaccggtactaccgtaggactacgttattaccctacgtccgaaccttaccgaacgtccggtaaacggaacacgtaccgtaccctacggtacctacgaacgtacgttacgggaacggttccggaacgtacggtacgtacgttaacggtaccggagttaccggtaacgtactttaaccggttaattaccggtttaaccggacggtaaccgggtacggggtaccggtaacgtaccggaccggtaccgtacgggtaccgggtaggtaccgggtacgggaccgggtaaagaccggtacgcgtaccgggtacctcgtaacgtaccgccggaaaccgtccggtacccg

SEQ ID NO: 131781 - DNA, 904 bp, Homo sapiens
  misc_feature: GYAE6OF01AK102.49.85.H08.1.454.CMB.1.raw
  modified_base (173)..(173): a, c, t, g, unknown or other
  misc_feature (173)..(173): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctnagtgtccgtcgtccccaggacagacagccagcatcacctgctctggagacaaagttgggggaataaatatgacgtggtctaggtactcgagcgaagaacgcccgaggcccgaacgttccccgttgttacggttcggtacctacgttactaacgtacaaacgtaacctaacccgtaaacggccggtaccccttacggaacggggtaacccttcccgttacggaaccgtccggttaacttttcccgtcgttacgggtaccccttaacccgtaaaccgtttccggtaaccggggtaaacctaaccggaaccgtaaccccttaacgttacccgtaaccggtaaccccgtaacggtacccggtaacgggttaacccggggtaccttaacccgggtaacgggttcccgtttaaacggtccgggtaaacgttaccgggtaccgggttaaccgttaaccgggttaaccgttttaacgtttaaccccggttagggtttaaccggtttaacggggggttaggtttaacccggggttaaggtttacggggtttacgggggtttaacgggtttcggggttttaccgggttacccgggttttaccgggtttacccggggtaggtttaccccggggtaccgggggtaaccccgggttacccgggggttacccgttaaccccggggtttaacccggttacggggtaaccccggtaccccggttaacccccgggtaaaaccccccgg

SEQ ID NO: 131782 - DNA, 805 bp, Homo sapiens
  misc_feature: GYAE6OF01E1OW1.49.85.H08.1.454.CMB.1.raw
  modified_base (174)..(174): a, c, t, g, unknown or other
  misc_feature (174)..(174): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagcccaccctnagtcgtccgtcgtccccaggacacgacagccagtcactccaccgtgctcgtaggacgaacgtaaaggttagggggaattaaagtagtcgtcggttcggtacgttaggtactcgaaggacaaggaaccggtaccggaccggtacccgtaccggtttccccgttggttcggttacggtctaacgtttcgtactaacgaacgtaacgtaaccgaacggtccccggtacccgtaggtaaccgggtacccttaccccgagggtaccgtaccgttacgttcccgttaccggtaccggtaccctaccgtaaccgttcgggtaacggaaaccaccgacccgtaccgtaaccttccgtaactaacccgtacgtacccgtaaccggggtacccgttacgaccgacgttaccgtaacggtacggtaatccgggtaggtacctacgttaacgtttaacgtccggttacgggtcggtaaccggggtcgttacccgggaaaccgtccggaccggtaaccggtttaccggggttacgggggtaccgttaccgggggacggaaacccggggtaacctaccggggaccccgttacgaccccgggttacgtcgggtaaacgtccccggtaaccggtccccgggtaccgg

SEQ ID NO: 131783 - DNA, 724 bp, Homo sapiens
  misc_feature: GYAE6OF01A0R4T.49.85.H08.1.454.CMB.1.raw
  modified_base (174)..(174): a, c, t, g, unknown or other
  misc_feature (174)..(174): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagcccaccctnagtgtccgtcgtccccaggacagacagccagcactcacctgctccgtaggacgaacgtaaaggttagggggaataaagtatgtcgtcggtctggtactacgacgtcgaaggacgaccgacggtccgaccggttcccgttagtggtttcggtactactccttagtacaagtactaaccgaacgcccgtaccgtcggacggtacctcccgtaggacgtacgtgttacctcgtcggtaccctccgaacgttcggtaacggaacctacgtacgtcccacgttcaccgtaacacgtaccggacggtaccggtacgttacgacgggtaccttaacggacggtaacgtacgggtacgtacgtaacggttaacctttacgttaccggtacgtacgggtaaccgggttcggggaaccgtacccgggacgtacccggtaccggtaaggttccggggttacggtacccggggacgggaaccggtaccgtaacgggtaccctaaccgggtaccccgttcggaacgggttccgtaaccggaccccggttaaccggaacccggg

SEQ ID NO: 131784 - DNA, 723 bp, Homo sapiens
  misc_feature: GYAE6OF01CNMO9.49.85.H08.1.454.CMB.1.raw
  modified_base (211)..(211): a, c, t, g, unknown or other
  misc_feature (211)..(211): n is a, c, g, or t
  modified_base (420)..(420): a, c, t, g, unknown or other
  misc_feature (420)..(420): n is a, c, g, or t
  modified_base (431)..(431): a, c, t, g, unknown or other
  misc_feature (431)..(431): n is a, c, g, or t
  modified_base (452)..(452): a, c, t, g, unknown or other
  misc_feature (452)..(452): n is a, c, g, or t
  modified_base (588)..(588): a, c, t, g, unknown or other
  misc_feature (588)..(588): n is a, c, g, or t
  modified_base (690)..(690): a, c, t, g, unknown or other
  misc_feature (690)..(690): n is a, c, g, or t
tcagagtcgagagacacgaccggtgctcgatttagtatcactcagtcgcggggctgggcctcaggaagcagcatcggaggtgcctcagccatggcatggactccctctcttcctcggcgtccttgcttactgcacaggtctccgtggcctctagtcgagctgacctcacgccctaccctcaggttcgtccgtcgtaccccgaggacagacncgccacgcatccgactgcctcgaggaagtaacggtaaaggttaggggaaattaaagtcgtgcggttggacgttggtaacgtcgacgacgaacgacgacccggtacggccctaaccggttccctaggtttcggtacgtactaactcgtaataacgaacgtacgtaaccgacgggccgtacccgaggacggtacctccgagacgtacgttntacgtcgtacnccgtaccagtcggtacgaacncggacctaacgtcctacgaccgactcggtacggtacgggacccgaacgtcgggtactccgtagttaacggcgtaacgggccgttagtaaccgtttagtttaaccgttacgtcgggtaacgcggggttacgggaccnccggtacgtccggacgggttacgggtcggggttaccggacccggggggaactaaccggggaccgttaaacggccggttccgggttaccccggcggttaaacnccgggttacggaaccccgtccgggtaaacccgg

SEQ ID NO: 131785 - DNA, 718 bp, Homo sapiens
  misc_feature: GYAE6OF01CUKGP.49.85.H08.1.454.CMB.1.raw
  modified_base (233)..(233): a, c, t, g, unknown or other
  misc_feature (233)..(233): n is a, c, g, or t
  modified_base (328)..(328): a, c, t, g, unknown or other
  misc_feature (328)..(328): n is a, c, g, or t
  modified_base (636)..(636): a, c, t, g, unknown or other
  misc_feature (636)..(636): n is a, c, g, or t
tcagagtcgagagacacgaccggtgctcgatttagtatcactcagtcgcggggctgggcctcaggaagcagcagtcggaggtgcctcagccatggcatggatccctctcttcctcggcgtccttgcttactgcacgaggactccgtggcctcctatgagctgactccacgccctaccctcgacgtggtaccgttcgccccgaggacagacagccagcactccacttgactcgnggaacgtaagtaaggtgggaataagtactgtacgtggctaggtactacgagactagacgccgacgcctacggtcctgttacgtgactagtactanactaagactaaccgacgccgtacccgtagacggtactaccgtgtacgcttagtcctacggcgtacctaccacgtcgtaacggactcgaaccgcctaacgtcaccgactacgtacggaccggtacgtacctcggtaacggttagttaaccgtcgtaacgttacggaacgtacggttaaaccgtaacgttttaacgccggttaccggtacgggtacggtaccgggtaacgggtaccacggggtaccccggtagggtttaacccggggaacggggtttaccgggaaccggggacgggtaaccgggtaaccncccgggttacggtaaccccggtttacccgggaggtttacccggaaccgtacccgggtcccgtaaaccccggggttaccccgg

SEQ ID NO: 131786 - DNA, 792 bp, Homo sapiens
  misc_feature: GYAE6OF01CROC0.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacgaggtactccgtcggcctcctatgacgctgacctcacgccctacctcacgtcgtccgtcgtcccgaggacacgacacgcacgtctactccactgcctcgtaggaacgtaacgtaaaggtacgggggtaaattaaacgtacgtacggtccgtggtacggttacggtagtaccgaacggtacgaacggaaccggtaccggacggtaccctaccggttccccgtttggttcgttacggtactacgttctaacgtaacgtaacgtaccgtaaccgaaccggtcccgtacccgtagtaaccggtacgtaccgtacggtacgtaccgttacgtcgtaccggtcgttacccgttaccgtaaccgttacggtaacggtaacctaacggaccgtaccccgttaacgtaccgttacccgaaccgtaactaccgggaaccgggttacccggtaaccgtacggtaacggttacctacggttacggacgtacggtcgtacttaccgttaactaagttcccgggtagtacccgggtagggtaccggtggtaacccgtacggtccgtaacgggttcggtaggggtcccgtaacgggaccgggttaacggacccggtacgcccggttaccgccggttaccgtacgggattaccccgggccgtaaccggtaccgg

SEQ ID NO: 131787 - DNA, 786 bp, Homo sapiens
  misc_feature: GYAE6OF01DKVZJ.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacgaggactccggtggcctcctatgacgctgactcacgcccaccctgtagttcgtcccgtcgtccccgaggaccagacacgaccagcatccactgctcgtaggaagaacgtaaaggttggggaataaagtgtcgcgtggtctaggtactacgagccgaagaccgaccgaccgtccgtaccgttcccgttggttcggttacgtactacttaacctacgtaacgtaaacgtaccgtaaccggaccggtcccggtacccgtacggaccggttacctcggaggtacgtaccgttcttcgttccgtacgtaccctaccgtacgtcggtaacaaccgacgaaccgtccttacctaccgaccgacctacggtaccggaacgggtcctacgaccgtacgttacttaccggaagtccgttaacgggtcgttaccgtaacgttaactttcccggtaaggttccgggacgggttacgggtaccggggttaacggaccgtacccgggttcggttaaaccggttccgggggtttaggggtaaaccgggttcccggggggaaacggtaaaaccccgggtacggtaacccggttacccgggttacccggtaccgtttcccgggaaataacccggggtcgtaaacccccgggccccgggtttaaaccggg

SEQ ID NO: 131788 - DNA, 683 bp, Homo sapiens
  misc_feature: GYAE6OF01EFLJB.49.85.H08.1.454.CMB.1.raw
  modified_base (488)..(488): a, c, t, g, unknown or other
  misc_feature (488)..(488): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcactccacctgcctcgtggaacgtaacgtaaaggttagggggaaattaaagtactagtccgtgggtaccttgggttataccgagacaggaacgccgacggacctacgtcccctggttggttcggtcagtactctaacgaagtaacaccgaacggccggtaccctcggaacgggtacctccgtagacggtccgtactttcgtacgtggtaccctaccgactcggtaacgaaccacacgtcctaacctctaaccggactacgcgtaggaccggtactacgacgtntacgacgagtcgggactacgtacgttaactactttacgtacggttaccggtagggtaccggtacggtaacggaccggtcccgtaggccgggttacggggttaccgggtcggggaaaccgggtaacgggacccgtaaacggtccgtaccgggacccgttccggacggaacggttcccgaccgtcccgtaacccggg

SEQ ID NO: 131789 - DNA, 717 bp, Homo sapiens
  misc_feature: GYAE6OF01DGW72.49.85.H08.1.454.CMB.1.raw
  modified_base (253)..(253): a, c, t, g, unknown or other
  misc_feature (253)..(253): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcacgccaccctcaggtcgtccgtcgtccccgaggacacgacagccagcatccacctgctcgtggagtaacgaaaggttaggggaataaatntcgcgtggcgtggtatacagcgaagacgccacggccacgtcccgtgttcgtgtcatactatacgaagtacaaccgtacggcccgggaccctaggaccggtacgtccgtaggacgtccgtacgtttccgttcgtaccggtacctacccgtaacgtccggtacggaaaccgaccgacgacccgtaactccgtaacgtaacccacgacccggtaacggccggtaaccgtcggaaccggtactacgtacggtagtacgggtacggtacgttcctaacgtttactttaccgtacggtcgggtaacggtcgggttaaccggacggtacccggtcccgtacgggtaccggggttcggggttaccgggtccgggggaaacggggtaaccggaccgggtaaacgtcccgggttaacggacccgggttaccgtacgggtaccccgtaacccggaccgacccgggttaacccggg

SEQ ID NO: 131790 - DNA, 788 bp, Homo sapiens
  misc_feature: GYAE6OF01A6HNE.49.85.H08.1.454.CMB.1.raw
  modified_base (736)..(736): a, c, t, g, unknown or other
  misc_feature (736)..(736): n is a, c, g, or t
  modified_base (763)..(763): a, c, t, g, unknown or other
  misc_feature (763)..(763): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcgttactgcacgaggatccgtggcctcctatgagctgactcagccaccctcagtcgtccgtcgtccccaggacacgacagaccagcacgtccacctgcctcgtaggacgaaccgtaaggttacgggggaattaaagttatcggtcgtggtaccgttaggtatacgacgtacgaacggaacggtacccgaaggtacccgtaccgttcccccggtagtttacggttacggtaccttaacgttacgttaacgttaacgaaaccgttaacctaaaccggtaaacccgggccccgggttacccctacgggtaaacgggtacccgttaccccggtacgggtaacggtccgtaaccgtttccgttaccggtaccggtccctaacccgtaccgttaccgggtaaaccgggtaaaccctaaccggaccgtaaccccttacgtaccgttaaccggaaccctacgtaacggacgggtccggttaaccgtccgtaagggttcctaggttacccgaggttacggacgttacttaccggtatttacggtacgtcggtacgcgggttacggtacggaccgacggtccgtagtcgggtgggttaccggtcgggaccggaggtaaccgngtacccggtccgtaacgtccgggtaanaccggtacccgagtacccgtaccgg

SEQ ID NO: 131791 - DNA, 488 bp, Homo sapiens
  misc_feature: GYAE6OF02HXPLZ.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacaggccgcactggggtattcgggcggagggaccaagctggaccgtccgtgacgtcacggccctaacggg

SEQ ID NO: 131792 - DNA, 540 bp, Homo sapiens
  misc_feature: GYAE6OF02JAOGM.49.85.H08.1.454.CMB.1.raw
  modified_base (323)..(323): a, c, t, g, unknown or other
  misc_feature (323)..(323): n is a, c, g, or t
tcagagtcgagagacacgaccggtgctcgatttagtatcactcagtcggcgggctgggcctcaggaagccagcatcggaggtgccctcagccatggcatggatcctctcttcctcggcgtccttgcttactgcacaggatccgtggcctcctatgagcctgacctccagcccaccctcagtcgtccggtagtccccaggaccagaccagccaggccatcacctgctctggagacaaattggggactaaagtactgctggactggtatcagcagaagccaggccagtccctgtgttggcatcatcgaagataccaagcgccctnacggactccctgagcgatttcgtctgggactccgaacgttctagggaacacgacgcccaactctgacccactcgagcgggtactcgaacggtcttaagtccgtaattacgagtctaggaactattactgtacaaggtcgtacggaccagccgtacgacgtagggtacttcgggcggacgggacaagcctagaccgttcgtgacgtcagccctaacgg

SEQ ID NO: 131793 - DNA, 522 bp, Homo sapiens
  misc_feature: GYAE6OF02JZPCA.49.85.H08.1.454.CMB.1.raw
  modified_base (362)..(362): a, c, t, g, unknown or other
  misc_feature (362)..(362): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattggggataaatatgctggctggtatcagcagaagccaggccagtcccctgtgttggtcatctatcaagataccaagcggccctcagggactccctgacgcgattctctggctccaactctggaacacagccactcngaccatcagcgggactcgaggctatcgatgagctagacttatactgtcgaggcgtagggaccaggcccgacgacgtcggggtattccggggacgggtacgggaccgtaaggcccgtggtaacccggtccgtacggaacggtccgacggacccgtaacggg

SEQ ID NO: 131794 - DNA, 507 bp, Homo sapiens
  misc_feature: GYAE6OF02I8JBK.49.85.H08.1.454.CMB.1.raw
  modified_base (332)..(332): a, c, t, g, unknown or other
  misc_feature (332)..(332): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggactccctgagcgattcnctggctccactctacgggaacacagccactctgaccatcagcgggactcaggctatcgatgagctgtactattactgtcgaggtcgtggacgacgccgcgacgtggggtagttcgggcgggaacgggaccaaggtcgtaggaccggttcgtaggacggtccgacgcccgtaacgg

SEQ ID NO: 131795 - DNA, 482 bp, Homo sapiens
  misc_feature: GYAE6OF02HGOJ7.49.85.H08.1.454.CMB.1.raw
  modified_base (418)..(418): a, c, t, g, unknown or other
  misc_feature (418)..(418): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcgcctcagggactccctgagcgattctctggctccaactctggaacacagccactctgaccatcagcgggactcgaggctatcgatgagctgactattactgtcaggcgtggacngccgcacgtggggtatcgggcggagggaccaaggctggaccgtctggacgtcgacgcccaacgg

SEQ ID NO: 131796 - DNA, 470 bp, Homo sapiens
  misc_feature: GYAE6OF02I89DJ.49.85.H08.1.454.CMB.1.raw
  modified_base (380)..(380): a, c, t, g, unknown or other
  misc_feature (380)..(380): n is a, c, g, or t
  modified_base (419)..(419): a, c, t, g, unknown or other
  misc_feature (419)..(419): n is a, c, g, or t
  modified_base (456)..(456): a, c, t, g, unknown or other
  misc_feature (456)..(456): n is a, c, g, or t
tcagagtcgagagacacgaccggtgctcgatttagtatcactcagtcgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattggggataaatatgctggctggtatcagcagaagccaggccagtcccctgtgttggtcatctatcaagataccaagcggccctcaggatccctgagcgattctctggctccaactctggacacagccactctgaccatcagcggactcaggctancgatgagctgactattactgtcaggcgtagggcagccgnacgtgggtattcgggcggaggacaagctgaccgtcgngagtcgagccacgg

SEQ ID NO: 131797 - DNA, 484 bp, Homo sapiens
  misc_feature: GYAE6OF02IPHDR.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcgaggctagtcgatgagctgactattactgtcaggcgtgggacagccgcacgtgggtagttcgggcggacggaccaagctggaccgtcgtgagtcacgccaacggg

SEQ ID NO: 131798 - DNA, 475 bp, Homo sapiens
  misc_feature: GYAE6OF02GA7NJ.49.85.H08.1.454.CMB.1.raw
  modified_base (418)..(418): a, c, t, g, unknown or other
  misc_feature (418)..(418): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcgccctcagggatccctgagcgattctctggctccaactctgggaacacagccactctgaccatcagcgggactcaggctatcgatgagctgactatactgtcaggcgtgggacngccgcacgtgggtattcgggcggagggaccaagctgaccgtctgagtcagccaacgg

SEQ ID NO: 131799 - DNA, 484 bp, Homo sapiens
  misc_feature: GYAE6OF02FRRW8.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattggggataaatatgctggctggtatcagcagaagccaggccagtcccctgtgttggtcatctatcaagataccaagcggccctcagggactccctgagcgattctctggctccaactctggaacacagccactctgaccatcagcgggactcaggctatcgatgagctgacttattactgtcgaggcgtgggacagccgcgacgtgggtatcgggcggaggaccaagcgtggaccgtcgtggagtcacgcccgaacgg

SEQ ID NO: 131800 - DNA, 484 bp, Homo sapiens
  misc_feature: GYAE6OF02FT14Y.49.85.H08.1.454.CMB.1.raw
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcgcctcaggatccctgagcgattctctggctccaactctgggaacacagccatctgaccatcagcggactcaggctatcgatgagctgactatactgtcaggcgtggacngccgngacgtgggtattcgggcggaacgggccaaggcctacgaccggtcctggacgtcgacgcccaacggg

SEQ ID NO: 131801 - DNA, 698 bp, Homo sapiens
  misc_feature: GYAE6OF02IHJ2Y.49.85.H08.1.454.CMB.1.raw
tcagagtcgagagacacgaccggtgctcgatttagtatcactcagtcggcggggctgggcctcaggaaggcacgcactcggaggttcgccgtctagcctagtggcatggatccctctcttcctcggcgtccttgcttactgctacgaggatccgtggtccgttccctatgtagtctaggactccagccaccctcgagtcgtccgtcgtccccgaggacagacgagcctaggcagtccaccgtgcctctggagacctaagttgggggaataaatagtcgtactggctggttactccagtacgagaacgaccaacggccacggtcccccgtggttcggttcggtacgtacgttcctaggtacgaagtacgtaaccgaggcccggtcctacgaagggactacccgtgacgacgtattacgtcgtacggctaccgacgtcgttacggaaccgtacgaacggtaccgtactaccgtacgtaaccctaacgtaacgacgggtaccgggtaactccggtaaacgggtaccttaaacgtccgtaagttacgtacggtcctagtaacttaacgtttacgtacgtcgtaacgggtcggtaagggaccgtacgcccggtacgtacggttagggttacgttcgggacggggtaaccggtacgaaaggtccgtaggcccgttacggtggaacgtcgacgacccgtaacggg

SEQ ID NO: 131802 - DNA, 647 bp, Homo sapiens
  misc_feature: GYAE6OF02FFUE7.49.85.H08.1.454.CMB.1.raw
  modified_base (252)..(252): a, c, t, g, unknown or other
  misc_feature (252)..(252): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacgaggactccgtggcctcctatgacgctgactcacgccacctcagtcgtccgtcgcccaggacagacacgccacgcactcacctgctcgtaggaagacgtaaaggttgggaactaaatngcgtggtcgtaggtactacgacgacaacggaacgccgacgcccgtacggttccccgttggtcgttcggtactactactactacaaacgtacaaccgaacggcccgtaccgtacggacggtcctaccgtaggacgtcgttactcgtacggtcgacctaaccgtacgtacggaccgaacaccgaccgacctactcgacaacctacgacgtcggacgtacgcgacgtactacgcgtagcgacgtactacgttaacgttcgtacggtacgaccggtcgggtacgacggactaccggcgtacgggtagggttacggaccggtcggggaaccggtacggtaacccgtcggtccgtacggtacccgtacgtacgtaccgacccgacggaccccgttacccgg

SEQ ID NO: 131803 - DNA, 524 bp, Homo sapiens
  misc_feature: GYAE6OF02HK1HO.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattggggataaatatgctggctggtatcagcagaagccaggccagtcccctgtgttggcatctatcaagataccaaagccggaccctcgacgggactccccgtgacgcgatttctctcggctccaactctagggaacacagccactctgacccatcagcgggactcgaggctagtcgatgagtctagtactattacgtgtcgagggtcgtagggacacggccgacgtacggtggggtagttccgggcgggacgggaccaaggtcgtacggacccgtcgtggacgtcacggacccaacggg

SEQ ID NO: 131804 - DNA, 696 bp, Homo sapiens
  misc_feature: GYAE6OF02HJF8M.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggatagaatagtgtcgtggtcgtaggtactacgagacgaagaacgaccgacggaccgtacccgtcccgtggttggttcggtactacttactactacgaagtaacctaacgaacggcccgtcccgtacggaacggtaccctcccgtaggacggacgtacttccttcggtcgtacccgtaccctaaccgttcggtaacggaaccaacgaccgaccctacctccgtaccgtaacctacctacgacgggaccgggtaccgtacggacggtacgtacgtacgtacgtacggacggtcgtacgtacttaacgttacgttacgtacggtacgggtacgggtacgggtacgaccggccgtaccgtacgggtacggggttacgggttccggggacggggaaccgggccggtaaaaaaacggtccggtaccggtacccggtccgtacggtacggtaccggtacccgtaaccccggg

SEQ ID NO: 131805 - DNA, 652 bp, Homo sapiens
  misc_feature: GYAE6OF02G42RP.49.85.H08.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccgngaaaaacngacacgccagcatccacctgctcgtggacaacaaagttggggaataaatatgcgtggctaggtatcagcaagaacgcaggccacgtccctgtcgttgcatctatacgaagactaaccgaacgccgacctacggaacgggtacctcccgtagacgtcgtactttccgtcgtcggcctaacctaaacgtcggtaacggaaaccacgtaccgacctaaccgtcgtacgaaccctaacgtccgaacgggtccggtactacggacggtactaacgtcgaagttcggacgtactacgtaactttacgttaaccgttcggtaccggacgggtacggtacggaaccgtaccggccgaccggtaacgggttgggttaacggtccgggacgggaacgggacccgaaggtccctaacgggtacccgtcgtaacggaccgtaccgacggacccgtaaccggg

SEQ ID NO: 131806 - DNA, 490 bp, Homo sapiens
  misc_feature: GYAE6OF02GIXJQ.49.85.H08.1.454.CMB.1.raw
  modified_base (383)..(383): a, c, t, g, unknown or other
  misc_feature (383)..(383): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcaggatccctgagcgattctctggctccactctcggaacacagccactctgaccatcagcggactcaggctancgatgagctagactattactgtcgaggcgtggacagccgcgacgtggggtattcgggcggacgggaccgaagccgtggacccgtcgtaggacgtcacgcccaacggg

SEQ ID NO: 131807 - DNA, 557 bp, Homo sapiens
  misc_feature: GYAE6OF02G90S0.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagagccaggccagtcccctgtgttggcatctatcaagataccaagcgcctcacgggatcccgtgagcgattctcgtggctccaactcgtgggaacacgacgccaactctacgaccatcgagcgggactcgacggtcttagaccggtagttggacggtctacggtacttaagtttaccgttcgtacgacgggtcggtacgggaaccacggcccgacgacggttggggttacgttcgggacgggaacgggtaccgaagttccgtacgacccggttcgtcgtaccggtcgacggcccgtaacgg

SEQ ID NO: 131808 - DNA, 516 bp, Homo sapiens
  misc_feature: GYAE6OF02IYCJB.49.85.H08.1.454.CMB.1.raw
  modified_base (220)..(220): a, c, t, g, unknown or other
  misc_feature (220)..(220): n is a, c, g, or t
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctgganacaaagttgggggataaatatgactggctggtatcagcgagaagccaggccagtccctgtgtggtcatctatcaagatacaagcggccctcgaggactcccgtgagcgattctcgtcggctccaactcgtaggaacacgacgccactctanaccatcgacgcggactcgacgctancgatgagctgactagtacggtcgaggcgtggacgtagcgacgtacgtgggtacgttcgggacgggtacggaccgaagcgtacggtaccgtcgtaggacggtacacgacccgaaggtcccg

SEQ ID NO: 131809 - DNA, 589 bp, Homo sapiens
  misc_feature: GYAE6OF02IP9V4.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttgggggataaatatgctggctggtatcagcagaagccaggccacgtcccctggtcgttggtcatctatcaagactaccaagcggccctgacgggactcctgagcgtattctctcggctccaactcgtacgggaacacgacgaccactactacgaccactcgacggccgggactcgacggtacctagtacgaagttggacgtcgtagaacttacgttacgttggtaccgtagggtacgggtcgggaacgtacggacccgacgtacggttgggggttacgttccggggacgggtaacggggaaccgaacggtccgtacggtacccggtccggtaggtaccggtcgacccggacccgtaaccggg

SEQ ID NO: 131810 - DNA, 532 bp, Homo sapiens
  misc_feature: GYAE6OF02G5JJP.49.85.H08.1.454.CMB.1.raw
  modified_base (372)..(372): a, c, t, g, unknown or other
  misc_feature (372)..(372): n is a, c, g, or t
  modified_base (396)..(396): a, c, t, g, unknown or other
  misc_feature (396)..(396): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttgggggataaatatgctggctggtatcagcagaagccaggccacgtcccctgtgttggtcatctatcaagataccaagccggccctcgaggactcccgtgacgcgatttctctggctccaactcgtaggaacacgacgccactcncgaccatcagcggactcgagctancgatgagctagactattacgtgtacgaggtcggtggaccaggcccgacgacggttggggtacgttcggggacgggtaacgggaccgaaggtccgtacggacccgttcggtacggacgtaccgacggcccgtaacgg

SEQ ID NO: 131811 - DNA, 543 bp, Homo sapiens
  misc_feature: GYAE6OF02GLMCT.49.85.H08.1.454.CMB.1.raw
  modified_base (481)..(481): a, c, t, g, unknown or other
  misc_feature (481)..(481): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattggggataaatatgctggctggtatcagcagaagccaggccacgtcccctgtgttggtcatctatcaagataccagcggccctcagggactcccgtgagcgattctctcggctaccactcgtggaaccacacgccctactcgtacgacctactcgacggccggactccgaggcctaagtcgagtcggagctagacttattaccgtgtacgaggtcggtgggacacggccgtcgacgttggggtacgttccggggngggaacgggaaccgaaggtccgtacggacccggttcgtcggacgtcgacggacccgtaacgg

SEQ ID NO: 131812 - DNA, 508 bp, Homo sapiens
  misc_feature: GYAE6OF02FQQD0.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattggggataaatatgctggctggtatcagcagaagccaggccagtcccctgtgttggtcatctatcaagataccaagcggccctcaggactcccgtgagcgattctctcggctccaactcgtcgggaacacgagccactctcgaccatcagcgggactcaggctatcgatgagctgacttatactgtcaggcgttgggacacggccgcgacgtggggtattcgggcgggacgggaccaaggcctagggtacccgtcgtacggacgtcgacgacccgtaacggg

SEQ ID NO: 131813 - DNA, 640 bp, Homo sapiens
  misc_feature: GYAE6OF02I6WOZ.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcactgctctgagacaaagtggggaataaagtatgactggctggtatcgagacagaagccaggccagtcccctgtcgttgtacacgtctagtacaagtaactaccaaggtccggtcctacgagggaactcccgtagacgacgtactttcgtcgtcgacctaccaacgttcgtacgggaactaccgacgtaccctactacgtacgtaaccctataccgtaggtaccgggtaactccgaggtaccttacgtaccgtagttacggacgtcgtacgtaacttacgttacgtacgtaccgtaacggtcggtaggaccgaacggtccgtaccgtacgggttcgggttaagttccggggaacggtaaccgggtacctaaggtacccgtaccggtaaccggttcccgtaaggtacccggtacgtaccggtaccccgtaacggg

SEQ ID NO: 131814 - DNA, 600 bp, Homo sapiens
  misc_feature: GYAE6OF02I4O49.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttggggataaatatagctggctaggtatcagcagaacgcagccagtcccctgtgttgtcagtctatacaagatacaacgcggtaccctcgacgggactcccgtagacgcgaagtttctacgtcggctacccaacttcgtacgggtaacaccgagaccctaactccgtaagtaccctataccgaacggaccgggtaactccgaacggtaccttacgtccggtaattcggacggtactacggtacttaacttacgttcgtacgagggtcgtaggacgacgccgtacacgttgggtaacgttccgggacggtaacgggtacgaacgtcgtaccggaacccgttcggtacgtaccggtacgtacgggaccctaccggg

SEQ ID NO: 131815 - DNA, 553 bp, Homo sapiens
  misc_feature: GYAE6OF02G3FCD.49.85.H08.1.454.CMB.1.raw
  modified_base (458)..(458): a, c, t, g, unknown or other
  misc_feature (458)..(458): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttggggataaatatgactggctggtatcagcagaacgccaggccagtcccctgtgttggtcatctatcaagactaccaagccggccctgacgggactccgtgacgcgattcgtctggcctaccaattcgtaggaaccacgacgacctactcctacgaccatcgaggaccgggactacgagctaagtcgatgaaggtctagtactagttacgtgtacgaggccggtaggaccncgaccgacgtaccggttaggggtacgttcgggaacgggtacggtaacccgaagtccgtacggaccgtcgtaggacctacggaccgcccgtaacgg

SEQ ID NO: 131816 - DNA, 570 bp, Homo sapiens
  misc_feature: GYAE6OF02JCE8A.49.85.H08.1.454.CMB.1.raw
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
tcagagtcgagagacacgaccggtgctcgatttagtatcactcagtcgcggggcgtgggcctcaggaagcagcatcggaggtgcctcagccatggcatggatccctctcttcctcgcgtccttgcttactgcacaggatccgtggcctcctatgagctgactcagccaccctcagtgtccgtgtccccaggacagacagccagcatcacctgctctggagacaaagttggggataaagtatagctggctggtatcagcagaagcagccagtcccctgtgtcggtcatctatcaagataccaagccggccctnacggactcccngagcgattcacgtggcctaccacgtcgtagggaacacacgcctactcgtacgaccagtcacggcggactcgacggtctatcgtatgacggtctaggacttacgttaccgtaggtccgtaagggtccgttagggaaccgacggtcccgacgtaacgggttggggttaacgttccggggaacgggtacgggaccgaacgtccggtacggtacccggtcgtagggtaccgcgtaccggtcccctaacggg

SEQ ID NO: 131817 - DNA, 727 bp, Homo sapiens
  misc_feature: GYAE6OF02IMMKQ.49.85.H08.1.454.CMB.1.raw
tcagagtcgagagacacgaccggtgctcgatttagtatcactcagtcgcgggcgtgggccgtcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcacctgctctgagacaaattggggataaatatgctggctggtatcagcgagaagccaggccacgtccctgtcgttggtcatctatctaagacttaccgaagcgcccgtacgagggacttcccgagacggtacgtacttcgtctcgggtaccttccctaaacgtccgttacgggggaaaccaccgtaaaggccctaccgttaccgacggtaacccctaacttaccgaccggttacggggaaccctttacgaaacggggtccttaactacgggtaaacgtttcggaaacgggttctacccgtaaagtttaaccgttaaaccgttcggtaaccgtaacggggtcgggttacgggtaaccgtaacgccccgggtacctaagggtttccgggggttaaagtttcccgggggtacgggggtaaaccggggacccggtaaaacggtttccggtaacccggtaacccgggtttcccgaaccggggttaacgttcccggtaaaccgggccccgttaaaccccggggg

SEQ ID NO: 131818 - DNA, 647 bp, Homo sapiens
  misc_feature: GYAE6OF02INDJ1.49.85.H08.1.454.CMB.1.raw
  modified_base (222)..(222): a, c, t, g, unknown or other
  misc_feature (222)..(222): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatccacctgctctgganacaagtggggataaatatgctggctggtatcagcagaagccgaggccacgtcccctggttgttggcatctatcaagactaaccaagccggaccctagacgggactcccgtgacgtccgtatttctcgtcggaccttaccgaacttccggtacggaaccaccgaacgaccctacctccgacgaaccctataccgaggccgggtactccgacggtacttagtacgagtacggacggtctagtaacttagttaaccgttggtaccggacgggtacggtacgggtaaccgacggcccgtacgtaaccgggttagggggttaccggttccgggggaacggggaaaccggggtaaccgtaacggtccggtaacggtccccggttaccggtacgggtaaccgtacccggaacccggtaccccggtaaccggg

SEQ ID NO: 131819 - DNA, 720 bp, Homo sapiens
  misc_feature: GYAE6OF02JEEQQ.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacacgccagcatccacctcgctcgtggagaacgtaaaggttagggggtaataaagtatcgacgtggcgtggtatcgacgcgaagaacgaccgacggacccacggttacccccgtggttcggttcgggttactacgttcttaacttacgaaacgtaacttaaccgaaacggtcccggtcccctacgacggggtacctcccggttacggacgtcgtactttacgtcgtcggtccctaccgtaaccgtcggtacgggaacctacgaacgtcccgacttaccgtcgaaccctacgtacgacgggaccgggtacctaccgacggtacgtaacgtccggtaagtcggacggtctaccgttaacttaagttttaccgtacgtcggacgggtacgggttaccgggaccgacggtaccgacggttacggttacggggttagttcccgggggaacggtaacggggaaccgtacggtacgtacccggtacccgttccggttaggaccgggttaccacccgggaccgtaacccggg

SEQ ID NO: 131820 - DNA, 727 bp, Homo sapiens
  misc_feature: GYAE6OF02H42H0.49.85.H08.1.454.CMB.1.raw
tcagagtcgagagacacgaccggtgctcgatttagtatcactcagtcgcgggcgtgggcctcaggaagcagcatcggaggtgcctcagccatggcatggatccctctcttcctcgcgtccttgcttactgcacaggatccgtggcctcctatcgagctgactcagcccaccctcagtgtccgtcgtccccgaggacacgacagccagcactccactcgctcctggagaacctaaagttcggggtaataaattagtacgctggactggtataccgagacagaacgcgacgaccgacgtaccccgtgttcggttcgtactacgttactatacgtaaacgtactaaaccggtaacgcccggtacccgacggtaccggtaacctccccgtagaacgggtacctaacgtttccgtacgtccggtaccctactaaccgtcgtaacgggaacctaccgacgtaccgaccttccgtacgaacctacgtacgtaccggacggtaccgacgtacgtccgttaagtacgagtaccggcgttacgacgttaacgtttaaccttacggtacgtacggtacggggtaccgttacggggaacgttcccggaccgtccgggtaaccggttaggggttacccgggtttacggggaaccgggtaacgggacccgtaaacgggttcgcccgggttaaaccggttccggtacggtacccgggtaacgtccggtaacccccgacgggg

SEQ ID NO: 131821 - DNA, 631 bp, Homo sapiens
  misc_feature: GYAE6OF02H92XC.49.85.H08.1.454.CMB.1.raw
  modified_base (235)..(235): a, c, t, g, unknown or other
  misc_feature (235)..(235): n is a, c, g, or t
tcagagtcgagagacacgaccggtgctcgatttagtatcactcaggtcgcggggctcgggcctcaggaagcagcatcggaggtgcctcgacgccatggcatgggatccctctcttcctcggcgtccttgcttactgcacaggatccgtggcctcctatgacgctcgactcacgccaccctcagtgtccgtgtaccccgaggacaggacagccagcactcgacctgctcgtagganactaagttgggggataacgtagtgctaggctaggtatcgagcaagacgccgagccagtcccctaggtcggttcggtctattactagtaccgaagactaaccgtaagccggcctcgaggactcccgtggacgcgtattacgtcgtcggtcctaccaactcgtacgggaacctccgacgcctaacgtccgtacgaacctagtaccgacggaccggtaacttcgacggtctaactaccgtaagtcgaggtctacgtacttacttacgtcgtacgacggtacggttaggaccgacgtaccgacgtacggtacgggttacgttcggggacgggaacggtaccggaacgtccgtacggttaccgtaccgttaggaccggttcacccggtacccgtaaccggg

SEQ ID NO: 131822 - DNA, 683 bp, Homo sapiens
  misc_feature: GYAE6OF02JCV2G.49.85.H08.1.454.CMB.1.raw
  modified_base (227)..(227): a, c, t, g, unknown or other
  misc_feature (227)..(227): n is a, c, g, or t
tcagagtcgagagacacgaccggtgctcgatttagtatcactcagtcgcgggcgtgggccgtcaggaagcagcatcggaggtgcctcagccatggcagtggatccctctcttcctcggcgtccttgcttactgcacaggatccgtggcctcctatgagctgactcagccaccctcagtcgtccgtcgtccccaggaccagacacgccagcagcacctgctcctgganactaagtggggaactaaagtatgactggcttggtactcagtcagacgcgacggccaacgtcccctgttagttcggtactatcttagactaaagactaccgaacgccgtccgttacgacgggtaaccttcccgtaggtacgtaccggtaattttccgtaccgttacgggtcccttaacccgtaaccggttaccggtacgggtaaaccaacgtacggtaaccccgtacgtttcccgaacggtaaccctacgttacgacggtaccggaccttacgacgtaccttacgtccgtagtacggacgtcacggttaacttacggttacgttcgtacgtaaccggttcgggtcgaaacgtcgtaccgagttaaccgttgggtaacgtcccgggaacgggtacgaacgtacgtaccgtacggtaacccgttcgtaacggtacgtccgtacggtacccgtaaccggg

SEQ ID NO: 131823 - DNA, 759 bp, Homo sapiens
  misc_feature: GYAE6OF02G18D4.49.85.H08.1.454.CMB.1.raw
  modified_base (263)..(263): a, c, t, g, unknown or other
  misc_feature (263)..(263): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacacgacagccagcactcacctcgctcgtggagacaaagttgggggaataaatatagcgtggtcgtggtancgagcaagaacgcccgaacggcccgtaccgtcccccgtggttcgttcggtactagttacctaatacgaaagacctaaccgaacggccggtaccctcggacggtacgtccccgtaggaccgtaccgtacttttccgccgttcgggtaccccttacccgtaaccgttacccggttaggggaaaacccaccgtaaccgaccccgtaccttaccgtaacaaccctacgtaccgggaccggtaccgggacccgtacgtaaccgggtaccttaaacgtccggaagtacggaccggtacgttaccgtaacgttaacgttaccgttaacgggccggttaacggggcgggttaccgggaacgacggtcccgaccgggtacgggttagggttacgggttccgggggaacggggtaacgggaaccccgtaagggtcccggttaacccgggaccccggtttaccggtaggtaaccgggtacccgtaacccggtacccgggtaacccgg

SEQ ID NO: 131824 - DNA, 615 bp, Homo sapiens
  misc_feature: GYAE6OF02GLPAB.49.85.H08.1.454.CMB.1.raw
  modified_base (245)..(245): a, c, t, g, unknown or other
  misc_feature (245)..(245): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagaacaaaagttgggggaataaaatangactggctggtatcagcaagaagccaggccacgtcccctgtgttggcatctatcaagataccaagccgacctcgacggactccctagacgcgattctcgtgcctaccaactcgtagggaacctacacgccaactcgtacgacctaactcgaacgggacgggtacctacgaaggtacgttaacgtacggaattgggaacgtctagtaacttaattactggtacgagggtaccgtgggaacacggaccgtaccgagggttacggggtaacgttccggggaacggggaacggggtaacccgaaacggtacccgttacgggtaacccccggttcgtacgggaacgttacccgaacgggtcccccgtaaacgggg

SEQ ID NO: 131825 - DNA, 612 bp, Homo sapiens
  misc_feature: GYAE6OF02FX2LG.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatccacctgctctggagacaaagttggggaataaatatgcgtggctggtatcgagcagaagccaggccacgtcccctggtcgttcgcgactctatcaagactaaccaagccgcctcgaacgggtacctcccgtagacgcgtatttcgtcgtggacctaccaacttcgtagggaaccacgacgtccctacgtccgtacgaaccgtataccgacgggtaccgggtacctaccgacggtacttacgtacgtagtacgagggtccttaaggaccttaagttacgtgtaccggtaggtccgggttacgacgacggtccgaccgtagggttacggggtctaccgggggacggaaccgggacctaacggccgtacggtacccgttccgaggtacgacgtacgacccggtaaccgg

SEQ ID NO: 131826 - DNA, 813 bp, Homo sapiens
  misc_feature: GYAE6OF02G3D7G.49.85.H08.1.454.CMB.1.raw
tcagagtcgagagacacgaccggtgctcgatttagtatcactcagtcgcggggctgggcctcaggaagcagcatcggaggtcgcctacagccatggcatggatccctctcttcctcggcgtccttgccttactgcacaggactccgtggcctcctatgagctgactcacgccaaccctcagtcgtccgtcgtcccccgaggtacacgaccacgacctacggccacgtcccgaaccttcggtccgtacgttacgggaacgaaccgtaaaaggttacggggggtaaattaaaacgtaagttaggaccgttcggtaccgttagggtacttaccgaaggtaccgaaggaaacgacccgaggaccccgtaacggttccccccttaggtttaggtttaccggggtacctaacggttaccttaaacgtacctaaacggtaaccttaaacccgaaacggtccggtaccccgttacggaacggggtaccttaccccggtaggtaacggccggttacttttaccggtcgttcggacccgttaccctaaaccgttccggttaccgggaaactacccgacggaccctacctcgttacgaacccctagtccgacgaccgggtacctaccggacggacttaacgacgtagttacggacggtactacggtaaccttaacgttaacgtcggtacgtaacgggtacggtaacgggaccacggccgtacgacggttacgggttacggttccggggtaacggaccggtacccgtaacggtccgtacggtacccgttcgtacgtaaccggccgtaacccggcctaacccgggg

SEQ ID NO: 131827 - DNA, 663 bp, Homo sapiens
  misc_feature: GYAE6OF02G1HEG.49.85.H08.1.454.CMB.1.raw
  modified_base (220)..(220): a, c, t, g, unknown or other
  misc_feature (220)..(220): n is a, c, g, or t
tcagagtcgagagacacgaccggtgctcgatttagtatcactcagtcgcggggctgggcctcaggaagcagcatcggaggtgcctcagcctatggcatggatccctctcttcctcggcgtccttgcttactgcacaggatccgtggcctcctatgagctgactcagcccaccctcagtcgtccgtcgtccccaggacagacagccagcatcactgctcgngagactaagtaggggataaatatgcgtggctgatatcagcagaacgccgacggcctacgtcccgtgttcggtcggtcatctatacaagactaccgaagccgcctagacggtctaccgtagaccgacgtattccgtacgtcggtaccctacccgtacgttaccggacggaacaccgaacgaccctacctcgtccgaaccctcgtacgaccgggtaccgggtacctacggtacggtacctagtaacgttggaaggaccgtagtaccgtaacttaccttacgtcggtaccggtcgggtacgggttacggacgttaccggcccgtaacgtcgggtttacgggttaccggaccgggggtacgggtaaccgggtaacccgtaacggtacccggttacgtaccccggttacggtacgggtaaccgtacccggacccggttaaccccgggg

SEQ ID NO: 131828 - DNA, 630 bp, Homo sapiens
  misc_feature: GYAE6OF02IY9Q7.49.85.H08.1.454.CMB.1.raw
  modified_base (508)..(508): a, c, t, g, unknown or other
  misc_feature (508)..(508): n is a, c, g, or t
  modified_base (617)..(617): a, c, t, g, unknown or other
  misc_feature (617)..(617): n is a, c, g, or t
tcagagtcgagagacacgaccggtgctcgatttagtatcactcagtcggcgggcgtgggcctcaggaagcagcatcggaggtgcctcagccatggcatcggatccctctcttcctcggcgtccttgcttactgcacaggatccgtggcctcctatgagctgactcgacgccaccctgagtgtccggtcgtccccgaggacagacagccagcatccacctgctctaggagacgaacgttgggaataatatgctggctggtactctagcgagtacgccgaggccacgtcccgtagtggttcgtcagtctagacgtaagtacgtaaccgacggtaccggccgtacggaacggtacctacccggtagacggtaccgttacgttccgtacggtcggtaccctacccgtaacgtcccggtaacggaacctacgaccgtaccctacgtactaccggcctaagaccgtaggccggtacaggaccgtctagtcaggtcgacggtctcggtaaacttnttacggttggaccgaagggtccgtaagggtccacgtccgacttacgggtcgggtacgttacggggacggtacggacctagccgttaaccggacttccggtagcgtaccnccggacgtaccgg

SEQ ID NO: 131829 - DNA, 718 bp, Homo sapiens
  misc_feature: GYAE6OF02H6X8B.49.85.H08.1.454.CMB.1.raw
  modified_base (243)..(243): a, c, t, g, unknown or other
  misc_feature (243)..(243): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccgaggacagacagccagcatccactgctcgtggagacaaagttggggaataaatntgctggctggtatcagcaagacgccgacggccacgtcccgtgtggttcgctatcgtatacaagacaaccgaagccggaccctacgaggcctcccgtagcgcgtacttctcgtcgacccttaccaacttcggtacggaacaccgacgtacctacttccgtaccgaacctataccgagggaccgggactcggtaaccgggtacttaccgtacggtagtacgggtacgtccgttaaggtaacctttaagttaaccgtttgggtacccggtaggggtaccgggtaacgggccgaaaccggccccggtacgttaacggggttaccgggggtttaaccgggtttaccggggggacccggggtaaaccggggtaaaccccggtaacgggttaccccgggtaccgggtttaccccccgggttaaccggtaccgggttacccgggtaaaccctaccccggggaacccccgggtttaacccgggg

SEQ ID NO: 131830 - DNA, 649 bp, Homo sapiens
  misc_feature: GYAE6OF02ILPFR.49.85.H08.1.454.CMB.1.raw
  modified_base (222)..(222): a, c, t, g, unknown or other
  misc_feature (222)..(222): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatcacctgctcgtgganacgtaaagttggggaataaatatgcgtggcttggtatcagcagaagccacggccacgtccccgtgttcggttgtcgtatctatcgaagactaccgacgccgccgtacgacggactcccgtagacgtcgtattcgtctcggctacctactcgtacgggaacctacgacgacccgtactaccgtaccgaacctaacgtaccgtacggtaccgggtacctaccggacggttacgttacggtaccgagtacggacggtcgtaacgttaacttaacgtttacgttacggtaccgagggttacggtacggaccgaccgacccggtcgtaacgggttacgggttaacggttccggggaaccgggaacgggacccgtaacggtcgtacccggtacccgtccggtaggtacgtacccgacggtacccggtaaccgg

SEQ ID NO: 131831 - DNA, 665 bp, Homo sapiens
  misc_feature: GYAE6OF02I4YGS.49.85.H08.1.454.CMB.1.raw
  modified_base (202)..(202): a, c, t, g, unknown or other
  misc_feature (202)..(202): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccngcatcacctgctctggagacaagtggggataagtatgctggctggtatcagcagaacgccgaggccacgtccccgtagttgtggtcatctatacgaagtactaccgaagccggtcccgtaggacggtactcccgagacgaccgtacttccgtcgtacggaccttaccaacgtccggtacgggaaccacgaccgtaccctaccgttccaacggtacctacgtaccggtacgggccggtaccgtacgtacgggtacttaacgtcggaacgtggaacggtactacgtaacgttaagttaccgtacggtacggtacgggtccgggttacgggaaccgtacggcccgacgttaccggggttacggggtttagtcccggggaacgggtaaccgggtaaccggtaacgtcccgtaccggggtacccgtcccggtaagggttccgtaccgacccgggtacccgtacccggg

SEQ ID NO: 131832 - DNA, 620 bp, Homo sapiens
  misc_feature: GYAE6OF02IG98P.49.85.H08.1.454.CMB.1.raw
  modified_base (217)..(217): a, c, t, g, unknown or other
  misc_feature (217)..(217): n is a, c, g, or t
  modified_base (308)..(308): a, c, t, g, unknown or other
  misc_feature (308)..(308): n is a, c, g, or t
  modified_base (445)..(445): a, c, t, g, unknown or other
  misc_feature (445)..(445): n is a, c, g, or t
  modified_base (478)..(478): a, c, t, g, unknown or other
  misc_feature (478)..(478): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacagatccgtggcctcctatgagctgactcagccaccctcagtcgtccgtcgtccccaggacagacagccagcatcacctgctcngagactaagtggggaataaatatgcgtggtctggtatcagacagaacgcgacggccacgtcccctggtaggttggtctatctactacgaanactaaccgacggccgacctacggtacgggtacctcccgtagacggtacgtactttcgtcgtcggtcctaccaacgtcggtaacggaaccacgaccgaccctacacgttacgacctaaggtccgaacggacggtaccncggtacgtacttacgtacgtgtacgtcgtaacncgttaactacgttacgtacgcgtaagggcggttacggacgtacgcccggtagtacgggtaggggttacgtcggggaacggtccggaacggtaacgtccgtaaccggtccggtagtccggtacgacccgacgtacccggacgg

SEQ ID NO: 131833 - DNA, 688 bp, Homo sapiens
  misc_feature: GYAE6OF02IV221.49.85.H08.1.454.CMB.1.raw
  modified_base (303)..(303): a, c, t, g, unknown or other
  misc_feature (303)..(303): n is a, c, g, or t
tcagagtcgagagacacgaccggtgctcgatttagtatcactcagtcgcgggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccagcatcacctgctcgtggagacgaaagttggggaataatatgctggctggtatcagcagaagccaggccacggtcccctggtgttcggtacactctacncaaagtacttaaccgaacggtcccggtaccctacggacggggtaccttaccccgtaggacggtcgtaacgtttccgtacgttccgggtacctaccctaacgttaccgttaacggggaaacctacgaaccgtccctaaacccttccgtacgaacccctaggtacccaagggtaccggacgtccggaacgggttcctacgtacgtaggtgtaggtccgttacgggtaactttaacgttacgtcggtacgtacggggtccgttacggggactacgggtacccggtactacggggttacggggttaccgtaccgggggaggtaacccggggacgtaaggtacccggtccgaacccgttcggaggtaccgtaccgacggacccgtaacgg

SEQ ID NO: 131834 - DNA, 529 bp, Homo sapiens
  misc_feature: GYAE6OF02G6PB6.49.85.H08.1.454.CMB.1.raw
  modified_base (382)..(382): a, c, t, g, unknown or other
  misc_feature (382)..(382): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagtggggataaatatgcgtggctggtatcgagcagaagccgaggccacgtcccctgttcgttgtcatctatcaagactaccgaagccgccctcgacggctccgtgagcgacttctctggctccaactcgtacggaacacgacgccactcgacgaccancgaggcggtactacgacgtctcacgtatcggagtctacgtacttagtactgtcgacggtcggacggacgcgacgcgaggttcgggtacgtcgggacgggacggacggaagtccgtagtcccgtacgtggacgcgtacgccgtaccgg

SEQ ID NO: 131835 - DNA, 661 bp, Homo sapiens
  misc_feature: GYAE6OF02H9RK6.49.85.H08.1.454.CMB.1.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccggtggcctcctatgagctgactcagccaccctcagtgtccgtcgtccccaggacagacagccagcactcacctgctcngganactaaaggttgggaataaatatgctggtctggtatcagcaagaacgccgaacggccaccgtccccttggttcgtttcggtactactactactacgtaaagtaactaaccgaacgccgccctacgacgggactcccgtgaacgtcgttacttttcgtggtacctaccgaagtcggtacgggaaccaccgggtccctaccgtcgacccgtagacggtaccggtagggtacggaacgggcggggaatcgggaacggaccggtaactagtactcgtcgtacggtagggttggtagggtagttaggtaggtacgttcgtcggtttacggttcggggtacgttccggggaggtacgggtaccgttagggttccgtaccggttcggttacggtacgacccgtacggacggtcccgttacccggccccggtttaccgtctacccgg

SEQ ID NO: 131836 - DNA, 746 bp, Homo sapiens
  misc_feature: GYAE6OF02G0JR6.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagaccagccagcactcacctgctctggacacgaaagttaggggaataaagtatgacgtggactaggtatcagcgaagaacgccaggccacgtccccgtgtcgttggtcatctatacgaagactaccgaacgccggtccctacgacggtacctcccgagacgcgtacttcgtcgtcggtcctaccgtaccgtacgtacggaacaccgacgtacccgtacttaccgtaccgaaccgtaacgttacggacggtaccggggtaccgttaccgtaaccggtcttaacggaaccggtagttacgggaccgggttactacggttacgtttaacctttaggttaccgtacccggtagggtaccgggttacgggtaacgtacccgggtaccggtaccggttacggggtttacggggttacgggtttaccccggggggaagggtaacccggggtaacccgtaaggttaccccgggtttaccgggttaacccccgggtttaccgtaacggggttacccggtaacccgggtaaccccgggtaaccccggttaacccccggggg

SEQ ID NO: 131837 - DNA, 536 bp, Homo sapiens
  misc_feature: GYAE6OF02IMNM4.49.85.H08.1.454.CMB.1.raw
  modified_base (301)..(301): a, c, t, g, unknown or other
  misc_feature (301)..(301): n is a, c, g, or t
  modified_base (378)..(378): a, c, t, g, unknown or other
  misc_feature (378)..(378): n is a, c, g, or t
tcagagtcgagagacacgaccggtgctcgatttagtatcactcagtcgcgggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagccagcatcacctgctctggagacaaagttggggaataaatatgcgtggctggtatcagcaagaagccaggccacgtcccctgtgttgcatctatacaanataaccaagccggcctcgaggactccctgacgcgattctcgtcgctacctaactcgtaggaacacgacgaccactcncgaaccatcacggcggactcgagtctaatcgatggagctagtattaattactggtacgagggtcggtagggacgtacgccgacgtacggtggggtacgttcggggacgggtaacgggaccgaacgtcgtacgcgtccgtagacgtcacgcccgaacgg

SEQ ID NO: 131838 - DNA, 832 bp, Homo sapiens
  misc_feature: GYAE6OF02IRNON.49.85.H08.1.454.CMB.1.raw
  modified_base (228)..(228): a, c, t, g, unknown or other
  misc_feature (228)..(228): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcacgccaccctcagtcgtccggtcgtccccgaggacagacacgccagcactcacctgctcgtgganacgtaaaggttggggaataaatagtgcgtggtcgtaggtactcgagacaaggaacgccgacggccctaccgtccccgttggttcggttcggtactacttcgtaactacgtaaagtaaccttaacccggaacggtccccgggtcccttaccggaacggggtaccttccccggtaggtaacggtaccggttacttttcccgtacggtttacccgtaccgtaccccgtaaaccgtttacccggtaaccgggaacccgtaacccgtaaccggtaccccgtaaccgttaccgtaaccgtaaccctaccggtacggaaccgggtaccggggtaacctcgggtaaccggtaccttacggtaacggtagtacgggtaccgttaccgttacgtttaaaccgtttacggtttacccgttagggtaccgtacgggggttacgggacgggtaacccgtaccgggcccggtaacccgggtacgggtttaccgggggtacggttacccgggggaaccggggttaaccgggaacccggtccggttaaccccgggttaccggtaccccgggtttacgtacccggtacgggttaccgaacccgggtccccgtaacccgggg

SEQ ID NO: 131839 - DNA, 697 bp, Homo sapiens
  misc_feature: GYAE6OF02IT1PF.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcacgcccacccctcagtcgtccgtcgtccccgaggaaccagacacgccagcactcacctcgcctcgtaggaagaacgaaaggttgggggaataaagtagtacggcgtggtcgttaggttatcgagacgaacgaacgacccgacggtacccaccggttccccgttggtttcggtttacgggtactaacttaccgtacgttacgtaaacgaaccttaaccgaacggtcccggcccggtacggtacggggtaccttcccgtaggaccgtaccgttcgtttccgtcgtaccggtacctacccgtaaccgtccggtacggaaccaccgacgacctaccgtccgacgtaaccgctaccggacgggaccgggtacctacggacgtcgttacgtacgtagtggacgtactacgtattacgttagtcgtcgacgggtcgtacgggacacggaccgacggtaggttacgggtccggtacggggaggaccggacgtaacgtccgtaccggacgttccgagtccgtaacggaccgtacccggaccgg

SEQ ID NO: 131840 - DNA, 736 bp, Homo sapiens
  misc_feature: GYAE6OF02G1LAC.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatcacctgctctggagacaaagttggggataaatatgactggtctggtatcgagacaagaacgccgacggaccacgtcccctggttcggttcggtctaactctactacaaagacttaaccgaaggcccggtacccgtacgaacgggtacctcccgtaggacgacgtaactttctcgtacggtcctaaccgtaactacggtacgggaaaccaaccgacgtacccgacttccgtacgtaaccctagtaccgaacggtccgggtaacctacggacggtaccttaacgtaccgtaagttacggaacggtccgttagtaacctttaaacgtttacgtacggtacggtaacgggttaccgggttacgggaacccggaccgtacccgggacgttaccgggtttacgggggtacgtttaccgggggaaccgggggttaacgggaaacccgggtaacggttacccggggttcccggtaacccgggtttccgtaacgggttacccggtaacggtacccccgggaacggttaacccccgggg

SEQ ID NO: 131841 - DNA, 581 bp, Homo sapiens
  misc_feature: GYAE6OF02JB6FE.49.85.H08.1.454.CMB.1.raw
  modified_base (253)..(253): a, c, t, g, unknown or other
  misc_feature (253)..(253): n is a, c, g, or t
  modified_base (418)..(418): a, c, t, g, unknown or other
  misc_feature (418)..(418): n is a, c, g, or t
  modified_base (459)..(459): a, c, t, g, unknown or other
  misc_feature (459)..(459): n is a, c, g, or t
  modified_base (475)..(475): a, c, t, g, unknown or other
  misc_feature (475)..(475): n is a, c, g, or t
  modified_base (565)..(565): a, c, t, g, unknown or other
  misc_feature (565)..(565): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcactccacctgctcgtggacaacgaaagtggggaataaatatgcgtggntagtatcagcaagagccgaggaccacgtacccgtgttacggttcgtctagtactagtacaagtactaacgaacgccgtcccgtagacggtacctacccgtgtaaacgcgtactactcgtggacctacactcggtaccgacacacgccctactacgcacctaacgngacggccggtactacggacgactaacgtcgacgtgtaccgntaacgattacgttacncgtacgagtaccggttagacgacgtcgacgtacgggtggtaccggtcggggacggacggtaccgagccgtacggaccgttcgaaggaccncgtacgcccgtaacgg

SEQ ID NO: 131842 - DNA, 743 bp, Homo sapiens
  misc_feature: GYAE6OF02JK1ZE.49.85.H08.1.454.CMB.1.raw
tcagagtcgagagacacgaccggtgctcgatttagtatcactcagtcgcggggctgggcctcaggaagcagcatcggaggtgcctcagccatggcatggatcctctcttcctcggcgtccttgcttactgcacaggatccgtggcctcctatgagctgactcagccaccctcagtcgtccgtcgtccccaggacagacacgccacgcatcgacctgctctaggacgacaaaggtggggaataagtatcgtacgtggcgtaggtactcgagacgtaagacgtccgaacggcctaccgtcccgtggtcgttcggtactacttccgtaatacgaacgtacttaaccgaacggtcccggacccgtacggaacggaccgttcccgtacggtacgcgttacttcgtacgtcggtaccctacgtaacgtcgtacggacctacgaccgtctaccgtactaacggaacctcggtacgacgggtaccggaccgttagaccggtcttaacggtccgtaaggtcgggaaacgttccgttaagtaacccgtttagttaccgttacggtcgttaaccggggtacggttaccgggaaccgtccggaaccggtccgggttaacggttacgggggttacgtaacccgggggtgggttaaacccggccggtaaaccgggtacccggttaaccccgggttaccggttaccgggtacccgtttaaccgggacccgttaccgggaacccccggttaacccgggg

SEQ ID NO: 131843 - DNA, 748 bp, Homo sapiens
  misc_feature: GYAE6OF02GYO5W.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctacagtcgtccgtcgtccccaggacagacagccagcatccactcgctcgtggacgaacgtaaaggttaggggaataaaagtacgtggtacgtggtcgtaggtactacgagtacgaagaacggccgacggtcccgtaaccgtcccgtggttcggttacggtctattctatacgaagtactaaccgacggcccggccgtacgacgggtaccctccgtagtacgtacgtactttccgtcggtaccgtctaacccgtaccgtacggtaaccggaacaccgtaccgtaccctacgtaccgtacgaaccctagtaccgagggacccggtaacgtccggaacgtacgttacgtaccggtagttacgggtcgtaccgttaacgtacgttacgttacgtcggtaccggtagggtacgggtacggtaccggaccgtaacccggtcgggttaccgggttacggggttacgggtaccgggggtaaccgggaaccgggtccggttaaacccggtcggttaaccccggttacccggttacggggtaccggtaacccggttccgggaaccccggttaccgggtaaccccggg

SEQ ID NO: 131844 - DNA, 702 bp, Homo sapiens
  misc_feature: GYAE6OF02FPB5D.49.85.H08.1.454.CMB.1.raw
  modified_base (405)..(405): a, c, t, g, unknown or other
  misc_feature (405)..(405): n is a, c, g, or t
  modified_base (500)..(500): a, c, t, g, unknown or other
  misc_feature (500)..(500): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacacgccacgcactaccacctgctcgtggacgaacgtaaaggttgggggtaactaaaagttatcggtcgtacggtacgttaggtaacttcagtacgaagaacggccgaacggacccgtaccggtccccgttgttcggtttcggtcctactacttaataccgaaagtaacctaaccgaacggtccggaccctacgacgggtactccccgngacgtacgtatttccgtacgtcgtccgtacctaaccgtcggtacggaacctacgacgcctaactcgtacgacctactacgacggtaccgggtacncgacggtactacgtacgtagtacggtcggtactagtaacctttagttacgtcggtacgtaccgggcggttcgggaactacggccgttaccgtcggggttaagggttccggtaccgggggtaacggaaccgggtaaccgtaaccggtccggtaacgttacccggaccgttagggtacgtcccggaacgtacccggtaaccggg

SEQ ID NO: 131845 - DNA, 636 bp, Homo sapiens
  misc_feature: GYAE6OF02GIW7J.49.85.H08.1.454.CMB.1.raw
tcagagtcgagagacacgaccggtgctcgatttagtatcactcagtcgcggggctgggcctcaggaagcagcatcggaggtgccgtcagccatcggcatgggatccctctcttcctcggcgtccttgcttacctgcacaggatccgtggcctcctatgtacgctgactcagccaccctcagtgtccgtgtcccctaggacagacagccaagcatcacctgctacttggagacaaagttgggggaataaagtatagctggtctggtatcagcagtaacgcctaggccagtccctgtgttggtctatactatcaagaactaccgaacgcgtccctacgacggtactcccgtgacgcgtatttcgtcgtggctacctaacgtccgtaagggtaacacgtacgaccctacgtcgtacgaccacgtacgacggaccgggtactcgaacgggtccttaagtaccggtacgtacgggacggtccgtacgtaccgttactttacccgtgtacccgacggtcggtacgggtacacggtccgacgtaccgttaggggtacttaccggggacgggtaacgggtaaccaaggtccgtaaccggacccggttaccgtaggtacggtacccgtaacggacccctaacggg

SEQ ID NO: 131846 - DNA, 863 bp, Homo sapiens
  misc_feature: GYAE6OF02IGY2Z.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatcgtggcctcctatgacgctgactcacgccaccctcaggtcgtccgtcgtccccaggacagacacgccagcactccacctgcctacgtacggaacgtacgtaaaaggttaggggggaaattaaaaagttcgtaggtacggttacggggttcgttacggggtttaactaccgacggaacgaaacgggtaaacggacccggtaaaccgggtcccgtacccggttacccccgttgggtttaccggttttcgggtaactaccgtttacctagtttaaccgaaacgtaaacctaaccgtaaaccgggtccccggtacccgttacgggaacgggtacctcccgtaggaacgtaccgtactttccgtaacgtccggtacctacccgtaacgtaccggtaacgggaactaccgaaccggtacccttaccgtacgtaaccgtaaccgtacgtacggtacgggaccggtacctacgggtaacgtaccttaagtcgtaacggagtccgggtaactaaccgttaacttacgtttacccgaggtttaacccgggaggggttaccggggttaacgaaccggtaaccgggtcccggtaaccggttacgggggttacggggtttacgggttaccgggggaaccgggtaacccgggaacgtaaaccccgggtcccgtttaaaccggggtaccctacgggttacgtaacccgggttaccgaccccccggtaccggtacccggg

SEQ ID NO: 131847 - DNA, 695 bp, Homo sapiens
  misc_feature: GYAE6OF02HGEUA.49.85.H08.1.454.CMB.1.raw
  modified_base (222)..(222): a, c, t, g, unknown or other
  misc_feature (222)..(222): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcactaggatccgtggcctcctatgagcgtgactcagccaccctcagtcgtccgtcgtaccccagacagacagccagcatcactgctctganacaagtgggataaactagtgctggctggtatcgacgcagaacgccgacgacctaccgtaccccgttggttcgttacggtcctaacgttctaacgtacaaacgtactaaaccgaacggtcccggtacccgtacggaacggtcccgttacctacgggtaagaccggtactttacccgtcgttccgggaccttacccgtaaaccttccgggaaaccggtaacccgacgtaccggacccttacgtaccgtaccgtaacctacgtacgtacgggaccggtacctagtacgggtaactacggttacgagtacggaagtctacgtacttacgtaacgtcgtaggtaccggtcggttaacggaccgtacggcccgtaagtaccgggtttacgggtaccggttccgggtaaccgggtaacggtacgaaccggttcgaccgttaaccgcggttacgaccgtacccggtaccggaccgtaccgg

SEQ ID NO: 131848 - DNA, 771 bp, Homo sapiens
  misc_feature: GYAE6OF02GP5OB.49.85.H08.1.454.CMB.1.raw
  modified_base (202)..(202): a, c, t, g, unknown or other
  misc_feature (202)..(202): n is a, c, g, or t
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtcccccaggacagacngccagcatcacctcgcttcgtggagaactaaagttgggggaataaagtatgctggctaggtatcagcagaagccgaggcctacgtccccttaggttcggttggtcctaagtctaactacgaaacgtaacttaacccgaaacggtccccgggtacccctaacggtaacggggtaaccttacccccggtacgtaacggtaccgtaacgttttcccgttaccgttacggggtaccccttaacccggtaaacctttacccgggttaacgggggaaaaccctaacccggaaccgtacccgtaaccgttacccgttacggtaaacccctacgttaccgtaacgggcccgggtaaccttacggacggtacttaacgtacgtaagtcggtagccgtacggaacgttaacgtttaccgtagtaccggaacgggtcgggtacgggtaccgacggcccgtaccggtaggtacggggttaacggtacccggggtaacggggaacgggtacccgaaaggtcccggtaacgtacccgggttcccgacgggtaccggtaaccggtaccggaacccgtaaccggg

SEQ ID NO: 131849 - DNA, 715 bp, Homo sapiens
  misc_feature: GYAE6OF02HOSBN.49.85.H08.1.454.CMB.1.raw
  modified_base (113)..(113): a, c, t, g, unknown or other
  misc_feature (113)..(113): n is a, c, g, or t
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (693)..(693): a, c, t, g, unknown or other
  misc_feature (693)..(693): n is a, c, g, or t
tcagagtcgagagacacgaccggtgctcgatttagtatcactcagtcgcggggctgggcctcaggaagcagcatcggaggtgcctcagccatggcatggatccctctcttccncggcgtccttgcttactgcacaggactccgtggccctcctagtgacgctgactcacgcccaccctcagtcgtccgtcgaccccgaggaccacgaccagccgagcgtacnccgtacctcggctacgaggtacgaaccgtaaaggttacggggaattaaagtagtgcgtaggtcgttaggtancgtaagcaagtaacgaccgacggtaccctaccgtcccggttggtccggtttcggactaacgtctaacgtacgaaagtaccgaaccaccggtccgtacccgtaggacggtaccgtaccgtggaacggtccgttattccgtaccgtcgtacctaacccgtaccgtacgggtaaccggactaacccgtaaccgacctaccggtaccttccggaacctcgtacggaaccgggcccgttactaccggagtaccgttacgacggtacggaggacgttaccgagtaaccgttacgttacccggtaggccgttaacggccgggtactaccgggacctccggaacggttcggttacgaccggggttacgggaacgggtaccacggtaccgtcggacccgttccgtagnggtaccgacgaccgcgtacccg

SEQ ID NO: 131850 - DNA, 719 bp, Homo sapiens
  misc_feature: GYAE6OF02H20N5.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggatcccggtcggccctcctactgacgctgactcagcccaccctcagttgtccggtcgtaccccaggacaacgaccacggccagcactcctaccctgcctcgtggaagaacgtaaagttagggggaaattaaatatgtcgtggtcgtgtagtctagacgaaggacgaccgacggaccgtccgtttcccgtggttcggtcgttactagttactacgtacaaacgtacgtaaccgaacgccccggtaccctacggaacggtctaccgtcggacgacgtacgtttcgtcggtaccgcctaacctaccgtacggtaccggaacctacgaccgtaacctccttaccgacccgtaccaggtacccggtacgggaacccggttctacgggaacggtccttaaccggtaggtacgaggtacgacttcgttaaccgttaattcggtactacgggaggtacgggtaccgtagacccgtcgtacggttaccgggttacgggttacgtacgggggaacgtacccgggaacttaccggcgttaacccggacccgtttgggtacccgacttaacccgggccggtaaacccggtcccgg

SEQ ID NO: 131851 - DNA, 697 bp, Homo sapiens
  misc_feature: GYAE6OF02IP7O4.49.85.H08.1.454.CMB.1.raw
  modified_base (136)..(136): a, c, t, g, unknown or other
  misc_feature (136)..(136): n is a, c, g, or t
  modified_base (230)..(230): a, c, t, g, unknown or other
  misc_feature (230)..(230): n is a, c, g, or t
  modified_base (276)..(276): a, c, t, g, unknown or other
  misc_feature (276)..(276): n is a, c, g, or t
tcagagtcgagagacacgaccggtgctcgatttagtatcactcagtcgcggggctgggcctcaggaagcagcatcggaggtgcctcagccatggcatggatccctcttcttcctcggcgtccttgcttactgcacnggatccgtggcctcctatgacgctgactcagtccaccctcagttgtccgtcgtccccgaggacagacacgccagcactcaccgtcgctctgganacgtaagttggggaataaagtatcgcgtggtcgtggttactcgagngagacgcgaggcctagtcccctggtcgttacgtactacgttctaatacgtaacgaactaccgtaacggccggtacccttacgaggtcctccgtagacgtcgtactttcgtcggtacgtcctaaccgaccgtacggtacgggaaccctacgaccgtaccgtaccctttcgaccgaacccgtactaccggaccgggtaccgggtacctcccgtacggtcgttaaccgtacgtacgttacggtacgtacgttaacgtacgtttaacgttacggtacgttacgggaacggtccggggttaagggacctaccgggtccgacgtaccgggttgggttaccgggttaccggggaccggttaccgggaaccaacggtccggtacggttaccgtcggttacggacgtaccggaccgtaccggaacccggg

SEQ ID NO: 131852 - DNA, 715 bp, Homo sapiens
  misc_feature: GYAE6OF02F4AL8.49.85.H08.1.454.CMB.1.raw
  modified_base (603)..(603): a, c, t, g, unknown or other
  misc_feature (603)..(603): n is a, c, g, or t
  modified_base (628)..(628): a, c, t, g, unknown or other
  misc_feature (628)..(628): n is a, c, g, or t
  modified_base (634)..(634): a, c, t, g, unknown or other
  misc_feature (634)..(634): n is a, c, g, or t
  modified_base (643)..(643): a, c, t, g, unknown or other
  misc_feature (643)..(643): n is a, c, g, or t
tcagagtcgagagacacgaccggtgctcgatttagtatcactcagtcgcggggctgggcctcaggaagcagcatcggaggtgcctcagccatggcatggatcctctcttctcgcgtccttgcttactgcacaggatccgtggcctcctatgagctgactcacgcccaccctctagttcgtccgtcgtccccaggacacggacacgccagcactaccacctgtccgttactcgggtaacgaacgtaaaagggttaggggggaaacttaaaagtagtacgtacgtaggtaccgttagggttaattccgaacgaccaaacggaaaccgggtacccgtaaccggacccgtaaccgttccccccgttgggttacggttttcggtaccacgtttacgttactaacgaacgtaaacgtaaacccgaacggtcccggtaaccctacggaacggtacccgtacccttaggacgtcgtaacgtttcgtaccgtcgtaccgtaccctaactacccggttacggaaccgtaacgaccggtaccctaacgttaccgtacgaaaccctagttacccgaggaccgggtactaccgaggtaccttaacgcgtaggacgngtcgtagacttataccgtgtaccgnggtcgngacaggccncgtacggtggtacggacggtaacggccggaacaccggtcgactccggtacgcgtacgacgtacgcgtaccgg

SEQ ID NO: 131853 - DNA, 788 bp, Homo sapiens
  misc_feature: GYAE6OF02JUFVF.49.85.H08.1.454.CMB.1.raw
tcagagtcgagagacacgaccggtgctcgatttagtatcactcagtcgcggggctgggcctcaggaagcagcatcggaggtgcctcagccatggcatggactccctctcttccgcggcgtccttgccttactgccacgaggactccgtggtccctacctagtgagtctacggtacctcacgccctacccgtatagttccgtcccgtccgtacccgacggacacggacacgcctagactacgtaccaccgtctcgtacggtacggtaacgtaacggtaaaggttaggggtaaataaacgttgcgttacgtagacgttagaccgtacgagtacgaacgtacgtaccgacgggtaccctacggttcccgtaggttaccggttccggtaacttacgtacgtaaccggtaacgtaacgtaaccgtaaccggtaaccggtacccggaccgtacggaacggtaccctacccggagtttccgacgtttactccgtacgtaccgcgttaccgtaacgtcggtaaaccggtaccgtacgtaaccggtaccgttaacggtaccctaacggtacccctaacgggtacccgtaacgggttaccgaccgttaacggtactaccggtttaacgacggttaacgtacggagttaaccgttacgtaacgttacgttaccgtcgtaacggcggttacggacgttaacgcccggtacgtcgggttaaggtcgtaaccggtggaaccgggtaccgaggtaccgtcgtacggtacctaccgtagtcccggtaacggccgaacccgtccg

SEQ ID NO: 131854 - DNA, 805 bp, Homo sapiens
  misc_feature: GYAE6OF02HRCTB.49.85.H08.1.454.CMB.1.raw
tcagagtcgagagacacgaccggtgctcgatttagtatcactcagtcgcggggctgggcctcaggaagcagcatcggaggtgcctcagccatggcatggatccctctcttcctcggcgtccttgcttactgcacaggtatccgtggcctcctatgagctgactcagccaccctcagtgtccgtcgtccccaggacagacagccagcactcacctgctcgtggatacaagttcggggaattaaactatgcgtggctaggtactctaacgcaaggaacgccgaggcctacgtccccgttaggttcggttcgtactacttacgtactacgaagtacctaaccgaacggtccggtaccctcgacgggtactccgtagacgtccgtaatttcgtcgtcggtactacccgaacgtcgacggaacaccgacgtaccctaacgtccgtacgtaacccgtacgtaacggaccgggttaccgggtacctacggtaacggttacccgttaaaggttaccggaacgggttacggtaaccgggttcgtaaaccggtttaaccgttttaacggtttaaaccgtccgggtaaacccgttaggggttacccgggtaaaccggggttaccgaaccgggttaaccccggtaccgggtttaaccgggggttttacgggggtttaacccgggttacccggggggtaaacgggttaacccgggggtaaccgtaacccggtttcccggaaccgggtttaacccgggtcggtttaacccgggttaacccggtaaccgggttaccccggtacccggttaaaccccgggg

SEQ ID NO: 131855 - DNA, 167 bp, Homo sapiens
  misc_feature: GYAE6OF01B0H22.41.29.C07.1.454.CMB.1.raw
  modified_base (167)..(167): a, c, t, g, unknown or other
  misc_feature (167)..(167): n is a, c, g, or t
tcagtctatactatcacgaccggtgctcgatttagagtgctacgaagggaaagggaccggtgctcgatttagagtgtacgaagggaaagggtgctgtccaaagaggttgtcttcatcttcccgccatctgaatagtatagactgagcgggctggcaaggcgcatagn

SEQ ID NO: 131856 - DNA, 183 bp, Homo sapiens
  misc_feature: GYAE6OF01BMCLX.41.29.C07.1.454.CMB.1.raw
  modified_base (167)..(183): a, c, t, g, unknown or other
  misc_feature (167)..(183): n is a, c, g, or t
tcagtctatactatcacgaccggtgctcgatttagagtgctacgaagggaaagggaccggtgctcgatttagagtgtacgaagggaaaggtgctgtcccaaagaggttgtcttcatcttcccgccatctgaatagtatagactgagcgggctggcaaggcgcatagnnnnnnnnnnnnnnnnn

SEQ ID NO: 131857 - DNA, 147 bp, Homo sapiens
  misc_feature: GYAE6OF01DDEEK.41.29.C07.1.454.CMB.1.raw
  modified_base (132)..(147): a, c, t, g, unknown or other
  misc_feature (132)..(147): n is a, c, g, or t
tcagtctatactatcacgaccggtgctcgatttagagtgctacgaagggaaagggtgctgtccaaagaggttgtcttcatcttcccgccatctgaatagtactagactgagcgggctggcaaggcgcatagnnnnnnnnnnnnnnnn

SEQ ID NO: 131858 - DNA, 167 bp, Homo sapiens; identical to SEQ ID NO: 131855
  misc_feature: GYAE6OF02HJXAY.41.29.C07.1.454.CMB.1.raw
  modified_base (167)..(167): a, c, t, g, unknown or other
  misc_feature (167)..(167): n is a, c, g, or t

SEQ ID NO: 131859 - DNA, 491 bp, Homo sapiens
  misc_feature: GYAE6OF01B45LH.17.55.E11.1.454.CMB.1.raw
  modified_base (482)..(482): a, c, t, g, unknown or other
  misc_feature (482)..(482): n is a, c, g, or t
tcagcgtagactagcacgaccggtgctcgatttagcactcgcacgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacagtaagaactacttagcttggtaccagcagaaaccaggacagcctcctaagctgctcattactgggcatctacccgggaatccggggtcctgaccgattcagtggcagcgggtctgggacagatttcactctcaccatcagcagcctgcaggctgaagatgtggcagtttatactgtcagcaatattatagtactcctctcactttcggcgtaggaccaggtgagatcaacgaangtggctacg

SEQ ID NO: 131860 - DNA, 524 bp, Homo sapiens
  misc_feature: GYAE6OF01CW05K.17.55.E11.1.454.CMB.1.raw
  modified_base (238)..(238): a, c, t, g, unknown or other
  misc_feature (238)..(238): n is a, c, g, or t
  modified_base (413)..(413): a, c, t, g, unknown or other
  misc_feature (413)..(413): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacagtaagaactacttagcttggtaccagcagaaaccaggacagcctcctaagctgctcatttactggcatcgtacccgggaatcccggggtccctgaccgtatcagtcggcaggcgggtctgggacagtacttcactctcacatcagcagcctgcaggctagaangtgtgactagtttacttacgtgtacagtacaattattatagtaccttcctctctacgttcgggcggtaggaccagggtcggaagacgtacaaacgtacgtcggtgcgtacg

SEQ ID NO: 131861 - DNA, 517 bp, Homo sapiens
  misc_feature: GYAE6OF01DYVJW.17.55.E11.1.454.CMB.1.raw
  modified_base (411)..(411): a, c, t, g, unknown or other
  misc_feature (411)..(411): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcagctgaagatgngctagtttatctgtcagactaattattatacgttactcctactctacgtttcggcgggtagggacctagggtcggaagacgtacgaaacgtaacgtggtggctacg

SEQ ID NO: 131862 - DNA, 604 bp, Homo sapiens
  misc_feature: GYAE6OF01A1V3E.17.55.E11.1.454.CMB.1.raw
  modified_base (252)..(252): a, c, t, g, unknown or other
  misc_feature (252)..(252): n is a, c, g, or t
  modified_base (477)..(477): a, c, t, g, unknown or other
  misc_feature (477)..(477): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtcgccgtacgggacatcgtgatcgacccagtcctccagacctccctggctgtgtctcgtgggcgaggacggccaccatacaactgacaacgtccagccaggtagtttgttttaanacacgtcctaccaaagtaagtaaacgtaaccttacttagtcttacggtaaccagaccaaggaaaacccgaggaccacgccctacgaagctgcctctagttacgtggctacgtccgtaacccggacgtcccggggtcctggacctagtcgaggtcggacgaggtcggtcgtagggacagttacttcacttcctacacctatacagcacgccgtgacgagctagacngtgtgtacttacgtttacttcgtgtacgagtacttaattattatacgttctcctcgtacgttaccgttcgggacggtacggaccgtagggtacgagtaacgtaaccgaagttacgcggttggctacg

SEQ ID NO: 131863 - DNA, 532 bp, Homo sapiens
  misc_feature: GYAE6OF01CMPON.17.55.E11.1.454.CMB.1.raw
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctccaacaagtaagaactacttagcttggtaccagcagaaaccaggacagcctctaagctgctcatttacgnggcatcgtaacccgggaatcccggggtcctgaccgtattcagtggcaggcgggtctgggacagactttcactctacaccatcagcacgcctgcagctagaagatggtcgtctagtttattacgtgtcagtataattattaatagttactctctccgtacgtttacggcgggaaggacgtaagggtaggagaactacgaaacgtagtcgtggcgtacg

SEQ ID NO: 131864 - DNA, 513 bp, Homo sapiens
  misc_feature: GYAE6OF01CJKB3.17.55.E11.1.454.CMB.1.raw
  modified_base (237)..(237): a, c, t, g, unknown or other
  misc_feature (237)..(237): n is a, c, g, or t
  modified_base (311)..(311): a, c, t, g, unknown or other
  misc_feature (311)..(311): n is a, c, g, or t
  modified_base (504)..(504): a, c, t, g, unknown or other
  misc_feature (504)..(504): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttancagctccaacagtaagaactacttagcttggtaccagcagaaaccaggacagcctcctaagctgctcatttacngggcatctaccgggatccgggtcctgaccgattcagtggcagcgggtctgggactagatttcactctcaccatcagcagcctgcaggctagaagtgtgtggctagtttattctgtcagtcaattattatagtactccgtctctacgtttcggcggtagggaccgagggtgaagtactaccgaaacgacgtggnggtctacgg

SEQ ID NO: 131865 - DNA, 784 bp, Homo sapiens
  misc_feature: GYAE6OF01E5N0L.17.55.E11.1.454.CMB.1.raw
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgccgtacgggacatcgtgatcgacccagtctccagacctccctggctgtgtctcgtgggcgaggacggccaccatacaactgacaagtccagccagtagttgttttacacagacctaccaaacgtaagtaaacgtaaccttacgttagccgttacggaaccagaccaacgaaaccacggaccacgccctacgtaacgctcgtacctacgtaacgttttacgcgggacctaacgtacccggtaacccgggtaacgttccccggggtaccctaggaccgtagttaccggaggtccggacggtacgggtccgggttacgtacgggtaactagtacctttaccaccttccgtacccaaccgtacgtacgacgcccgtaaccgtccgtaggaaccggacggtaccgtaaggaaacgtacgttacgggttacgtaaccgttttaagttttaacgtaccgttacggtaacgtaacgtaaactttaaacgtttacgtttaaccgtaaccggttacccttacccgttaccggttaaccgttaacccgggtttaccgggggaaccgggtaaccgggtaaccggtaaacggggttacggaaacgttaacccgtaaaccggaaacggtaccgtttcgggtaccgtcccgttaacccgg

SEQ ID NO: 131866 - DNA, 514 bp, Homo sapiens
  misc_feature: GYAE6OF01E3HAY.17.55.E11.1.454.CMB.1.raw
  modified_base (491)..(491): a, c, t, g, unknown or other
  misc_feature (491)..(491): n is a, c, g, or t
  modified_base (509)..(509): a, c, t, g, unknown or other
  misc_feature (509)..(509): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctctaagctgctcatttactggcatctacccgggaatccggggtcctgaccgatcgagtggcaggcgggtctgggacagtattcactctcaccatcagcacgcctgcaggctgaagatggtcgtctagtttattaccgtgtacagtactaaatattaatagtacctctctcgtacgttcggcggaggaccaggtggaanactacaaacgatggtcgngtacg

SEQ ID NO: 131867 - DNA, 674 bp, Homo sapiens
  misc_feature: GYAE6OF01DCXBT.17.55.E11.1.454.CMB.1.raw
  modified_base (362)..(362): a, c, t, g, unknown or other
  misc_feature (362)..(362): n is a, c, g, or t
  modified_base (406)..(406): a, c, t, g, unknown or other
  misc_feature (406)..(406): n is a, c, g, or t
  modified_base (465)..(465): a, c, t, g, unknown or other
  misc_feature (465)..(465): n is a, c, g, or t
tcagcgtagactagcacgaccggtgctcgatttagcactcgcacgttgggtttgggggagctacaacaggcaggcaggggcagcaagatggtgtgcagacccaggtcttcatttctctgttgctctggatctctggtgccgtacggggacatcgtgatcgaccagtctccagacctcccgtgctgtgtctcgtgggcgaggacggccaccatcaactgacaacgtccagccaaggtagttagttttacacgagtcctaaccaaacgtaagtaacgtaacttaacgttacgtccgtttacggaaccaggacaacgaaaacccgaggaccaacgtccctaccgtaagctgctactactttacgngggtcacgtccggtaacccggagtccggggtaccctggaccgtnttcgaggtcgcgtacggtcgggtcgtacgggactagtactttacacctactacctaccnctacgacgcacgccctagcgaggtctagtaagtagttggtacgttacttaagttttacgttacgttagtaccgtagtaacttaattactttaacgttaccgttaccttacccttccttacccgttacggtttaccgggacgggtaaccggtacggtaagggtacggtaacgtaacgtaacggtaaaccgtaggttacgtcggcgtaccg

SEQ ID NO: 131868 - DNA, 815 bp, Homo sapiens
  misc_feature: GYAE6OF01CY5C1.17.55.E11.1.454.CMB.1.raw
  modified_base (371)..(371): a, c, t, g, unknown or other
  misc_feature (371)..(371): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgtgctctggatctcgtggtcgccgtacgggacatcgtgatcgacccagtctccacgtacctcccgtggctgtgtctcgtgggacgaggacgggaccaccatacaacgtgacaacgtccaacgccaggtagttagttttaacacacgtacctaaccaaacgtaagtaaacgaacttacgttagtccgttacgaccagacaacgaaaccgaggaaccacgaccctacgtaagtctacgtctactacgtttacgngggtacctacgtaccggtaaccccgggtacggttaccccggggtccacggtaccgtacgtaccgtaggtcggacggacgggtccgggtacgtagggaactagttaccttcaccgttaccacctacctataccgacgtacgaccggtccgtacggaacgtacggtacgttaagggaaacggttcgttacggggttaacggttaaccgttttaaggtttttaaccgttacgttacggtaaccgttaagttaaaccgtttaaaattttaaacgttttaacgttaccggttacccctttaccgtttaccgtaccgggtttaccccgggtagggggtaaaccggggtaaacccggggtaaacccgggtaaaggggttccgggtaaaaacgtaaccgttaaaacccggtaaacggttacggttaaaccgggcgggttaaacctaacccgg

SEQ ID NO: 131869 - DNA, 565 bp, Homo sapiens
  misc_feature: GYAE6OF01C6AKN.17.55.E11.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (413)..(413): a, c, t, g, unknown or other
  misc_feature (413)..(413): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactcctggctgtgtctctgggcgagngggccaccatcaactgcaagtccagccagagttgtttatacagctaccaacagtaagaactacttagcttggtaccagcagaaaccaggacagcctctaagctgctnatttacngggcatccgtacccgggatcccggggtcctgaccgattcagtgcagcgggtctgggacagtatttcactctccaccatcagcacgcctgcaggctagaagngtgtcggctagttttatactgtacagtactaagttacttaagtacgttaccttccctacctcgttaccgtttccgggggaccggtacgggaacccgtaaaggggtacggaagtaacgtaccgaaaaacggtacgttaggtcggtctaaccgg

SEQ ID NO: 131870 - DNA, 625 bp, Homo sapiens
  misc_feature: GYAE6OF01E238S.17.55.E11.1.454.CMB.1.raw
  modified_base (238)..(238): a, c, t, g, unknown or other
  misc_feature (238)..(238): n is a, c, g, or t
  modified_base (379)..(379): a, c, t, g, unknown or other
  misc_feature (379)..(379): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacagtaagaactacttagcttggtacccagcagaaaccaggacagcctcctaagctgctcatttactgggcatccgtacccgggaagtcccggggtccctgaccgattcgagtggcaggcggggtcgcgganagtacttccacttcctaccacctactacgacacgaccgtccgtgaccggacgcgtaagaacgtagttggtcggtactttagttttaacttacgttcgtacgtacgtaacttaaatttattaacgttaacgttacccttcccttcttaccgttaccgggtttaccgggaccggggtaaccgggaacggtaacgggtagggtaagtaacgtaaaccgtaaaccggtagtcgggtccggtacgtaccgg

SEQ ID NO: 131871 - DNA, 748 bp, Homo sapiens
  misc_feature: GYAE6OF01C8N0U.17.55.E11.1.454.CMB.1.raw
  modified_base (370)..(370): a, c, t, g, unknown or other
  misc_feature (370)..(370): n is a, c, g, or t
  modified_base (455)..(455): a, c, t, g, unknown or other
  misc_feature (455)..(455): n is a, c, g, or t
tcagcgtagactagcacgaccggtgctcgatttagcactcgcacgttgggtttgggggagctacaacaggcaggcaggggcagcaagatggtgttgcagacccaggtcttctatttctctgttgctctggactctcgtggtcgccgtacggggacatcgtgatcgacccagtctccagacctccctggctgtgtctcgtgggcgaggacggccacatacaactgacaacgtccacgccaagtacgtttagtttaatacgacgtacctaccaaacgtaagtaaacgtaaccttaacttacgtcgttacggtaaccaacggacaaacggaaaccgaggacacgtacctaccgtaagctcgctctatttacgnggactacgtaccggtaacccgggacgtccggggtcctacggacgtatcgaggtcgcgaggtcggtcgtaggactagttacttacnctacctaccactactcgacgcctagtccgtacgacgacggtcgtaaggtaacgtcgtttagggtacggttacgtttaagtttttaacgtaacggttcggttaacaacgttactaaaattttacgtttaagttaccgttaacccttttcccgtccgttaaaccggttccggggtttaacccgggggaacggggtaaccggggtaaaacccggttaaggggtaaacgggtaaagttaaacccggtaaaacggttaaaaccccgggtatttggggtaacgggttccctaaacccgg

SEQ ID NO: 131872 - DNA, 695 bp, Homo sapiens
  misc_feature: GYAE6OF01BXH4Q.17.55.E11.1.454.CMB.1.raw
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctctggcgagagggccaccatcaactgcaagtccagccagagttgttttatacagctccaacagtaagaactacttagcttggtaccagcagaaaccaggacacgcctacctaagctgctactatttacgtgggactacgtaccgtaacccgggtaacgtcccgggggttccctacggacccgtagttccaaggttcggacgtacggtccggggtcgtagggtaaccgtagtacgtttccacttccgtacctacccgtactccaacgccaaccggtccgtacggacccgtaacgggtaccgtaggtaaacgtagttcggtacggtcgtttaaggttttaactttccggttagttactaacgtactaaactttaacgtttaattacgttacccttacccttactttaccgtaaccggttttaccgggaccggggtaacgggtaaccggtaacgggtacggtaaacggaacgttaaccgaaacggtaacggttcgtcgggtcgtaccgg

SEQ ID NO: 131873 - DNA, 491 bp, Homo sapiens
  misc_feature: GYAE6OF01E4X7Z.17.55.E11.1.454.CMB.1.raw
  modified_base (382)..(382): a, c, t, g, unknown or other
  misc_feature (382)..(382): n is a, c, g, or t
  modified_base (470)..(470): a, c, t, g, unknown or other
  misc_feature (470)..(470): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtcctgaccgattcagtggcagcgggtctgggacagatttcactcncacatcagcagcctgcaggctgaagatgtgcagtttattactgtcagcaatattatagtactctctcactttcggcgaggaccaaggngagatacaaacgatgtgctcg

SEQ ID NO: 131874 - DNA, 713 bp, Homo sapiens
  misc_feature: GYAE6OF01EAJRH.17.55.E11.1.454.CMB.1.raw
  modified_base (243)..(243): a, c, t, g, unknown or other
  misc_feature (243)..(243): n is a, c, g, or t
  modified_base (338)..(338): a, c, t, g, unknown or other
  misc_feature (338)..(338): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgccgtacgggacatcgtgatcgaccagtctccagactccctggctgtgtctcgtgggcgaggacgggcccaccatcaactgacagtccagccagtagttgtttanacacgctaccaaacaagtaaacgaacttacttagtcttaggaaccagacaacgaaaccgagaccacgacctactaagctacgctctactttacgnggactacgtaccgtacccgggtaacgtcccggggtacctacggaccgtattcgacggtcggacgtacgggtcgggttacgaccgggtaactacgttactttccgaaccttcctaccgtaacctagttacccgagtccgaacgccgttacggaccgtacgggtctaaaggaggttacgttggtcggttaactttaggtttacttacggttacgtaccgaagttaaccttaaagtttactttaacgttaccgttacttacccgttccgttaccgtttaccgggtttaccggggaaccgggtaacggggtaacccggtaagggtaacggtaaccgtaacgttaaacgaaacggtacgtttacggtcggtcgtacccgg

SEQ ID NO: 131875 - DNA, 635 bp, Homo sapiens
  misc_feature: GYAE6OF01AV7TM.17.55.E11.1.454.CMB.1.raw
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagtagtgttttanacagctaccaacagtaagaactacttagcttaggtaccagcaagaaaccaggacagcctacctaagctgctacatttacgngggactatccgtacccgggaagtccccggggtccctgaccgtattcgagtcggctaggcgggtcgtgggacagtactttcacttctccacctatacacgccagcctgacagggtctaggaaagtgttcggtacggtacttaggttttaactttaccgtaggtacctaacggtacttaaagtttactttaagttaacgttaccttacccttcttacccgttaaccggttttccgggaacgggtaacgggaaccggtaaaggggttcggaagtaacgtaaccgtaaaacggtaccgttaggtcggtccgttaccgg

SEQ ID NO: 131876 - DNA, 677 bp, Homo sapiens
  misc_feature: GYAE6OF01BWDF0.17.55.E11.1.454.CMB.1.raw
  modified_base (241)..(241): a, c, t, g, unknown or other
  misc_feature (241)..(241): n is a, c, g, or t
  modified_base (323)..(323): a, c, t, g, unknown or other
  misc_feature (323)..(323): n is a, c, g, or t
  modified_base (473)..(473): a, c, t, g, unknown or other
  misc_feature (473)..(473): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagttgtttanacagcctaccaacagtaagaacttacttagacttggtaccagcaacgaaaccaggacagccctcaagctgctctatttacgnggctacgtccgtaacccgggacgtcccggggtaccctacggtaccgtagttccgaggttcgggacctacgggtccggggtacgtaggggaacctaaggtacttttaccgacgtttacctcctaaccactaccgacgtaccgacgtcccgnggtaccgagggtacgtagaaacgtagttggtacgggtacttaacgttttatttaccgtgttacgaacgttactaaagtttaactttaacgtacgttacccttcccgttacgttcccgtaaccggtttccggggaccgggtaagggacccgttaaggggacgtaacggtaacgtaaccgtaaacgtaggtcggtggccgtaaccg

SEQ ID NO: 131877 - DNA, 672 bp, Homo sapiens
  misc_feature: GYAE6OF01CUZGR.17.55.E11.1.454.CMB.1.raw
  modified_base (241)..(241): a, c, t, g, unknown or other
  misc_feature (241)..(241): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagacggccaccatcaactgacaagtccagccagagttgtttanacagcctaccaacaagtaaacgaaccttacgttacgtcgttaggtaaccagacaacgaaaccaggaccacgaccctaccgtaagctcgctactattttaccgtgggacctacgttaccgtaaccccgggtaacgttccccgggggtccctaggaacccgtagttccgaaggtcggcgagggtcccgggtacgtgggaactaggtactttccgacctactacctaaccacgtacacggaccacggcctcgccgaggtcgtaggaaacgtgttcggtaggtacttaagttttacttcgtagtacgtagtactaattacttataccgttaccttcccgttacgtacccgttcggtttacccggggcgggtaacgggtaaccggtagggtacgaacgtacgtaaaccggtaaacgtacgtcgggtagtcgtaccg

SEQ ID NO: 131878 - DNA, 874 bp, Homo sapiens
  misc_feature: GYAE6OF01CPAT4.17.55.E11.1.454.CMB.1.raw
  modified_base (345)..(345): a, c, t, g, unknown or other
  misc_feature (345)..(345): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctcgtggtcgaccgtacggggacagtcgtgatcgacccagtcctaccacgaccctcccgtggtcttgtcgtcgtcggtgggacgaggaccggaccacatacaacgtgactaacgcacgcagttagttagtttacacacgcctaaccgaaataagtaaacgtaacttacgttacgttaccgttacggtaaccaagtaccgaaacgtaaaacccgnggaaccacgtacccttaccgtaagcctcggtaccttacgttaacgtttacggcggtactaccgtaccgggtaaccgggtacggttccccggtaactacggaccgtacgtacggacggtcggaccggtcggtacgggtctacgggaactacgtttactcctaccgtaccgtaccaacgtacgaccgaaggtccccgtaacggtcccgagggtacccgaacggggttccgtaaagggtaaacgtcgggtttacggtaacggtttaagtttaaccgtttttaaacgtcgtaacggtttaccgaaacgttaacgttttaaaacgtttagtttaaacccgttaccgtttaacccgttacccttttaacccggtaaccgggtttttaacccgggggttacccgggggaaaacccggggggttaaaaccgaacccgggggttttaaaggggacccggtaaaaacgtttacccggtaaaaacccggggtaaacggttaccgggtaaacggttccccgggaaccctttaaacccgggg

SEQ ID NO: 131879 - DNA, 685 bp, Homo sapiens
  misc_feature: GYAE6OF01E4F1G.17.55.E11.1.454.CMB.1.raw
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
  modified_base (329)..(329): a, c, t, g, unknown or other
  misc_feature (329)..(329): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccagtagttgttttanacagcctaccaacagtaanaactacttagcttgtaccagacaacgaaaccaggacacgtcctactaagctagctctacgtttacgnggactacgtaccggtacccgggtacgtcccggggtccctgaccgtattcgaggtcgacgacggtcgggttacgaggtacagtactttaccgactcgtaccaacctataccgacgcgaacgtccgtgaccgacggtacgtaaggaacgtaggttcggtcggttaaccgtttaagttttaacttacggttacgtacgtaacggtaacttaaattaacgtttaacgttaccgttaccctttcccgttaccgttaccgtaaccgggtttaccgggggaccgggttaaacgggaacccggtaaggggttaccggaaacggtacgtaaaccgaacggtaacgttcgggtacggcgtacccgg

SEQ ID NO: 131880 - DNA, 753 bp, Homo sapiens
  misc_feature: GYAE6OF01BITRF.17.55.E11.1.454.CMB.1.raw
  modified_base (250)..(250): a, c, t, g, unknown or other
  misc_feature (250)..(250): n is a, c, g, or t
  modified_base (362)..(362): a, c, t, g, unknown or other
  misc_feature (362)..(362): n is a, c, g, or t
tcagcgtagactagcacgaccggtgctcgatttagcactcgcacgttgggtttgggggagctacaacaggcaggcgaggggcagcaagatggtgttgcagacccaggtcttcatttctctgttgctctggatctctggtgccgtacgggacatcgtgatcgacccagtctccagactcccgtggctgtcgtctcgtgggcgaggacggccaacactcaactgacaacgtccagaccagtagttgttttanacgacgctaccaaactaagtaaagtaaaccttacgttagtcgttacggaccaagactaacgaaaccgagtaccacgtacctaccgtaagctacgtacctacgtactttacgnggtactacgttaccggtaacccgggtacggttccccggggtacctacggtaaccgtacgttacggacgttacgggacgtacggtccggggttacgtacggggtaaacctacgttactttaccgaccgttacctaccgaacctacgtacgtacgtaccgtaccgtaccgtagaccgaacggtacgttaaggaacgtcgttcgggtacgttaacttttaacggttttaacgttacgtacggttaactacggtaacttaaactttaacgttaacgttaccgtaacttcccgttactaaccggttacggtttaccgggacgggtaaccgggtaacggttaacggggtacgtaaacggtacctaaacggaaacgttacgtcggtacgtcgtaaccg

SEQ ID NO: 131881 - DNA, 820 bp, Homo sapiens
  misc_feature: GYAE6OF01C77PT.17.55.E11.1.454.CMB.1.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagacgggcccaccatcaactgacaagtccagccagtagttntttanacagcctaccaacaagtaacgtaacttacttagtcttacggtaccagacaacgaaaccgagggaacacgccctaccgtaagcctcgtctactactttacggtgggacctacgtaccccggttaacccgggtaacggttcccggggttaccctacggaacccgtaagttccgtaacggtcgggaccgtagggttcccgggggtacgtacgggggaactaaggtttactttacccgtaccgttaccgttaaccccgaaaccctaaacgttcccgaaacggtaccccgtaaccggtacccgttacggacccggtacgggtaccggtaaacggtaaaggttacgttcggggttaacggtaccgttttaaggtttttaacgttaccgttacggttaaccgaacggttacttaaaagttttacttttaaaggttacccttaaaccgtttcccttaaccgttaccctttacccgggtttaccgggggaaccggggtaaccgggtaaacccggtaaaggggtacggtaaacgaaccgttaaacggaaaacccgttagtttacgggtagggtcccttaacccgg

SEQ ID NO: 131882 - DNA, 749 bp, Homo sapiens
  misc_feature: GYAE6OF01B5MA0.17.55.E11.1.454.CMB.1.raw
tcagcgtagactagcacgaccggtgctcgatttagcactcgcacgttgggtttgggggagctacaacaggcaggcaggggcagcaagatggtgttgcagacccaggtcttcatttctctgttgctctggatctctggtcgccgtacggggacatcgtgatcgacccagtcctccacgtacctcccgtggctgtcgtctcgtcgggcgaggacgggcccaccgtataccaacgtcgacgaacgtaccgacgccgaggtagttagttttactaccgacgtcctaccaaacgaagtaaacgtaacttacgttaagccgtttacggtacccagaccgaagtaaacccaggaaccacgtacccttaccgtaagccttcggacctacgttacgtttaacgtcggtactacgtacccgtacccgggtaacgtccccggggtaccctacgaccgtattacacgggtcgcggtacggacgggtcgtacggaacgtattacgttccaacgtcctacgtaccacgttacgacgtccgaacgtccgtcgaccgtacggtcgtaagagtacgttggtacgttcgttaacgttttactacgttatacgtagttaacttaagttacttaaggttacccttaccgttacttcccgttaagttcccggtttaacgggacccgggtaaggttaccggtaaacgggtacggtaacggaaacccttacggtaaaaccggttaccggttacgtacgggtacttaacccgg

SEQ ID NO: 131883 - DNA, 751 bp, Homo sapiens
  misc_feature: GYAE6OF01EF7LM.17.55.E11.1.454.CMB.1.raw
  modified_base (740)..(740): a, c, t, g, unknown or other
  misc_feature (740)..(740): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctcgtggttgccgtacggggacatcgtgatcgacccagtcctccagacctcctggctgtgtctcgtgggcgagacgggcccacatccaactgacaacgtccacgccaggtagttcgttttaagaccagtacctaccaaacgtaagtaaacgtaacttacgttagtctttacggaaccacggacaaacggaaaaccgacggaaccaaccggtcccttaaccggtaacgtcgtaccgtacttaccttacgttttacggtcgggtactaccgttacccggtaaaccggggtaccgttcccggggtccctaacggtaccgtacttcggaggtcggacgtcgggtacggtccgggtaggaacggtacttacgtttaccgtacctcgtaaccctacccgtaataccgacgtaccacggtccgacggtaccagggtcctaaggaacgtcgtacggttacggttacctttagttttactacggttagtacacgtaacgtttaatttagttagttaacccttcttacccttacttccggttaccggtttaaccggggacggttacgggacggtaagggtacgtaacgtaaacgtaaccgtaaacggtacgtttcgggngtcctacccgg

SEQ ID NO: 131884 - DNA, 777 bp, Homo sapiens
  misc_feature: GYAE6OF01AEX1R.17.55.E11.1.454.CMB.1.raw
  modified_base (155)..(155): a, c, t, g, unknown or other
  misc_feature (155)..(155): n is a, c, g, or t
  modified_base (770)..(770): a, c, t, g, unknown or other
  misc_feature (770)..(770): n is a, c, g, or t
tcagcgtagactagcacgaccggtgctcgatttagcactcgcacgttgggtttgggggaggctacaacaggcaggcaggggcagcaagatggtgttgcagacccaggtcttcatttctctgttgctctggatctcgtggtcgcctacggggaacngtcgtgactcgacccagtcctccagacctccctggcttgtcgtctcgtagggtcgaggacgggcccactagtaccaactcggaccgtaacgtcccgaacggtacctaaggtacgttttacgtttaactaaccgaccggtacctaacccgtaaaggtaacgttaaacggtaacctttaacggttaacgtccggttaaggttaacccaggtaaccgaacggaaaacccgtagggaaccctaccggttaccctaccgttaacgtccgtacggtacctacgtaacgttttacgcgggactacgttacccggaaccgggtacgtcccgggttaccaggttaccagttaccggacgcggtaccggtaggtcgggtacgttacggaaacctggttacttccggaacttccgtaaccgaccttaacgccgtacgtacgtaacgtccgtacgaccgtacggtcgtacgaacgtagtacggtacgtacgttagtttaacgtagtacgtaaccgtgtaacttattaagttacctacgttacctcctacgttaccgtaacggttccgggaacggtacgtaacggtaggacgtaaacgacgtaaccgtaacgaacggttgaaccggtntaaccgg

SEQ ID NO: 131885 - DNA, 747 bp, Homo sapiens
  misc_feature: GYAE6OF01CJ344.17.55.E11.1.454.CMB.1.raw
  modified_base (477)..(477): a, c, t, g, unknown or other
  misc_feature (477)..(477): n is a, c, g, or t
tcagcgtagactagcacgaccggtgctcgatttagcactcgcacgttggggtttgggggagctacaacaggcaggcaggggcagcaagatggtgttgcagacccaggtcttcatttctctgttgctctggatcgtctggtcgccgtacgggacagtcgtgatcgacccagtcctccagcctcccgtggctgtcgtcgtcggtagggcgaggccggtaccaccataccaacgtgaccaagtcccgacgaccgaggttagttacgtttaacaacacggtacctaaccgaaacgtaaggtaaacgtaaccgttacgtacggtaccgttaacggaaccgaagaaccgaaacggaaaaccgaggaacctaccgtacccttacaaaggtccacgtcttaacgtacgttcggacggaccttacgtaccgggtaacccgggtacgttccccgggtacctacgaccgtgttacggagtcggaccgngggtacgggctagggtaaccagttactcaacctcgtaccactacgcgtaacgccacggtctacgaggagtacgtaaggaattggtacggtacgttacgtttaattacgtttaccgtaggtcctaaaggttacttaaaggtttaccttaaggtacccttccgttaccttacgtaccggtttaacccgggtggaccccgggtaaagggaaccgttaggggtacgaaacccgtattaaaacccccgggaatgggtttacggctccggtaaccc

SEQ ID NO: 131886 - DNA, 756 bp, Homo sapiens
  misc_feature: GYAE6OF01AXI6P.17.55.E11.1.454.CMB.1.raw
tcagcgtagactagcacgaccggtgctcgatttagcactcgcacggttgggggtttgggggagctacaacaggcaggcaggggcagcaagatggtgttgcagacccaggtcttcatttctctgttgctctggatctcgtggtgcctacggggacatcgtgatgacccagtctccagactcccgtggctgtgtctgtgggacgaggacgggccacatcactgactacgtccacggacctaggtacgtttagtttacacgtagtcctaccaaacgtaacgtaaacgtaaaccttacgttacgtaccgttacgggtaaccaacggaccgaaacgaaaaccgacgggtaacctacggtaccccttacgtaacggtacctcgtaccttacgtaacggttttacccggcgggtacttaccggtaacccgggttaacccgggtaaccggttccccggggtactaccggtaaccggtacttaccgaggtcgggactacggggtcggttcgaggactagtacttcactcctcactctacgcgaccacggtccgtgaccgtacggtactaggtacggtagtcgtacgggttacttaactttagtaccgtaagtccgaattaacgttattaacgttaataccggttacttcccggtacgttacgttacccgggttaacgggtaccgggaaacggttaccggtaagggtaccggtaaaagtacccgttaaacggtaaaccgtagggttccccgtaaggtactacccgg

SEQ ID NO: 131887 - DNA, 862 bp, Homo sapiens
  misc_feature: GYAE6OF01AWJUK.17.55.E11.1.454.CMB.1.raw
  modified_base (135)..(135): a, c, t, g, unknown or other
  misc_feature (135)..(135): n is a, c, g, or t
  modified_base (493)..(493): a, c, t, g, unknown or other
  misc_feature (493)..(493): n is a, c, g, or t
  modified_base (535)..(535): a, c, t, g, unknown or other
  misc_feature (535)..(535): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatcctntggtcgccgtacggggacatcgtgatacgaccctagtcctaccagtacctcccgtggcttggtcgttctccgtcggggacggacggacggggtacccaaccgtactaaccgtaaaccgtcggaacctaaaccggttcccgaacggtcccgtaaagtttccgggttttagttttaactaaccgacgtccctaaccgaaaccgtaagttaaaccgtaaccttagttacggtctttaacgggaccagacgaaacggaaaccgacgaccacggtacccctacgtaacgtctcgtaacctcttaacgttcgtggactactaccgggtaccgggacgtcccgggtacagtaacctctagaccgnggtaccgcggtacgggtccgtagtactacggtactttacccnctaccgtcaaccgtcgtaaccggactaccggtacgtaccctcgggtaacaccgggttagtaagggtaacgtttacgtacggttacggttaacgttttaggtttaacctttacgtacgttaaccggttaacggtaacggttttaaacttaacgtttaaacccgttaccggtttaacccctaccgttacctttaacccgggttaaccccggggttaacgggtaaccggggttaaacgggaacccgggtttaaaggttaccgggtaaaaccgggttactaaaaccggggtaaacggttccgggtaacgtttaccggggcccttaaccggg

SEQ ID NO: 131888 - DNA, 747 bp, Homo sapiens
  misc_feature: GYAE6OF01A3T05.17.55.E11.1.454.CMB.1.raw
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgccgtacgggacatcgtgatcgacccagtctaccagacctcccgtggctgtgtctcgtgggcgagacgggccaccatacaacgtcgacaacgtccacggaccgagtagtttacgttttaataccacgtacctaccaaacgaacgttaaacgtaaccttaacgttacgtcgttacggtaccagacgaacggaaaccgacggaccacgcccttaccgtaacgtcctgtcctacgttaacgtttacgacgggtacctaccgttaccggtaaccccggggtaacggttccccgggggtccctacgggtaaccgttacgttacgtaggtcgggtccggtacggggtcgggttccggtacgggtaacgtagttaccgtttaccaccttcccgtaccctactacgtacgacgccgtaacgccgtacgacgtacgggtctaaggacgtagtacgggtcgttacgttacgtttagttcgttaggtacacgttaacttaattaacgttaacttaccgttactccgttacttaccgttccggttacggggaccggtacgggtaaccgggaggtacggtaacgtaaccgtaacggaaacggtagtacgggtcgaccgtacg

SEQ ID NO: 131889 - DNA, 710 bp, Homo sapiens
  misc_feature: GYAE6OF01BU8HC.17.55.E11.1.454.CMB.1.raw
  modified_base (242)..(242): a, c, t, g, unknown or other
  misc_feature (242)..(242): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagttgttttanacagctaccaacaagtaaacgaactacttagtcttacggtaccagacaacgaaaccgaggacacgcctacgtaagctcgctctactttacgtcgggactacgtccgtacccgggaacgtcccggggtcctaggacctagttccgagtcggcgtagggcggtcgtagggactagtacgtttcacttcctacaccgtactcgaacgcctaacgtccctggaccgacgggtacctaaggaacggtacgttcggttacggtacgtttaaggttttaagtttaccgttagttaccgtaagtaaccgttaaagtttaacgtttaacgttacgttaaccttcccgttacttacccggttaccggttttacccggggacggggttaaccgggtaaccgggtaacggggttaacgggtaaaccgtaacggttaaaccgtaaaacggttaaacggttcgggtaacggtcgtaacccgg

SEQ ID NO: 131890 - DNA, 509 bp, Homo sapiens
  misc_feature: GYAE6OF02HFMHY.17.55.E11.1.454.CMB.1.raw
  modified_base (238)..(238): a, c, t, g, unknown or other
  misc_feature (238)..(238): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacagtaagaactacttagcttggtaccagcagaaaccaggacagcctcctaagctgctcatttactgggcatccgtaccgggaatccggggtccctgaccgattcagtggcagcgggtctgggacagatttcactctcaccatcagcagcctgcaggctagaagatgtgctagtttatactgtcagctaattattatagtactcctctctactttcgggcggacggactaagggtgaagtacacgaaacgacgtgtgctacg

SEQ ID NO: 131891 - DNA, 518 bp, Homo sapiens
  misc_feature: GYAE6OF02ISH8W.17.55.E11.1.454.CMB.1.raw
  modified_base (237)..(237): a, c, t, g, unknown or other
  misc_feature (237)..(237): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttanacagctccaacagtaagaactacttagcttggtaaccagcagaaaccaggacagcctacctaagctgctcatttactggcactctacccgggaatccggggtaccctgaccgattcagtgcagcgggtctagggacagtatttcacgtctacaccatcagcagctgacgagctgaagatgtgtcagtttatacgtgtacagacgtaatattactagtaacttcctactctactttccggacgtacggacaaggtgagactacaacgtactaggtcgctacg

SEQ ID NO: 131892 - DNA, 500 bp, Homo sapiens
  misc_feature: GYAE6OF02F7XP5.17.55.E11.1.454.CMB.1.raw
  modified_base (238)..(238): a, c, t, g, unknown or other
  misc_feature (238)..(238): n is a, c, g, or t
  modified_base (411)..(411): a, c, t, g, unknown or other
  misc_feature (411)..(411): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacagtaagaactacttagcttggtaccagcagaaaccaggacagcctcctaagctgctcatttactgggcatctacccgggaatccggggtccctgaccgattcagtggcagcggtctgggacagatttcactctcaccatcagcagcctgcaggctgaggtgnggctagtttatactgtcagcaatattatagtctctctactactttcggcggaggacctaaggtgagatacaacgtactgtcggctgacc

SEQ ID NO: 131893 - DNA, 617 bp, Homo sapiens
  misc_feature: GYAE6OF02JVRBS.17.55.E11.1.454.CMB.1.raw
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
  modified_base (409)..(409): a, c, t, g, unknown or other
  misc_feature (409)..(409): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttanacagctccaacagtaagaactacttagcttggtaccagcagaaaccaggacagcctacctaagctagctacattacgnggcatccgtacccgggaagtcccgggtcctacgaccgtattcgaggtcggcaggtccggtcgtagggacagtactttcactctcacctatcgancacgcctagcgaggctaggaagtagtggtcgacgttaagtttacttacgtcgtacgtagtacctaagttaatttacgtaacgttaccttacccttacctccgttaaccggtttcggggtaaccgggtaacgggtaacccggttaagggtacggaaggtaacctaaccggtaaaaccggttaacgtaccgggttaggtacccggtacgg

SEQ ID NO: 131894 - DNA, 556 bp, Homo sapiens
  misc_feature: GYAE6OF02IYFRB.17.55.E11.1.454.CMB.1.raw
  modified_base (312)..(312): a, c, t, g, unknown or other
  misc_feature (312)..(312): n is a, c, g, or t
  modified_base (365)..(365): a, c, t, g, unknown or other
  misc_feature (365)..(365): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttatacagctccaacagtaagaactacttagcttggtaccagcagaaaccaggacagcctctaagctgctcatttacngggcatctacccgggaatccggggtccctgaccgattcagtggcagcgggtcngggacaggtatttcactcctcaccatcagcagcctgcaggctagaagattgtggctagtttacttacgtgtacagtctaatatttatagttacctccttcttacgtacgttttacgggccggtaacgggtaccgtaaagggtcggtaacgtacttaaccgaaaacgtaaccgttagggtacggtctaccgg

SEQ ID NO: 131895 - DNA, 540 bp, Homo sapiens
  misc_feature: GYAE6OF02H5TL2.17.55.E11.1.454.CMB.1.raw
  modified_base (237)..(237): a, c, t, g, unknown or other
  misc_feature (237)..(237): n is a, c, g, or t
  modified_base (418)..(418): a, c, t, g, unknown or other
  misc_feature (418)..(418): n is a, c, g, or t
  modified_base (452)..(452): a, c, t, g, unknown or other
  misc_feature (452)..(452): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttanacagctccaacagtaaagaactacttagcttggtaccagcagaaaccaggacagcctcctaagctgctcatttactgggctagtcctacccggggaatcccggggtccctggaccgattcagtggcgagcgggtctgggacagtatttcactctcaccatcagcagcctgcaggctgaagntggtgctagtttatctgtcagactaattattaanagttacctcctctaccgtacgtttcgggcggtaacgggtaccaagggttcgaagtactaccgtaaacgtacgtggtacggactaccgg

SEQ ID NO: 131896 - DNA, 1051 bp, Homo sapiens
  misc_feature: GYAE6OF02FXV8Z.17.55.E11.1.454.CMB.1.raw
tcagcgtagactagcacgaccggtgctcgatttagcactcgcacgttaggttggggagacggtacgaacaggccaggctagggggccagcgaaacgatgggtagttccgcagacccaggtcttcatttcctcctgtgctctggatcctctggtcgcctacggggacaatcgtgatgacccagtctccacgactccctggctgtgtctctcggcggaagaggccaccatccaactcgcgaacgtccacgccgagtacgttgttttactacgacgaccttccgaacctaggttaaacgaacgtaaccttaaggtaccgtttcgggtaaccccaaggtccaaccggaaaacccgacggtaaccctacggtaccccttacccttaaacggtccgttacggtaccttaccgtaaccttttaacccgtacgggggtacccctaacgtttacccggttaaaccccggggtaacccgttaccccggggggttccccccgtaagggtaacccccggttaacgtttacccggtaacgggtttacggggtacccgggttaccgggtacccgggggggtttaccgtaacggggggtaaacccttaacgggttaaccctttttacccggaaccctttaccccgttaacccgtaaccccgtaaacggttccccgaaacggtacccgtaccgggtacccgttacggcccgtaaacggggttacccgttaagggtttaaacggtaacgttttacgggtttaaccgggttaaccgtttaacgggttttttaaacccgtttaaccggttaccggtttaaaccgttaacgggttaaacccgtttaaacgttttaaccgggttttaaacggttaaccccgggttttaacccgttttacccgtttacccggtttaacccggttaacccggttttaccgggggtaaccgggttaaacccgggggttaaacccgtaaaccgggggtttaacgggtaaacgggttaccggttaaacccggttaaaacccgggtaaacccggttttaccggttaacgggtacccgtttaacccggg

SEQ ID NO: 131897 - DNA, 574 bp, Homo sapiens
  misc_feature: GYAE6OF02IVQD0.17.55.E11.1.454.CMB.1.raw
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
  modified_base (370)..(370): a, c, t, g, unknown or other
  misc_feature (370)..(370): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttanacagctccaacagtaagaactacttagcttggtacccagcagaaaccaggacagcctactaagctgctacatttacgnggcatccgtacccgggaagtcccggggtcctgaccgtattcagtggcagcgggtngggacagtatttcgactctacacatcagccagcctgaccaggtctagaagtgtaggtcggtactagttttatacgtgtaccgagtactaagttactttaagtacgttactccgttactcgtaccgttttcgggcgggtaacgggaaccgtaagggtacggtaagtaacgtaccgtaaacggaacgttcggtacggtcttaccgg

SEQ ID NO: 131898 - DNA, 519 bp, Homo sapiens
  misc_feature: GYAE6OF02G3M8R.17.55.E11.1.454.CMB.1.raw
  modified_base (236)..(236): a, c, t, g, unknown or other
  misc_feature (236)..(236): n is a, c, g, or t
  modified_base (515)..(515): a, c, t, g, unknown or other
  misc_feature (515)..(515): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttanacagctccaacagtaagaactacttagcttggtaccagcagaaaccaggacagcctctaagctgctcatttactggcatccgtacccgggaatccggggtccctgaccgtattcagtgcagcgggtctgggacagtactttcactctcactatcagcagcctgcaggctgagatgtggctagtttatacgtgtcagtacaattattaatacgtactcctctctacgtttacggcggtacggtacgaaggtcggagtacgtacgaacgtaacgtcgtagntacg

SEQ ID NO: 131899 - DNA, 534 bp, Homo sapiens
  misc_feature: GYAE6OF02F7JX3.17.55.E11.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtacctacggggacatcgtgatgacccagtctccagactccctggctgtgtctctgggcgagagggccaccatcaactgcaagtccagccagagtgttttanacagctccaacagtaagaactacttagcttggtaccagcagaaaccaggacagcctacctaagctgctcatttacnggcatctacccgggaatccggggcctgaccgattcagtgcaggcgggtctgggacaggtatttcactctcaccatcagcagcctgcgaggctaggaagtgtgtggactaggtttacttactgtacagactaattattatagtactcctctactacgttcggacgggtaggaaccgtaagggtacgagtaatacgtaaacggtactaggtacggtctgacc

SEQ ID NO: 131900 - DNA, 843 bp, Homo sapiens
  misc_feature: GYAE6OF02F43GP.17.55.E11.1.454.CMB.1.raw
  modified_base (246)..(246): a, c, t, g, unknown or other
  misc_feature (246)..(246): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccatcaactgacaagtccagccagtagttgttttatacngcctaccaaacagtaagaacttacttacgtcttacgggtaacccaggtaccaaacgtaaaacccgaagggaacctaacgcccttaccgtaaagccttacggccttactacgtttacgtcgggactacgttacccggtaacccggggtaacgttcccgggggtaccctacggtaacccgtacgtttccgaagggtcggaccgtacgggtcccggggttacgttacgggggaaccttaagggttacctttttacccgaacccgtttacccgttaacccaacccgttaaaccgtacccggtaaacggtaccccgtaaccggtacccgttacgggaccggtaacgggtacccggttaaaggaacggttaacgttcgggttaccgggtacgttttaacggttttaacgtttaacgtacgttacgtaacggtttaacttaaacgtttaacttaacgttacgttaacccttcccgtttaccgttaccgttacggtttaccgggggaaccggtaaccggggttaaccgggttaacgggttaggtaacggtaaccgttaacggtaaaaccggttaaccggttacgggttacggtaccgtaacccgg

SEQ ID NO: 131901 - DNA, 857 bp, Homo sapiens
  misc_feature: GYAE6OF02I4IQ6.17.55.E11.1.454.CMB.1.raw
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagttgtttaatacagcctcaacagtaagactacttagcttggtaccagcaagaaaccaggacagcctactaacgctgctcacgtttacgcgggtacataccgtacccgggaagttccccggggtacctcggaaccgtacgttcgacggttggacgtacggtccggggtacgttcggggaacctaaggttacttttacccgtaaccttacccgtttaccaacccgtaaacgttcccgaacggtacctaaccgggtcccgttacgggacccgtaagggtccgtttaaacggaaacggttaacggttcgggttacgggggtaccctttaaagggtttttaaccgtttaaccggtttacggttacccggtaaacgttaacccgttaaaagttttaacggttttaaaactttaaacccggtttaacccgttttccccgtttaaccgtttaacccggttttaacccgggttttacccggggtaaacccggggggttaaacccgggggtaaaacccgggttaaaaccgggggtttaaggggtaaaacccggtttaaacccggtttaaacccgggtaaaaaaccccgggtttaaacccggtttaacgggttaccggggttaaacccgttaaccccggg

SEQ ID NO: 131902 - DNA, 620 bp, Homo sapiens
  misc_feature: GYAE6OF02H177I.17.55.E11.1.454.CMB.1.raw
  modified_base (240)..(240): a, c, t, g, unknown or other
  misc_feature (240)..(240): n is a, c, g, or t
  modified_base (358)..(358): a, c, t, g, unknown or other
  misc_feature (358)..(358): n is a, c, g, or t
  modified_base (429)..(429): a, c, t, g, unknown or other
  misc_feature (429)..(429): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgacaagtccagccagagttgttttanacagctaccaaacagtaaagaactacttagcttaggtaccagcaagaaaccaggaacacgcctacctaagctgcctactatttactggcatccgtacccgggaagtcccggggtcccncgaccgtagttccgagtggcgaggcggtcgtggactagtacgtttcaccttctacacctatccacgcgacnccgtgacgaggtactaggtaagtgttgtagtacgttaacttttaagttaccgtgtacaacgtactaaagttagtttaacgtaacgttccttacccttcgttaccgtacggtttacgggaccggtaacgggtaacccgaagggttacggacgtaacgtaaccggtaaaccgtacgtcggttacggctaccgg

SEQ ID NO: 131903 - DNA, 686 bp, Homo sapiens
  misc_feature: GYAE6OF02ISCE4.17.55.E11.1.454.CMB.1.raw
  modified_base (262)..(262): a, c, t, g, unknown or other
  misc_feature (262)..(262): n is a, c, g, or t
tcagcgtagactagcacgaccggtgctcgatttagcactcgcacgttggggtttgggggagctacaacaggctaggcaggggcagcaaggatggtgttgcacgacccaggtacttcattttctctcgttgctctggactctctggtgcctacggggacatcgtgatgacccagtctccagaccttccctggctgtgtctcgtcgggcgaggacgggcccaccactcgaactgacaacgtccgagccaggtacgttggtttanacgagtctaccaacgacgtaacggaactacgttagcttcggtaccagcaacgaaacctaggacaacgcctacaagctagctacatttacgcgggacagtccgtaccgggaacgtccggggtaccctcggaccgtacgttcgaggtcggacgtacgggtcgggtctacgggaacctaggtacgtttccgagttcctaccgtaacgtacgttcgacgtacgtacgtccgtaggaccgagggtaccttagaacgtagtcggtacggtacgttacggttttaacttacgtacggtacgaacgtactaaactttaacttacgtaacgttacttcttaccgtcgttaacggtttccgggacggtaaccgggtacgtaacggggtacgaaggtaacctaacggaaaccgttacgtcggtacggtcgtacgg

SEQ ID NO: 131904 - DNA, 772 bp, Homo sapiens
  misc_feature: GYAE6OF02HXAOA.17.55.E11.1.454.CMB.1.raw
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatacaactgacaagtccagccagtagttgtttactacgagcctaccaaacgaagtaaacgtaaccttaacgttacgtccgttacgggtaacccaaggaccaaacgaaaacccgaggaaccacgtaccccttaccgtaagtcctcgtaccttacttaacgttttaccgtggggtacctacgttaccccggtaaccccggggtaaccgttccccggggtacccctacggtaacccgtacttcggacggtcggaccgtacgggtccgggtcgtacgggacgtacggttactttccgaccttccgtacctacgtacgtacacggtccgtacgtccgtagaccgaggtacctaggaacgtagtggtaacggctttaaggttttactcgttacgacgtaagacttaaagttagtttaacgttaaccgtacctttcccgttaccgttaccgttaaccgggtttacccggggacgggttaaaccgggtaaccggtaagggtaccggtaaacgttaaccgttaaacccggtaaacggttaccgggtttcgggtaccggttacccgtaaccgg

SEQ ID NO: 131905 - DNA, 683 bp, Homo sapiens
  misc_feature: GYAE6OF02HZYBJ.17.55.E11.1.454.CMB.1.raw
  modified_base (523)..(523): a, c, t, g, unknown or other
  misc_feature (523)..(523): n is a, c, g, or t
  modified_base (574)..(574): a, c, t, g, unknown or other
  misc_feature (574)..(574): n is a, c, g, or t
tcagcgtagactagcacgaccggtgctcgatttagcactcgcacgttgggtttgggggagctacaacaggcaggcaggggcagcaagatggtgttgcagaccccaggtcttcatttctctgttgctctggatctctggtgccgtacggggacatcgtgatcgaccctagtctccagtacctcccgtggctgtcgtctcgtgggcgaggacgggccaccactcaacgtcgacagtccagccagagttgtttacacacgctaccaacgtagtaaacgtaactacgttagtcgttacggaccagactaacggaaacccgaggacacgtaccctacgtaacgtcgtcgtactccgttaactttaccgtcgggtactacgttacccggtaacccggggtaacgttccccggggttacctacggtaacccgtacgttcgacggtcgacgtacggtcggttacgtacgggacttaggtacctttccgaccttcgtaccgtaccgtacgtacgacgtccgacgtacccgtnccggtagaccgtagtacgtacgttacggtcgtacgtagtttacttacgtanaccgtagtaactaagttactttaacgtaccgtaccttctactacgttccgtacgggacggtacggtacgaggtacgtacgacgtacgtaagtaccgtgtacgcgtaccg

SEQ ID NO: 131906 - DNA, 721 bp, Homo sapiens
  misc_feature: GYAE6OF02IBWUS.17.55.E11.1.454.CMB.1.raw
  modified_base (518)..(518): a, c, t, g, unknown or other
  misc_feature (518)..(518): n is a, c, g, or t
  modified_base (533)..(533): a, c, t, g, unknown or other
  misc_feature (533)..(533): n is a, c, g, or t
  modified_base (546)..(546): a, c, t, g, unknown or other
  misc_feature (546)..(546): n is a, c, g, or t
  modified_base (568)..(568): a, c, t, g, unknown or other
  misc_feature (568)..(568): n is a, c, g, or t
  modified_base (593)..(593): a, c, t, g, unknown or other
  misc_feature (593)..(593): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgccgtacgggacatcgtgatggaccagtctccagacctccctggctgtcgtctcgtgggcgagacgggccaccgatacaacgtggaccaacgtccgaacgaccgaaggtagtttgttttaactaacgacgccttaaccaaacgaaaggttaaacgaaacttacgttaacgcgttaacggttaccgaacgaccgaaacgaaaaccgtaacgggaaccaacggtaccctaacccgttaaagcctcggtaccttactaacgtttaacgcgggtacctacgtacccggtaacccggggtaacgttacccggggtccgtacggtaccgtacttacggacggttcgacggtaacggtccggggtcgtacgggaactggtacttacncgtactaccactacncacgctacgtccngacgagctagaacagtcggacngttaacgttattacgtaccggttanaacgtattaacgttattaacgtacgtaccttcgtaccttaccgttcggtaccggggtaacggtacgggtaaccggtaaggtaacgtacgtaacgtaaccgtaaacggtacggtacggtagtccgtacg

SEQ ID NO: 131907 - DNA, 650 bp, Homo sapiens
  misc_feature: GYAE6OF02GK5QK.17.55.E11.1.454.CMB.1.raw
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (330)..(330): a, c, t, g, unknown or other
  misc_feature (330)..(330): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccgatcaactgacaacgtccagccagtagttgtttanacngctaccaanagtaagaactacttagcttaggaccagcaagaaaccgaggacacgccctacctaagctgcctactactttacgnggacagtccgtaaccgggaacgtcccggggtccctaggacccgtattcgaggttcggactagggtccgggtacgtagggactaggttactttacgacctcctaccactactcgtaacgcgaacgtcctcggcgacgggtcctaaggaacgtagttcggtaggtactttaagttttacgttcgtaggttacgacgttactaaatttacgttaactttaaccgtacctcccttcttacttaccggtttaccgggacggtaacgggtaaccgaagggttcggaagtaacgttacgaaaccggtacgtggtacggtcctaacgg

SEQ ID NO: 131908 - DNA, 653 bp, Homo sapiens
  misc_feature: GYAE6OF02IAREK.17.55.E11.1.454.CMB.1.raw
  modified_base (238)..(238): a, c, t, g, unknown or other
  misc_feature (238)..(238): n is a, c, g, or t
  modified_base (324)..(324): a, c, t, g, unknown or other
  misc_feature (324)..(324): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgactacggggacatcgtgatgacccagtctccagactccctggctgtgtctctgggcgagaggccacatcaaactgacaagtccagccagagtgtttaanacagcctcaacagtaagaactacttagcttgtaccagacaagaaacccaggacacgacctactaagcgtcgactacaagtttacgnggcactacgtacccggaacgtccgggtacctacggaccgacttcgagtcggacacggtcgggtacgtacgggactaggtactttacacgttactcctaacctagttaacgccgaagtccgtagaccgtacggacgtagaaacgtagtggtacggtacgttaagttttaacttacgtacgttacgagtacctaaattaagttaattaacgttacctaccgttcctacgttaccgtttacgggtacggtacggggaacccttaaacggggttcggtaacgtaaccgtaaccgtaaaacggttaccgtagggttacgtaccgtacggtaccc

SEQ ID NO: 131909 - DNA, 658 bp, Homo sapiens
  misc_feature: GYAE6OF02IHM7G.17.55.E11.1.454.CMB.1.raw
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgactaagtccagccagtagttgttttatacagtctaccaaacgtagtaaacgtaacctacgttaagcttacggtaaccagaccaagaaaccgaggacacgtccctaccgtaagcctgaccttctaactttacggaggcctaacgttacccgtaacccgggtaacgtcccggggtaccctcggaccgtacttcgaggtcggcgaagggtccgggtacgtacgggactagtactttaccacttcctacacctatccgagtccacgcctgccgaggctaggtaagtgttcgggtacggtacttaagttttactaccgtgttaccagtaacgtaatttaacttacgtaacgttcctaccgttctaccgttacggtttcggaacggtacgggtacgtaagggttacgaacgttataaccggtaaccgttagtcgggtcgtagtaccg

SEQ ID NO: 131910 - DNA, 706 bp, Homo sapiens
  misc_feature: GYAE6OF02FIKZ4.17.55.E11.1.454.CMB.1.raw
  modified_base (363)..(363): a, c, t, g, unknown or other
  misc_feature (363)..(363): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatcgacccagtctccagacctccctggcctgtcgtctcgtgggcgagacgggccaccatccaactcgcaacgtccaagccagtagttgttttacacacgctacccaaacagtaactaaccttactacgtccgttaggtacccagacctaacgaaacccagggtaaccacgtcctaccgttaaagcttacgccttacttactttacgngggtaccaccttacccggtaacccgggtacgtcccggggttaccctagaccgtattccgaggttcggcacgggtcggtacgttacgggacctagtactttcgacctaccgtacaccgttacacctacgcctacgtccgtacgccgtaacggcttacggaaacgtcgttaccggtgtaccgtttaaggttttaacttacgtcgtaaccgaagtaacttaaacgtttattaccgtaaccgttacttcccgtacttcccgtacggttccgggtaacgggtacggtaaccgtaacgggtcgtaacgtaacgtaactaaaccggtacgttcggaccgggtctacccgg

SEQ ID NO: 131911 - DNA, 855 bp, Homo sapiens
  misc_feature: GYAE6OF02G6Q1L.17.55.E11.1.454.CMB.1.raw
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgccgtacgggacatcgtgatcgaccagtctccagacctccgtgctgtgtctcgtggcgaggacggcccacatacaacgtcgactaacgtccgacgaccgagtacgttagttttaacaccgacgtacctaaccaaacgtaaggtaaacgtaaccttaacgttaacgtcgtttaaccgggaaccctacggaaccgtaaaccgaaaacccggaacgggtaacccaccggtaccctaaccgtaaacgccgttacggaccttaccgtttaacgtttaccggtcgggtaacctaccggttaacccccggggtaaacccggggttaaccggttcccccggggttacctaacccgggtaaccgttaccgttacgtacgggtcgggaacggtaccgggttacgggtacggtaggggtaacctacggtttacctttaaccgtacccgtttccgaaccccgttaaccgtactaccgggtaaccgaccggttacccgtccggtaggaaccccgggtagggtaaaccgttaagggaaaccggttaggttcccgggttagtttaaccgttttaacggttttacgtttaacgcggttacgaacgttaaacgttagtttaactttactacgttacccgttcccttagtacccggtttacggtaccggggaggtaacccggtaggaacggtacgtactaaccggacgtaaaccgtcgggtagtcggacctaacg

SEQ ID NO: 131912 - DNA, 754 bp, Homo sapiens
  misc_feature: GYAE6OF02HKX3A.17.55.E11.1.454.CMB.1.raw
  modified_base (248)..(248): a, c, t, g, unknown or other
  misc_feature (248)..(248): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgccgtacggggacatcgtgatgacccagtctccagactccgtggctgtagtctcgtgggcgaggacggccacagtacaactgaccaagtccgagaccagtagttgtttanactagcctaccaacgaagttaaacgaacttacgtagtaccgttacggtaaccgacggaaccgaaacggaaaaccgacgggaacctaccgtacccttaacccgtaaacgccgttacgaccttaacgtacttttaacggtcggggaacctaacgttaccccggttaacccgggaacgttcccggggtacctcggaacgtcgttacgagggtcgacggacgggtcgggttacgtacgggaacttacggtacgtttacccgtaaccgttccaacccgtacctacgtaccgacggtccgtaaccgtccgtagaccggtacggtcggtaaaggtaacgtacggttaaccgggtcggtaacgtttacggttttactaccgttaggttaccgtaacgtaacttaagttaacttaacggttacctacgtttccctaagttaccgtacggtttacgggacggtaaccgggtacgtaaggtacgataaccggtacaacgtacgtggtacgagtaccg

SEQ ID NO: 131913 - DNA, 660 bp, Homo sapiens
  misc_feature: GYAE6OF02F79JD.17.55.E11.1.454.CMB.1.raw
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (626)..(626): a, c, t, g, unknown or other
  misc_feature (626)..(626): n is a, c, g, or t
tcagcgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccgatcaactgacaagtccagccagtagttgtttanacagtctaccaanaagtaaagaactacttagtcgttacggaaccagacaacgaaaaccgaggacacgtccctacaagtctagctactactttacgcggactacgtaccggtaacccgggtagtcccggggtacctgaccgtattcgaggtggcgtaggcgggtactagggactagtactttcaccgtacgtaccaaccagtcgacgacgtacgtccgtacgaccgtaggtcaaggtaagtacgttcgggtaagtaccgtttaagtttacgttaccgtagtactaaggtaacttaaagttaacttaacgttacgtacccttaccgttactttaccgtaaccggtttaccgggaacgggtaaccggtaccgtaaggtacggtanaacgtacggaaacgtagtcggtacgcgtaaccgg

SEQ ID NO: 131914 - DNA, 702 bp, Homo sapiens
  misc_feature: GYAE6OF02JIJLR.17.55.E11.1.454.CMB.1.raw
tcagcgtagactagcacgaccggtgctcgatttagcactcgcacgttgggtttgggggagctacaacaggcaggcaggggcagcaagatggtgttgcagacccaggtcttcatttctctgttgctctggatctcgtggtgcctacggggacatcgtgatgacccagtctccagacctccctggctggtgttctcgtggggcgaggacgggccaaccagtcaactcgcaaacgtccagccagacgtttgttttacacacgtcctaccgaaactagtaaacgaaccgttaacttaacgtcgtttacgggaacccaggaaccgtaacggaaaaacccgacggaacctaacgtacccttacggtaaacggtctaacgtccttacttacgtttacgacgggtacctacgtaccccggttaaccgggtaacggttcccgggtcccgtacgaaccggtattacgaggtcgcgtacggtcgggtacgacggggtaactaggttctttacgacctccgtacacctacgtacagcctacgacgtcgacgtacgcgttaaggagtacggtagttcgtactaagttttacgtacgttacgttacgaaggttacaatttaccgtaattacctacttccgtacctcgttaccgttaggaaccgggtaggaacggttaggacgagtaacgtacggtaacgtacgtcggagtcgtacg

SEQ ID NO: 131915 - DNA, 574 bp, Homo sapiens
  misc_feature: GYAE6OF01BAIVA.17.44.D11.1.454.CMB.1.raw
  modified_base (292)..(292): a, c, t, g, unknown or other
  misc_feature (292)..(292): n is a, c, g, or t
  modified_base (512)..(512): a, c, t, g, unknown or other
  misc_feature (512)..(512): n is a, c, g, or t
  modified_base (563)..(563): a, c, t, g, unknown or other
  misc_feature (563)..(563): n is a, c, g, or t
tcagcgtagactagcacgaccggtgctcgatttagcgcagtacgaagggggagagaggagcccagccctgggattttcaggtgtttccatttggtgatcaggactgaacagagagaactcaccatggaatttgggctgagctggctttttcttgtggctattttaaaaggtgtccagtgtcaggagcagttgttggagtcggggggagcctggtacagccgggtgggtccctgagactctcctgtgcagcctctggattcacctttaataacttcgacatgagctgggtccnccagacctccagggaagagcctgggagtgggtctcgtaagttttgtcgttaggtggtggtgacacatactacgcagacctccggtgaacgggccggttcaccatgtccagagacaattccaagaacactactttttctagtaaatgacaagcctgcgagccgacgacacggtccgtttatactgtcgaccgtaaacgtaaggggtcgggggagcgtacgnggctacgttgaccgacgtgggaccagggacccgtggtcaccgtctccgtcncgccctacccg

SEQ ID NO: 131916 - DNA, 637 bp, Homo sapiens
  misc_feature: GYAE6OF01B2VUG.17.44.D11.1.454.CMB.1.raw
tcagcgtagactagcacgaccggtgctcgatttagcgcagtacgaagggggagagaggagcccagccctgggattttcaggtgttttcatttggtgatcaggactgaacagagagaactcaccatggaatttgggctgagctggctttttctgtggctattttaaaaggtgtccagtgtcaggagctagttgttggagtcggggggagcctggtacaggccgggtgggtccctgagacctctcctgtcgcacgcctctggattcctaaccttttaataaccttcgactagtgagtccttcggggtcccgccagaacctccgaagggaacgcgccgtgggagtcgggtcctcgtaagttttcggtacgttagtggtggtagacgacatactacgcacgacctcggtaggaacggtccggttcaccgtatcgaccagacacaattaccaagaaccactacttttcgagtaaatgaacaagctagcgacgccgacgacgtacgtcgtttatacgtcgtacgaccgtaaacgtaacggggtacggggagcgtacgtcggtcttacgttcgaccgtacgtcggggacccgtacgggaaccctcggtcccgtaccgttcctaccggtcaccgtcccgtacccg

SEQ ID NO: 131917 - DNA, 606 bp, Homo sapiens
  misc_feature: GYAE6OF02IQH1W.17.44.D11.1.454.CMB.1.raw
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
  modified_base (352)..(352): a, c, t, g, unknown or other
  misc_feature (352)..(352): n is a, c, g, or t
tcagcgtagactagcacgaccggtgctcgatttagcgcagtacgaagggggagagaggagcccagccctgggattttcaggtgttttcatttggtgatcaggactgaacagagagaactcaccatggaatttgggctgagctggctttttctgtggctattttaaaaggtgtccagtgtcaggagcagttgttggagtcggggggaggcctggtacaggccgggtggtccctgagactctcctgtgcagcctctggattcacctttaataacttcgacatgagcgtggtccncagactccagggaacngcctggagtgggtctacgaagttttgcgttagtggtggtgacanatactacgcagcctcgtagaacgggtccgttcacctagttcgaccagacgactaattccaacgaacactacttttactagtaaatcgacaaagccgtgacgagccgacgacacggtacgttatactgtacgaccgaaacgtaacgggtcgggggaacgtacgtacgacgtacgtacgttacgaccgtacgtacgggaccgtaacgggtacccgtggtaccctaccggtccgtccgtacctacgtccctacccgg

SEQ ID NO: 131918 - DNA, 498 bp, Homo sapiens
  misc_feature: GYAE6OF01DV85O.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctcccagactcctcctctatggtgcttccaccagggcccctgactatccccgcaggttcagtggcagtggtctgggacagagttcactctcaccatcagcagcctgcagtctgaagattttgctagtttattactgtcaccagtataataactggcctcgtggactttggccaagggccaaggtgaaagcaaacgatgtgctgcaccatctgtctctac

SEQ ID NO: 131919 - DNA, 577 bp, Homo sapiens
  misc_feature: GYAE6OF01CKTX0.25.32.C10.1.454.CMB.1.raw
  modified_base (307)..(307): a, c, t, g, unknown or other
  misc_feature (307)..(307): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagcccaccctctcctgcagggccagtcagagcgttggcaggaacttagcctggtaccagcaagaaacctggccagccctccagacctcctcctctatggtnccttccaccacgggcccctgactactccccgcctaggttccaggtggcaggtgggtctgggacaggagttcactctcaccatcagcagcctgcagtctagaacgtatttgactagtttattactgtacactagttataataacgtcggccttcggtggtacgtttggaccgaaagggtacctaaagggtacgggaaacgtaccgtaaaacggtacgttagggtacggaccgtaggaccctaaccgtacttcgtcggttcttccgtaaccg

SEQ ID NO: 131920 - DNA, 493 bp, Homo sapiens
  misc_feature: GYAE6OF01BI84Z.25.32.C10.1.454.CMB.1.raw
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctccagactcctcctctatggtgccttccaccacgggccccctgactactccccgcaggttccagtggcagtggtctgggacaggagttcactctcaccatcagcagcctgctagtctagaagtattttgctagtttatactgtcacagtataatactgcctcgtgcgttgcgaagcagtgaaancgaacgatgngctgcacatcngtctntac

SEQ ID NO: 131921 - DNA, 581 bp, Homo sapiens
  misc_feature: GYAE6OF01DWB0T.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagccaccctctcctgcagggccagtcagagcgttggcaggaacttagcctggtaccagcaagaacctggccagcctcccagactcctcctctatggtgccttccaccgacgggcccctgactactccccgctaggttcagtcggctaggtgggtctgggacagagttcactctacaccatcagcacgcctgctagtctagtaagtattttgacttagttttaacttacgttgtactaactagttaactaactaacgtcggtacccgttcggttaggttaccgtttaggaccgtaaagggaccgtaagggtacggaaacgacgtaaaacgtacgtggtcggctagaccgtaacctattccgtcgttcctcgtaccg

SEQ ID NO: 131922 - DNA, 499 bp, Homo sapiens
  misc_feature: GYAE6OF01DA079.25.32.C10.1.454.CMB.1.raw
  modified_base (206)..(206): a, c, t, g, unknown or other
  misc_feature (206)..(206): n is a, c, g, or t
  modified_base (404)..(404): a, c, t, g, unknown or other
  misc_feature (404)..(404): n is a, c, g, or t
  modified_base (491)..(491): a, c, t, g, unknown or other
  misc_feature (491)..(491): n is a, c, g, or t
  modified_base (495)..(496): a, c, t, g, unknown or other
  misc_feature (495)..(496): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggngccaccctctcctgcagggccagtcagagcgttggcaggaacttagcctggtaccagcaagaacctggccagcctcccagacctcctcctctatggtgccttccaccgacgggcccctgactactccccgcaggttcagtggcaggtggtctgggacagtagtcactctcaccatcagcagcctgcagtctagaagtnttttgtagtttattactgtcacagtataatactgcctcgtgacgttgacaggacaaggtgaaagcaacgactgtgctgcactatctntctnntcc

SEQ ID NO: 131923 - DNA, 497 bp, Homo sapiens
  misc_feature: GYAE6OF01BGBFQ.25.32.C10.1.454.CMB.1.raw
  modified_base (396)..(396): a, c, t, g, unknown or other
  misc_feature (396)..(396): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctcccagactcctcctctatggtgcttccaccagggcccctgatactccccgcaggtcagtggcagtggtctgggacagagttcactctcaccatcagcagcctgcagtctgaagtntttgctagtttattactgtcacagtataatactgcctcgtgtacgttgaccgaaggaccaaggtgaaagcgaaacgatggtgctgcacatctntcttntac

SEQ ID NO: 131924 - DNA, 658 bp, Homo sapiens
  misc_feature: GYAE6OF01DZYV6.25.32.C10.1.454.CMB.1.raw
  modified_base (206)..(206): a, c, t, g, unknown or other
  misc_feature (206)..(206): n is a, c, g, or t
  modified_base (406)..(406): a, c, t, g, unknown or other
  misc_feature (406)..(406): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagngccaccctctcctgcagggccagtcagagcgttggcaggaacttagctggtaccagcaagaaacctggccacgcctcccagacctcctcctctatggtgccttccaccgacgggcccctgactactccccgcaggttcagtggcagtggtctgggacagagtcactctcaccatcagcacgcctgctagtctaggaagtnttttgcttagttttacttacgtcgtacctaacctagttaataaagttaaccgttcggtaccccgttccgggttacgggtaaccgggtttttacgggacccggtaaaacggggtaaccccgtaaaggggttacgggaaaaacgaccggtaaaaaaccggtaaacggttcggttaacggggaccttaccgggaacccgtaaccccgttaaacgtttcccggtttaacggtttcccgttttaccgttaaaccccg

SEQ ID NO: 131925 - DNA, 515 bp, Homo sapiens
  misc_feature: GYAE6OF01A2JPQ.25.32.C10.1.454.CMB.1.raw
  modified_base (507)..(507): a, c, t, g, unknown or other
  misc_feature (507)..(507): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggacttagcctggtaccagcagaaacctggccagcctcccagactcctcctctatggtgcttccaccagggccccctgactactccccgccaggttcagtggcagtgggtctgggacagagttcactctcaccatcagcagcctgcagtctgaagtattctgcctaacctatttattgtcaactaatttaaggacttaccctcttccttccttcggcggaggaccgaggtggagactacgaacgatggtggctgctaccatctnttctctac

SEQ ID NO: 131926 - DNA, 567 bp, Homo sapiens
  misc_feature: GYAE6OF01BKZR4.25.32.C10.1.454.CMB.1.raw
  modified_base (305)..(305): a, c, t, g, unknown or other
  misc_feature (305)..(305): n is a, c, g, or t
  modified_base (441)..(441): a, c, t, g, unknown or other
  misc_feature (441)..(441): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagccacccttctcctgcagggccagtcagagcgttggcaggaacttagcctggtaccagcagaacctggccagcctccagacctcctcctctatggtcncttccacagggcccctgactactccccgcaggttcagtggacaggtggtctgggacaggacgttcactctcacatcagcagcctgcagtctagaagtatgttgactaaactttattaccgtagtaacaaaaagttnttaaactacctcgtacccccttatccttaacgtttccgggacggaacgggaccctaaggggtgaagaattaccgaaaagtaactgggtacgacgttacggcctaaccgattccgtgttccttaacg

SEQ ID NO: 131927 - DNA, 513 bp, Homo sapiens
  misc_feature: GYAE6OF01ELUWS.25.32.C10.1.454.CMB.1.raw
  modified_base (293)..(293): a, c, t, g, unknown or other
  misc_feature (293)..(293): n is a, c, g, or t
  modified_base (509)..(509): a, c, t, g, unknown or other
  misc_feature (509)..(509): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagccaccctctcctgcagggccagtcagagcgttggcaggacttagcctggtaccagcagaaacctggccagcctcccagacctccncctctatggtgccttccaccagggccccctgatctaaaccccgccaggttcagtggcaggtggctgggacagagttcactctcaccatcagcagcctgcagtctagaagtattttgctagtttacttactgtcaccagtaataataactgcctccgtgtacgtttgaccgaagggacctaggtgaaagcgaaacgatgtggctgcacatctgtctntacg

SEQ ID NO: 131928 - DNA, 501 bp, Homo sapiens
  misc_feature: GYAE6OF01EUEPZ.25.32.C10.1.454.CMB.1.raw
  modified_base (364)..(364): a, c, t, g, unknown or other
  misc_feature (364)..(364): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (496)..(496): a, c, t, g, unknown or other
  misc_feature (496)..(496): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctcccagacctcctcctctatggtgcttccaccagggccccctgactactccccgccaggttcagtggcaggtgggtctgggacngagttcactctcaccatcagcacgcctgcagtctagaagtattttgctagtttattactgtcactttagataataactgcctcgtgacgttgcgaaggcaaggtgaagcaacgatgngntgcacatctcgtntctac

SEQ ID NO: 131929 - DNA, 786 bp, Homo sapiens
  misc_feature: GYAE6OF01BWUP3.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaacggagcctaccctctcctgcagggccagtcagagcgttggcaggacttagctggtaccagcagaaacctggccagcctccagtacctcctcctctagtcggtcgtccttacccgaccgacgggtccccctaggacttacccgtcccccgccgtaacggtttccgaaggttcgggaccgtaacgggttcggggttccgttacggggaacgtaacggttacggtttccaaaccgttccttacccgaaccctacgtaccgaacgcctaacggtcccgttaggacccgtaagtttccgtaaggttaaacggtttagtttttacgggaacctttaaggtttttaactttaccgtcgttaacccgtaaccctaaggttaaactttaaaacgtaccggttaccgggtaccccgtttaccgggtaaccggggttaacggttttaccgggaacccgtaaaacggggtaacccgtaaaagggggttacggaaaaaccggtacccgtaaaaacgggttaacgttaggggtaccggtacggttccgaaccgttaacccgtattacccggtttacgtttcccgttccgtaacccg

SEQ ID NO: 131930 - DNA, 527 bp, Homo sapiens
  misc_feature: GYAE6OF01D5BK4.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagccaccctctcctgcagggccagtcagagcgttggcaggaacttagcctggtaccagcagaaacctggccagcctcccagacctcctcctctatggtcgcttccaccacgggcccctgactactccccgcaggttcagtgcagtggtctgggacagagtcactctcaccatcagcagcctgctagtctagaagtatttgctagtttattacgtgtcactagtataactaactggtcctcggtagtacgtttggacctaagggaccgaaggtacggaaagacgaaacgatggtcggactgacctactatctcgtcttctac

SEQ ID NO: 131931 - DNA, 587 bp, Homo sapiens
  misc_feature: GYAE6OF01DUL7I.25.32.C10.1.454.CMB.1.raw
  modified_base (408)..(408): a, c, t, g, unknown or other
  misc_feature (408)..(408): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagccctccctgtctgtgtctccgtgggggaaagcgccaccctctcctgcagggccagtcagagcgttggcaggaacttagcctaggtaccagcagaaacctggccagcctacccagactcctcctctatggtgcttccaccgacgggcccctgactactccccgcaggttcagtgcagtggtctgggacagagttcactctacaccatcagcacgcctgacagtctagtaagtntttgctagtttatactgtacacctagtataaattacgtcggtacctcggttaggtacgtttacgggaccgtaaaggggaaccaaagggtacggaaaagtaccgaaaaaccgtaagttgggtacggtaccttagggaccctaacccgtaaagttccttacggttcctttacgtaaacccg

SEQ ID NO: 131932 - DNA, 589 bp, Homo sapiens
  misc_feature: GYAE6OF01EQ8IH.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtgggggaaggacgccaccctctcctgccagggccagtcagagcgttggcaggaacttagcctggtaccagcagaacctggccagcctccagactcctcctctatggtcgccttcccaccgacgggcccctgactactccccgctaggttccaggtcggctaggtcgggtcgtacgggacaggtacgttcactctacaccatcgacgcacgcctgctagtctagaagttattttgcttagtttacttactgtcctaactagtaataactacgtcggtccttcggttacggtacgtttcggaccgtaacgggacgtaaagggtaggaaagtaccgaaaacgtacgttggtacggacgtagaccgtaaccagttaccgttgttccttacgtaccg

SEQ ID NO: 131933 - DNA, 696 bp, Homo sapiens
  misc_feature: GYAE6OF01DS2IR.25.32.C10.1.454.CMB.1.raw
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggaagtaaattgtgatgacgcagtctccagccctcctgtctgtgtctccgtaggggaacgcncccacctctcctgcgaggccagtcagngcgttggcaggtacttagcctaggaccagacaagaacctcggaccacgtccctacccacgtacccttccctccttacttagtcgggttctcccttacccgaccggtaccgggtccccttaggaccttacccgtccccggcgtacgggttccaggttcggcgttacggggttcgggtacgtagggaacctaggtacgtttccaccgttcctaccaaccgtacgtaccgacggtacccgacgtcccgtgtacctagttcgtaagttacgtttagttttacgacgtttaattttacgttacgtacgttacaacttaagttaaactaacgtaaccgtccggttaccgttacgggttacggttacgttacggaacccggaaagggtaaccgtaagggtacgaaacgtaccgaaacggtgtaggcggtactacgaccttactacttacgttcttcctcttaccg

SEQ ID NO: 131934 - DNA, 549 bp, Homo sapiens
  misc_feature: GYAE6OF01DWDEA.25.32.C10.1.454.CMB.1.raw
  modified_base (206)..(206): a, c, t, g, unknown or other
  misc_feature (206)..(206): n is a, c, g, or t
  modified_base (295)..(295): a, c, t, g, unknown or other
  misc_feature (295)..(295): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctgggggaagngccaccctctcctgcagggccagtcagagcgttggcaggaacttagcctggtaccagcagaaacctggccagcctccagactcctcctntatggtgccttccaccgacgggcccctgactacgtccccgctaggttcagtggcaggtgggtctgggacagtagttcactctcaccatcagcagcctgcagtctagtaagtattttgcttagtttatactgtacacctagtataatactggtccttcggtggtacgtttcggaccgtaagggacctaagggtacggaaagtaccgaaaacggaacttggtcggactcgacctacctattctcgttcttctaccg

SEQ ID NO: 131935 - DNA, 542 bp, Homo sapiens
  misc_feature: GYAE6OF01AHDEO.25.32.C10.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (402)..(402): a, c, t, g, unknown or other
  misc_feature (402)..(402): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagngccaccctntcctgcagggccagtcagagcgttggcaggacttagcctggtaccagcagaacctggccagcctcccagacctcctcctctatcggtgccttccaccacgggccccctgactactccccgcaggttcagtggcaggtgggtctgggacagagttcactctcacatcagcacgcctgcagtctgaagtntttgctagtttattactgtccactagtactaataacgtcgtccgtccgtggtacgtttcggaccgtaagggacctaagggtacggaaacgaccgaaacggtacgtggtcggctacgacctaccgatcctgtccttctacc

SEQ ID NO: 131936 - DNA, 548 bp, Homo sapiens
  misc_feature: GYAE6OF01DD63X.25.32.C10.1.454.CMB.1.raw
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggacgccaccctctcctgcagggccagtcagagcgttggcaggaacttagcctggtaccagcagaaacctggccagcctcccagactccctcctctatggtcnccttccacctagggccccctgactactccccgccaggttcagtggcaggtgggtctgggacngtagtcactctcaccatcgancagcctggctagtctagaagtatttgctagtttattactgtacactagtaataataacgtcggtcctcggtggtacgtttgggccaaaggggacctaagggtacggaaagacgaaaacggactggtcggactcgactacctatcttgtccttctaccg

SEQ ID NO: 131937 - DNA, 597 bp, Homo sapiens
  misc_feature: GYAE6OF01DJMH0.25.32.C10.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagngccaccctctcctgcagggccagtcagagcgttggcaggaacttagcctggtaccagcagaaacctggccagcctccagacctcctcctctatggtnccttccaccacgggcccctgactactccccgcaggttcagtgctaggtcggtctgggacagacgttcactctcaccatcagcacgcctgctagtctagaagtatttgctagtttatactgtcactagtataaatacgtcggtaccttccgtagggtaccgttttcgggacgtaaacggggtaccctaaaggggtacgggaaaacggaccgaaaaaccgggtaacgtttagggtcggggtaccttacggacccgtaacccgtaacgttccgttacggtttccctttacgtaacccg

SEQ ID NO: 131938 - DNA, 603 bp, Homo sapiens
  misc_feature: GYAE6OF01BKMFJ.25.32.C10.1.454.CMB.1.raw
  modified_base (207)..(207): a, c, t, g, unknown or other
  misc_feature (207)..(207): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggngccaccctctcctgcagggccagtcagagcgttggcaggacttagctggtaccagcagaaacctggccagcctcccagacctcctcctctatggtgcttccaccacgggcccctgactactccccgcacggttcagtggcagtggtctgggacagtagttcactctacaccatcagcagcctgcagtctgaagtatttgctagtttatactgtactacctagtactaataacgtcggtcccttccggtggttaccgtttcgggacccgtaaaggggtacccaaaggggttacggaaaacgtacccggtaaaaaccggtacgttacgggttacggggaccctttaggaacccgtaacccgtaactttaccgtccggtttaccctttacgtaaccccg

SEQ ID NO: 131939 - DNA, 612 bp, Homo sapiens
  misc_feature: GYAE6OF01BIIXS.25.32.C10.1.454.CMB.1.raw
  modified_base (431)..(431): a, c, t, g, unknown or other
  misc_feature (431)..(431): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagcgccaccctctcctgcagggccagtcaggagcgttggcaggaacttgcctggtaccagcagaacctggccagcctccagactccctcctctagtcggtcgccttcccaccgtacgggcccctgactactcccccgctagggtttccaggtcggactagggtcgggtcgtgggacaggtacgttccactctacacctagtcagcacgcctgctagtcgtgtaacgtnttttcgcttagtttactacgtgtacctactaggtaattaactaacgttcggtcccgttaccggtcggttaacggtttcggaccgaagggtaccgtaagggtacggaaacggtcgtaaacgggtacgttggcgggtaccttcggaacctaccgtacgttccgttacggtccttcgtaacccg

SEQ ID NO: 131940 - DNA, 538 bp, Homo sapiens
  misc_feature: GYAE6OF01AL0WZ.25.32.C10.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagngccaccctctcctgcagggccagtcagngcgttggcaggactagcctggtaccagcagaaacctggccagcctcccagacctcctcctctatggtcgcttccaccacgggcccctgactactccccgcaggttcagtcggcagtcggtctgggacagagttcactctcaccatcagtcagcctgcagtctgaagtattttgacttagtttacttactgtcactagtaataactaactgcctcggtggtacgttcggaccaagggacgaaggtacggaaagaccgaaacgtacgtaggtcggctagacctaccacttactcgttcttctaccg

SEQ ID NO: 131941 - DNA, 697 bp, Homo sapiens
  misc_feature: GYAE6OF01CXN4W.25.32.C10.1.454.CMB.1.raw
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagacgcccaccctctcctgcagggccagtcagagcgttggcaggacttagcctggtaccagcagaacctggccagcctccagacctcctcctntatggtcnccttccgaccgcggcccctgactactcccccggacctaggttccaggtcggcgtaggtcgggtcgaggacgagttacgtctacgtcctacaacctcgtacgacgaccgacggtcccgtagacctaacgttaccgttaaggttaaacggtttttgtttttttaacggtttaagtttttaaccgttaacgttacccgtttaacctaacgtttaaggtttaaacttaaacgttaaccggttccggttacccgtttacgggttacggtttacggtttaccgggaaccgggtaacggtaaacgggtaacgggtaaaggaaacgaacgtaaaccggtggtagttcggaccttacggtacccacgttacttcgttatttacccttcgttcccgttccccg

SEQ ID NO: 131942 - DNA, 577 bp, Homo sapiens
  misc_feature: GYAE6OF01CFEP2.25.32.C10.1.454.CMB.1.raw
  modified_base (309)..(309): a, c, t, g, unknown or other
  misc_feature (309)..(309): n is a, c, g, or t
  modified_base (384)..(384): a, c, t, g, unknown or other
  misc_feature (384)..(384): n is a, c, g, or t
  modified_base (420)..(420): a, c, t, g, unknown or other
  misc_feature (420)..(420): n is a, c, g, or t
  modified_base (568)..(568): a, c, t, g, unknown or other
  misc_feature (568)..(568): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagcccaccctctcctgcagggccagtcagagcgttggcaggaacttagcctggtaccagcagaaacctggccagccctccagacctcctcctctagtcggtcnccttcccaccgtacgggcccctgactacctccccgctaggttcagtggcaggtggtctgggacagcgttcactcncacatcagcacgtccttacgacgttctaggaagttnttttcgacttagtttattactgttcctaactagtaattaagtacgtcgtccttccgggtgttacggtttcggaccgtaagggtaccgaagggtacgaaagaccgaaaggaccgttaggcggtctcgacaccgtactcgtagtcttacncgttccccg

SEQ ID NO: 131943 - DNA, 564 bp, Homo sapiens
  misc_feature: GYAE6OF01DWVFU.25.32.C10.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctccagatgccactggagaaattgtgatgacgcagtctccagcctccctgtctgtgtctccgtggggaagngccaccctctcctgcagggccagtcagngcgttggcaggaacttagcctggtaccagcagaaacctggccagcctcccagacctcctcctctagtggtcgccttccaccgacgggcccctgactactccccgcaggttcagtgctaggtggtctgggacagtagttcactcgtacacctatcgagcagcctgcagtctagaagtatttgcttagtttatactgtcactagtataacgtaactggtacctcgtggtacgtttaggaccgtaagggaccgtaagggtacggaaacgaccgtaaacggtaacgttcggtcggacgttagaccgtaacctagttacctcgttccgttctaccg

SEQ ID NO: 131944 - DNA, 632 bp, Homo sapiens
  misc_feature: GYAE6OF01A82GP.25.32.C10.1.454.CMB.1.raw
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
  modified_base (382)..(382): a, c, t, g, unknown or other
  misc_feature (382)..(382): n is a, c, g, or t
  modified_base (619)..(619): a, c, t, g, unknown or other
  misc_feature (619)..(619): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggacgcccaccctctcctgccgagggcccaggtcaggagcgtagtcgacgagtactcgcgtacgacngacaactacgcgacncgcccncgacgtcctcctctntgtcggctcctaccgacgccgtccagtactcccgccgacgtacgtcacggtcgagtcggtcgtcggtacggacgngtacgtcctcgtaccgccaacttcctacgacgacgtaccgctaggactacgtcgtaagtagtttcttagacgtttatttactagctacaacgttagttaataacgttcggccgttaccggtgttacgggttccgtacgtaaccgggaaacgtacgggttaaagtaacgggaaccgtaaccgaaaacgggtttcgtcgggccgtaaccgtacgtaaccccactttagttcccggtttnttaacccctttcg

SEQ ID NO: 131945 - DNA, 534 bp, Homo sapiens
  misc_feature: GYAE6OF01A5O9Z.25.32.C10.1.454.CMB.1.raw
  modified_base (207)..(207): a, c, t, g, unknown or other
  misc_feature (207)..(207): n is a, c, g, or t
  modified_base (408)..(408): a, c, t, g, unknown or other
  misc_feature (408)..(408): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctcctggggaaggngccaccctctcctgcagggccagtcagagcgttggcaggaacttagcctggtaccagcagaaacctggccagcctcccagacctcctcctctatggtcgcttccaccacgggcccctgactactccccgcaggttcagtggcaggtcgggtctgggacaggtagttcactctcaccatcagcagcctgcagtctgaagttntttcgctagtttattctgtcactagtaactaatactggcccttcggtaggtacgtttggaccgtaagggccaagggttcggaaagcaaacggtactggtcgactgcaccagtcctgttcctgtacc

SEQ ID NO: 131946 - DNA, 608 bp, Homo sapiens
  misc_feature: GYAE6OF01AYEI7.25.32.C10.1.454.CMB.1.raw
  modified_base (308)..(308): a, c, t, g, unknown or other
  misc_feature (308)..(308): n is a, c, g, or t
  modified_base (439)..(439): a, c, t, g, unknown or other
  misc_feature (439)..(439): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccatggagaaattgtgatgacgcagtctccagccctccctgtctgtgtctccgtggggaagacgcccaccctctcctgcagggccagtcagagcgttggcaggtaactgcctggtaccagcagaacctggccagccctccgagacctcctcctctagtcggtcnccttaccaccgacgggcccctgactacctccccgctacggttcaggtcggcgtaggtcgggtacgtaggggactaggtacgttacacgttctaccacctatccagccacgtcctgctagtctagtaagttntttgcttagtttatactgtacacgtagtaataactacgtcggtccttacggtaggttaccgttaggaccgtaaggggacctaagggtacggaaaacgtacgtaaaacggtagtaggtcggtacgtacgtacctaaccgttacgttacgttacggttccttcgtaacccg

SEQ ID NO: 131947 - DNA, 709 bp, Homo sapiens
  misc_feature: GYAE6OF01B9WX7.25.32.C10.1.454.CMB.1.raw
  modified_base (422)..(422): a, c, t, g, unknown or other
  misc_feature (422)..(422): n is a, c, g, or t
  modified_base (469)..(469): a, c, t, g, unknown or other
  misc_feature (469)..(469): n is a, c, g, or t
  modified_base (696)..(696): a, c, t, g, unknown or other
  misc_feature (696)..(696): n is a, c, g, or t
tcagactgtacagtcacgaccggtgctcgatttagtatagacatcaacacacaaaagggggaggaactgctcagttaggacccagacggaaccatggaagccccagcgcagcttctcttcctcctgctactctggctcccagatgccactggagaaattgtgatgacgcagtcctccagccctccctgtctgtgtcctccgtaggggaagacgcccacccttctccctggcgacgggccaggtcaggagtcggttggcaacgggtaacttacggccgttagggtaacccagaccgaaacggaaacccgtcggacccacgcccctaccccgaacgtacccttcccctccttcttagttcgggtctccctttacccgaccgaccgggtccccttaggaccttacccgtccccgccgtacggtcnggtcggctagggtggtcgtagggactagtcgttaccactctccaacntcgacgccacgcctagcctagtccgttagtaagtttagttttacgacttttaagtttacttacgttgtacctaacgtaagttaactaacgttaaccgttcggtcccgttaccggtcggttaaccgtttcgggaaccgtaaacggggtaccgtaagggtacggaaaacgaccgtaaacggtacggttggtacggtccgtacggaacctaccgttactacttaccgttnttacccgtacccg

SEQ ID NO: 131948 - DNA, 618 bp, Homo sapiens
  misc_feature: GYAE6OF01EFTQK.25.32.C10.1.454.CMB.1.raw
  modified_base (192)..(192): a, c, t, g, unknown or other
  misc_feature (192)..(192): n is a, c, g, or t
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatgccactggagaaattgtgatgacgcagtctccagccctcctgtctgtntctccgtggggaagcgccaccctctcctgcagggccagtcagngtcgttggcaggtacttgcctggtaccngacagaacctggaccagccctccgagtacctcctcctctagtcggtctccttccaccgacgggtcccctgactacctccccgcgtacggttcgagtcggcgtaggtcggtcgtcgggacaggtacgttccactctaccacctatcgacgcacgcctgcgtagtcgtagtagttatttcgattagttttacttactcgtactaaccgtagttaacttaacgtaacgtcggtcccgttacggttacgggttaccggtttacggaacccgtaagggaacccgtaaggggttacgaaacgtaccggtaaaacgtacgtacggtcgtacgtcgacctactactcgttctccttgtacccg

SEQ ID NO: 131949 - DNA, 654 bp, Homo sapiens
  misc_feature: GYAE6OF01BP618.25.32.C10.1.454.CMB.1.raw
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
  modified_base (371)..(371): a, c, t, g, unknown or other
  misc_feature (371)..(371): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatgccacgtggaagaaattgtgatgacgcagtcctccagccctccgtgtctgtgtcctcggtggggaagcnccaccctctccgngacgacggccagtcagagtcgttggacaggtaacttagccgtacggtacagacgaacgaaaccgtggaccacgcccctacccgagtacctcctccttacgtagtcggtctaccttcccgaccgtaccggcccctagaccttaccncccccgtacgtacggttacgacggtcggacgtagggttcgggtacgtacgggaactggtaacgttccaaccttccgaacaccagtaccgacgtcacgtcctgactaggtctagtaacgtatttcgactttaagtttacgtactcgtacacgtaagtaactaacgtaacgttcggaccgttacggtaggtacgttcgaaccgaacgggaccgtaaagggtacgaaacgacgtaaaacgtagttacggtcgactcggaacctaccggcttatcgttctcgtaccg

SEQ ID NO: 131950 - DNA, 587 bp, Homo sapiens
  misc_feature: GYAE6OF01E0A0K.25.32.C10.1.454.CMB.1.raw
  modified_base (387)..(387): a, c, t, g, unknown or other
  misc_feature (387)..(387): n is a, c, g, or t
  modified_base (420)..(420): a, c, t, g, unknown or other
  misc_feature (420)..(420): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtgggggaaggagccaccctctcctgcagggccagtcagagcgttggcaggacttagcctggtaccagcagaaacctggccagccctccagacctcctcctctagtcggtgtcctccaccgacgggcccctgactactccccgctacggttcaggtcggctaggtgggtcgtgggacaggtagttcactcncaccatcgagcacgcctgcagttctagaagttntttgctagtttatactgtacactagtaataattacgtcggtccgtcgtacggtcgtttacggaccgtaacgggtaccgaagggttaggaaaacgtacgaaaaccggtagttacggtacgggtcctacggaccctaaccgttacttaccgttcgttccttccgtaccg

SEQ ID NO: 131951 - DNA, 620 bp, Homo sapiens
  misc_feature: GYAE6OF01BG1AP.25.32.C10.1.454.CMB.1.raw
  modified_base (237)..(237): a, c, t, g, unknown or other
  misc_feature (237)..(237): n is a, c, g, or t
  modified_base (371)..(371): a, c, t, g, unknown or other
  misc_feature (371)..(371): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaaggagcccaccctctcctgcagggccagtcagngcgttggcaggaacttagcctggtaccagcagaacctggccagccctcccagacctccctcctctatcggtgccttcccacccgacgggccccctgactactcccccgctacggtcaggtggcaggtgggtcgngggactaggtagtcctactctaccaccactacacgcacgcctgctacgtctagaagttatttggactttagtttacgttactcgtacctacctaagttaataaacgttacgttccggtaccttaccgggttcggttacggtttacggaccggaaagggtaccggaaagggttacggaaacgaccgtaaaccggtagttggtcgggtactcggacctaccgtacttccgttacgttccgtttcgtacccg

SEQ ID NO: 131952 - DNA, 684 bp, Homo sapiens
  misc_feature: GYAE6OF01ECPLJ.25.32.C10.1.454.CMB.1.raw
  modified_base (212)..(212): a, c, t, g, unknown or other
  misc_feature (212)..(212): n is a, c, g, or t
  modified_base (472)..(472): a, c, t, g, unknown or other
  misc_feature (472)..(472): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatcgccacgtggaagtaaattggtgatgacgcagtctccagcctcctgtctgtgtctcgtaggggaagcncctacctctcctgcgacgggccagtcaggagtcggttggacaggtaacttacgccgtacggtaccaggacaacgaaacccgtcggaccacgccctaccacgtacctcctcctcgtagtcggtcgtccttaccgaccggacgggtcccctagactaccgccccgtcgtacggttcagggtcgcgtagggtcggtcgtagggactaggtacgttccacgttcacacctatcgagcacgtcctgactagttactagtaagttntttagactttatttactactcgtacctaactaagtaactaaacgttaccgtacgtcccgttacggttacggttacggtttacggaaccggttaacgggaaccggttaaagggtacggaaaacgtaaccgtaaaacggtacgttacgggtacggtacgtacccgaaccgttaaccttaacgttcccgtttacggttacccttccgttaacccg

SEQ ID NO: 131953 - DNA, 691 bp, Homo sapiens
  misc_feature: GYAE6OF01EIM3H.25.32.C10.1.454.CMB.1.raw
  modified_base (170)..(170): a, c, t, g, unknown or other
  misc_feature (170)..(170): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatcgccactggagtaaattgtgatgacncagtctccagcctcctgtctgtgtctccgtaggggaacgcgccacccttctccgtcggacgacggcctagtacgagcggtcgttggactaaggtacctagcctacggtaccagcaacgaacctcggaccacttcccacctacgtaccctccttcctacgtacgtcggtctaccgttcccaccgggaccggtcccctagtactacccgtcccccggtacgtacggttcgaggtcgcgtagggtcggtcgtagggactagtcgtctactctaccacagtacgacgcctacggtcctgacttacgtcgtaacgttagttactttcgacttttacgtttaacttacgtaccgtaactaccttaaagttaacgtaaccgttaaccgggttccgtaccgttccgggttaagttaccggttaaccgggaacgttaacggaacgggttaagaaccggtaaagaccggtaaacgtagggtcggtcgaccgtacgaaccgtcgtacttaccgtctttccgtaacgttcccg

SEQ ID NO: 131954 - DNA, 840 bp, Homo sapiens
  misc_feature: GYAE6OF01B5VAN.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggggctcccagatgccactggagaaattgtgatgacgcagtctccagcctccctgtctgtgtctccgtggggaggacgccaccctctcctgcagggccagtcagagcgttggcaggtactacgctggtaccagcaagaacctcggccacgccctcccagacctccctccttctagtcggtcgccttacccacccgaccgggcccctagacttaccgtcccccgaccgtacggttcgacggttcgggaccgtacgggttcggggttacgtacggggaccgtaacggtacgtttaccgtacccttaccgtaccctaaccctacttccgaacggtacccgaccgggttccccgttgggtaaccgtaaccggtttacccgttaaggtaaacgggttttactttttttaccgggaaccgtttttaagggtttttaaccttttacccgggttaggtttacccctaaacccgtttaaggtttaaacgttaaacgggtttaacccggttcccggggttaaccccgttttccccggggtaagggttttacccgggtttaccggggaaccccggtaaaacgggggtaccggttaaaacgggtagggaaaaaccggtaccgtaaaaccgggttacggtttaggggacccggttaggtaccccggtaacccgtaccgtttaacgttacccggttttccgttcctttaccgttaacccccg

SEQ ID NO: 131955 - DNA, 656 bp, Homo sapiens
  misc_feature: GYAE6OF01BMEEH.25.32.C10.1.454.CMB.1.raw
  modified_base (159)..(159): a, c, t, g, unknown or other
  misc_feature (159)..(159): n is a, c, g, or t
  modified_base (174)..(174): a, c, t, g, unknown or other
  misc_feature (174)..(174): n is a, c, g, or t
  modified_base (200)..(200): a, c, t, g, unknown or other
  misc_feature (200)..(200): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatgccatggagaattgngatcgacgcagtccnccagccctcctgtctgtgtcctccgnggggaagctccaccctctcctgcgaggcctagcgaagtcgtcgttgctaaggaacttgccgttaggaccagacaagaaaccctggccacgtccctacccagtacccttcctacctaccttagtcggtctacctaccgaccgacggtcccctagtacctaccgtccccgacgtacggtttaccaggtcgcgtagggtcggtaccagggacaaggtcttccacttccaccgaactacgcgacgacgaccggttaccgcgataccgttacgtaacggtaaagtttacttttaggtaactttaaagttttacttaacggttctaaccgtacctaaaggttaactaaagttaaccgtcgtaccgttcggttacgtacggttacgacggtaacggacgtaaggtacgaaagacgtaacgagtacgttgactcgactacctatacgtcgttaccttcgtaccc

SEQ ID NO: 131956 - DNA, 744 bp, Homo sapiens
  misc_feature: GYAE6OF01AVN2Y.25.32.C10.1.454.CMB.1.raw
  modified_base (153)..(153): a, c, t, g, unknown or other
  misc_feature (153)..(153): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactgganaaattgtgatgaccgcagtctccagcctcctgtctgtcgtctccgtggggaacgcnccaccctctccgtgcgacgggccagtcagngtcgtggacaggtacttcgccgtggtaccagacaacgaaccgtcggccacgcccctaccgagtaccctccctcctctagtcggtcgtccctacccgaccggtaccgggtcccctagtaccttacccgtcccccgtacgttacggttcgacggtcggccgtaggggttcgggtaccgtacggggtaactacggttaccgttacctacccgttcctaccgaacccgtactcccggacgtacccgaccggtcccgtacggtacccgtacgttaccgttaagggttaacgtttacgttttacgtacccgttttaagttttaccgtttaccgttcgtaaccctaacgttaaacggttaaacttaaccgttaaccggtcccggttaccggttacccggttacgggttacggttaccggaccggtaaacgggtaccggtaagggtaacggaacgaacgtaaccgtaggttcggtacggtcgactaccgtactacgttcctcgttctcgtacc

SEQ ID NO: 131957 - DNA, 683 bp, Homo sapiens
  misc_feature: GYAE6OF01AOM7G.25.32.C10.1.454.CMB.1.raw
  modified_base (374)..(374): a, c, t, g, unknown or other
  misc_feature (374)..(374): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
tcagactgtacagtcacgaccggtgctcgatttagtatagacatcaacacacaaagggggaggaactgctcagttaggacccagacggaaccatggaaagcccccagcgcagcttctcttcctcctgctactctggctcccagatgccactggagaaattgtgatgacgcagtctccagcctccctgtctgtgtcctccgtggggaaggacgcccaccctctcctgcagggccagtcagagcgttggcaggaacttagcctggtaccagcagaacctgaccagcctccagacctccttcctctagtcgtgccttccaccgacggcccctgactacctccccgctacggttcacgtgcgtagtcggtcagggacngtacgttcactctacaccgatccagcagccctgctacgtntagtaacgttnttttcgagtttaacgtttactacgttacgtaccgtaacctaagtttaaattaacgtaaacgttccgggttacccttacccgggttaggttacggttttacgggaaccggaaacggggtaacccggtaaagggtaaacgggaaaacggtaacccgtaaaaacgggtaacccgggtttacggaaccgggttcccgtaaaccggtaacccctaacgtttaccgttaccggtttactttacccgacccgttttaacccccgg

SEQ ID NO: 131958 - DNA, 879 bp, Homo sapiens
  misc_feature: GYAE6OF01DU99N.25.32.C10.1.454.CMB.1.raw
  modified_base (450)..(450): a, c, t, g, unknown or other
  misc_feature (450)..(450): n is a, c, g, or t
tcagactgtacagtcacgaccggtgctcgatttagtatagacatcaacacacaaaagggggaggaactgctcagttaggacccagacggaaccatggaagccccagcgcagcttctcttcctcctgctactctggcctccagatgccatggaagaaattgtgatgacgcagtcctccacgcctcctgtctgtgtctcggtggggaagcgccacctctcgtgccgacggcctagtcgaggtacgtcggtcggacgtaacggtaacttacgccgttacggaccacgacgaaacgtaaccgtcggaccacgccctacccgagtacctccctaccgtcttagtcggtcctcctaccgaccgacggtcccctagtactcccgtcccggcgtcgtacggcgtcggtacgtaggcggtggacgactcggtaactctacgtcttacgcttacacgtcnccgtacgtccgtacgaccgtacgtaacgtgtaacgttacgtttacggttaaaccttaaaccgtttaacgtttaacgttaccggttaaaagttaaaaaaccgtttaaacgtttaacctttaaccggtttaacccccgttaccccgttttacccccgttaacgggttttaaccccggttttaccgggggggtaaacccggggaaacccgggggtttaaaaacccggaaccgggggtttaaaacgggggttaaccggtaaaaaacccgttaaaccggggttaaaaaaccccggggtttaacccgaaccggggggttttttaccgacccggggaaaccccctttaaccggggttaaaccccctttaaaccccgggtttcccggtttttttaacggaaacccccgtttttacccgggtttttaaacccccccgg

SEQ ID NO: 131959 - DNA, 991 bp, Homo sapiens
  misc_feature: GYAE6OF01CB2IE.25.32.C10.1.454.CMB.1.raw
tcagactgtacagtcacgaccggtgctcgatttagtatagacatcaacacacaaaggggggaggaactgctcagttaggacccagacggaaccatggaagccccagcgcagcttctcttcctcctgctactctggcctcccagatcgccacgtggaagtaaattgtagatggacgcagtcctcacgccctcctgtctgtcgtctaccggtaggggaacggtcacccaccccttctaccgtggaccggacgggccctaaggtaccgagggtacgttcggttggccgtaagggtaacctttcggcccgtacggtacccagaccgaacgtaaacccgtggcccaacggtcccctacccgacgtacccttcccgtcccgttacgttacgttccgggtaccgttcccctttaacccccggaacccggtaccccggggttacccccttagggtaaccctttaacccccgggtcccccccggtacccggttaaccgggttaccggtacgggttaccgggtacggttaacccggggttcggggttaccggtttaccggggaagttaacccgggttaccgttaacccggtaaaccccttccccggtaaccctacccgtaaccggttaccgacggtacccgtaacccgtcccgttcggtaacccgttacgttacccgggtttaagttaaccgggtttaacgttttaccgggtaacctttttaaccgggtttttaaacttcccggtttaccggtaaccgtaacccgttaaaagggtttaacctttaaacccgggttaccgttaccccgggttacccccgggttttaacggggtttacccggtttaaaccgggttccggaacccgggtaaaccggggtaaaacccgttaggggggtaaaacccgtaaaacgtaacccggtaaaacggttaccgggttagggtacccggaccgtccgtaccgtaacgttaccggttcgtaccctttcggtacccttaaccccgg

SEQ ID NO: 131960 - DNA, 630 bp, Homo sapiens
  misc_feature: GYAE6OF01EDTBH.25.32.C10.1.454.CMB.1.raw
  modified_base (217)..(217): a, c, t, g, unknown or other
  misc_feature (217)..(217): n is a, c, g, or t
  modified_base (455)..(455): a, c, t, g, unknown or other
  misc_feature (455)..(455): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaaggagccaccctntcctgcagggccagtcagagcgttggcaggacttagcctggtaccagcaagaaacctggaccacgccctccagtacctcctcctctagtcggtcgtccttaccgaccgacgggtcccctaggactaccgtcccccgcgtacggttcgagtcggcgtaggtcgggtctgggactaggtacgttccacttccgtaccacctactcgagccacggtcctgaccgtagtcgtaggtaagttnttttcgacgttaagttttactactcgtactactagttaactaacttacgtcgtaccgttcggtacggttacgttcggaccgtaacgggtaccgtaagggtaggaaacgaccggtaaaacgttacgtggtccggactacgaccgtaacctagttacctcggttccttacgtacccg

SEQ ID NO: 131961 - DNA, 862 bp, Homo sapiens
  misc_feature: GYAE6OF01EA3P7.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtaggggaacgacgcccaccctctccgtgccagggccagtcaggagcgttggcaaggtaacttagccgttaggtaccagacctaacggaaacccgtcggaccctaacgccctaccccgtacgtaccttccccgtcccttacgttacgtcgggttcgtacccgtttacccgacccgaccgggtccccctaggtaaccttacccgtccccccgacgtacggttccgaggtcgggacgtacgggttcgggtcgtacggggtaacgtacggtacgtttaccgacgtttaccgaccgtaacctagtaccgacggtaccaccggtacccgttaggtacccgtacggttaccgtaacggttaacgtttacgtttttacggaaccttttaaaggttttaccgtttaccgtccgttaacccgtaaccgttaaacggtttaaacgtttaaaccgttaaccggttaccggttaccccggtttacgggttaaccgggttaacccgggtttaccgggaaacccgggtaaacgggggtaaacgtaaaccggggtaaacggtaaaaccgggtaaaccgtaaaacccgggttaggttaccgggtccgggtaccttaaccgggacccctaaaccggttaacgtttccccggtttaccggtttcccgttacccggttaaccccg

SEQ ID NO: 131962 - DNA, 714 bp, Homo sapiens
  misc_feature: GYAE6OF01CYDZC.25.32.C10.1.454.CMB.1.raw
  modified_base (209)..(209): a, c, t, g, unknown or other
  misc_feature (209)..(209): n is a, c, g, or t
  modified_base (518)..(518): a, c, t, g, unknown or other
  misc_feature (518)..(518): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggataaattgtgatgacgcagtctccagtccctcctgtcctgtgtctccgtggggaagcnccctaccctctcctgcgagggccagtcagagtcgtggcaggtaacttacgccgtaggtaccagtacgaacgtaaaccgtcggacccacggccctaccccgacgtacccttcccttacccttacgtagttcgggtcctacccgtttcccgaaccgtaccgggtccccctagtaacctaccgtcccccggtacgtaggttccaggttcggacgtagggttcggtcgtacggggactacggttacgtcaccgttctaccgaactacgtcacgtaccacggtcctaggacctaggttactaaggttaacgttntttcgtacttacgttttacgtactcgtaaccacgtaattaactaacgtacctcggttaccttacggtggttacgttcgggaaccgtaagggtaaaccgtaagggtaacggaaacgtaaccgaaacggttacggttaggtcggtaccgtacgaaccctaaccgttacgttccgttacgttcccgttcccttaacccg

SEQ ID NO: 131963 - DNA, 726 bp, Homo sapiens
  misc_feature: GYAE6OF01DRKCS.25.32.C10.1.454.CMB.1.raw
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatcgccacgtggaagtaaattgtgatgacgcagtcctccagtcctccctgtctgtcgtctcggtaggggaacgcncccaccctctcgngacggacgactacgacgacggtcgtcggtacgaacgtaacgttacgtccgtacgttaccggacgacgaacgtaaaccgtaccgcgaccgaccgtcccacgacgttccctctactagtcgtcgtcctaccgtaccgaccggtcccgtctacgtacctccccgtccgtacggtacgtcggtacggtccggagtacgggttcgggacgaacggtacgtacgttcctacgaccttccacgaacgtcacgaccgcgtaccgtcgtacgtacgttacgtacgttaaggttacgttttcgtacttacggttttaacttcgtacgtactaaccgtaagtttaataacgttacgtccggcccgttacgttaacgggacgtttacgggaaccgaacggtaaccggtaacggtaaagggaaccaaacgtaaaccggtcgtaagttcgggaacctccggaactcccgtaaacttcgttaacgtttcccgttaagtcccgtttaccccg

SEQ ID NO: 131964 - DNA, 702 bp, Homo sapiens
  misc_feature: GYAE6OF01BSH4B.25.32.C10.1.454.CMB.1.raw
  modified_base (312)..(312): a, c, t, g, unknown or other
  misc_feature (312)..(312): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggcgccaccctctcctgcgagggccagtcagagcggttggcaggaactagcctggtaccagacaacgaaaccgtggccagccctccacgacctcctcctctatggtcncttcccaccgcggcccctgactacctccccgctaggttcaggtcggcgtaggtcgggtcgtgggacgtaggtacgttcactctaccacctataccacgcgacgtccgtcgacgtagttcgtagggtaaacttgtttttacgacgttttagttttaactttaccgttacgttacccgtaacctaaggtttaacttaaacgttaaccgtccggtaccccgtttaccgggttacggggtttaacggtttaccggggaacccggtaaacggggtaacccgggtaaaggggttaccgggaaaacggtaaccgtaaaaaccgggtaccgttacgggtcgggtaccgtacgacccgtaaccgtacgttaccgtttcgttaccgttaccgttaacccg

SEQ ID NO: 131965 - DNA, 716 bp, Homo sapiens
  misc_feature: GYAE6OF01BBLWT.25.32.C10.1.454.CMB.1.raw
  modified_base (228)..(228): a, c, t, g, unknown or other
  misc_feature (228)..(228): n is a, c, g, or t
tcagactgtacagtcacgaccggtgctcgatttagtatagacatcaacacacaaaggggggaggaactgctcagttaggacccagacggaaccatggaagccccagcgcagcttctcttcctctgctactctggcctccagatcgccacgtggaataattggagagtgacgcgtagtcctccacgtccctccgtgttctggttcgtccgtacgggtggggaacggccnccctacccttcgtccgtcggacgacgggtccaggtacgaggtacgttgggtacggacgtacgggttaaccttcggccgttacggaaccacggcgtaaacggtaacccgtcggacccaccgtcccctaacccgacgtaccccttccgtacctacgttacggtccgggttccctacccgtttacccggaacccgggtccggtaccccgtagtacccgttaccccggtaccccgggttaaggtacggttaccggaacgggttccgtaccgggtaggggtcggttaccgggaggtaccgtacgtcttacccacgttcgaaccacgtcgaccgcgacacgtcgagactagtacgtaagtacttgttcgtaactttgttacttcacgactaagtataatcgtacgttcgacgtcgtacggtacgtacgaacgaggacgtagacgtaaacacggtaacgtgtcggtgctacgcctactctattactcgtctaccg

SEQ ID NO: 131966 - DNA, 845 bp, Homo sapiens
  misc_feature: GYAE6OF01AM782.25.32.C10.1.454.CMB.1.raw
  modified_base (191)..(191): a, c, t, g, unknown or other
  misc_feature (191)..(191): n is a, c, g, or t
  modified_base (453)..(453): a, c, t, g, unknown or other
  misc_feature (453)..(453): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctccagatcgccagtggataaattggcgatgacgcagtctccagcctcctgtctgtntcctcgtaggggaagacgccacccttctcctcgacacgggcctagtcgagtacgtcggttggacgaaggtaacttcgccgttcggtaaccgacgacgtaacgaaaccgtcggaccgaccgtccgtccccaacggtaccttcctccgtacgttacgtacggtccggtcctaccgtacccggaaccgggtcccctacgaaccttacctaccccccggacgtaacgggtttccgaaggttccggacggttacggtaccggggttntacgggtaaatacgggttaccgttttacacccgtttacacccgtaacccgtaacgttacgaccgtcgtacgtacccggtacgtacgtaccgttacgtaacggtaagttacgttacggttaccgtaacgtttaaaccgtttaacgtttaacgttaaccggttaaacttaaaacgttttacgaacgttaacggtaaccggtaccgggttacggttaaccgttccggggtttaaccggaccccggtaaacgggggtaaaccgtaaaccggggtttaccggaaacccgtaaaccgttaaaccggaaaacccggttaacgggttaaccgggtcgggtaacccttaccgtaacccgttaaccgtttaacgtaccggtttaccgttacccgttaaaccg

SEQ ID NO: 131967 - DNA, 865 bp, Homo sapiens
  misc_feature: GYAE6OF01BSYKA.25.32.C10.1.454.CMB.1.raw
  modified_base (157)..(157): a, c, t, g, unknown or other
  misc_feature (157)..(157): n is a, c, g, or t
  modified_base (165)..(165): a, c, t, g, unknown or other
  misc_feature (165)..(165): n is a, c, g, or t
tcagactgtacagtcacgaccggtgctcgatttagtatagacatcaacacacaaagggggagaactgctcagttaggacccagacggaaccatggaagccccagcgcagcttctcttcctcctgctactcgtggcctcccagatgcccactgggaanaaatttgnggatggacgctagtcctccagccctcctgttctgtctcgtcgtaggggaacgcgccctaccctcgtcctacggcgacggtccagtcgaggacgtcggttaggacgtaaggtaccgtacgtccgtacggtaaccacgacgaacgtaacccgtggaccgaccggtcccctaccccgtaacgtacccttcccttaccgtcttacggtcggttccgttcccgttacccgacccggtaccgggtcccccttagaaccctttcccgtaccccccggtactaacggttcctaagggtccggtacggtagggttcgggttaccgtacggggtaactaggtaccgtttcccaacgttcccaaccgtaaccgtacttacgacggtacccgtacggtacccgtacggtacgttacccggttaccggtaaggttaagtttaccgttttggttaaccgttttaacgtttaaccttccggtaacgtacccttaaacgggttaacgtttaataaaccggttaccgtaccggtacccgtttccgggtttaagggttaccccggttttaacgggaacccggggtaaaaccggtaaacccggtttaaagggtaaccgggaaaaccttaaaccggggaaaacccggttaagggttcccggtaaacggttccgaaccgttaacgaccccgttatttcccgtattcccgttacgtaccccg

SEQ ID NO: 131968 - DNA, 767 bp, Homo sapiens
  misc_feature: GYAE6OF01CICFD.25.32.C10.1.454.CMB.1.raw
  modified_base (176)..(176): a, c, t, g, unknown or other
  misc_feature (176)..(176): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccacgtggaagtaattgtgatgacgcagtccnccacgtccctcctgtctgtcgtcgtcggtaggggaacgccgccctaccctctccgtgccgacgggaccagtcgaggcggtcggtacggacgaacggtacgttacgacccggttacggaaccacgaaccgtaacggaaacccgtcggacccaccgtcccctaccccgaacgtcccctccctttccgtagttacggttcggttccgtcccgttaacccgacccgggtcccggtacccgttacgtaccgtccccgtcccccggtacggttacggttacgaggtcggacgtagggttccggtacggtacggactacggttacgtcctaccgtactccgaacctgtaccgaccggctaccggccgttacaccggttacgttacgtaacggtttaacgttcgtttacgtaccgttttaagttacctacgttacgtaacctaacgtaagttaactacgttacggtccggtacccgttacggttacggttacgtaaccgggaacccggttaaggaaccgttacgggaaagtaaccggaacgtaacggtcgtaggtccgtcaacggtactacttacgttcgttacgtccgtacgttcccg

SEQ ID NO: 131969 - DNA, 746 bp, Homo sapiens
  misc_feature: GYAE6OF01CO6CK.25.32.C10.1.454.CMB.1.raw
  modified_base (71)..(71): a, c, t, g, unknown or other
  misc_feature (71)..(71): n is a, c, g, or t
tcagactgtacagtcacgaccggtgctcgatttagtatagacatcaacacacaaagggggaggaactgctnagttaggacccagagggaaccatggaagccccagctcagcttctcttcctcctgctactctggctccagattccagcggacaaactgtgttgacacagtctccagccacctgtctttcgtccgtccggggaacacgcccacctctaccgtgcgacgggcccgcagacgttgtacgactaacgtacttacgccgtacggtaaccaagacgaacgtccgcggacgaccggtcctaccggacgtcctcctactacttacgtacgtacgtacttaccgtacgtaacgggtccgaccgtacgtaccgaccgtacctacccggaccggtacccgttcgtaccggtggtaccggtccggttaggggttaccgggtcggtaaccggtaacgttacgtttaaccgtacttaaccgacctacctacttaccgaccacggtacgtacgtacgtacgtaagtagtttacgttacgtacgtttagttactacgttacgtacgtaccgtacgtaccgtaagacggtagtacccttactaaccgttaacttaccgtttaccgttacggttaccccgtacgggtaaccgtacgttaacggtacgtaaacgtaaccgtaaaggtaaccgtaacgtgggtaactccgtacgtaccgtacctagttccgtctttacctccgtccgtttaccccg

SEQ ID NO: 131970 - DNA, 501 bp, Homo sapiens
  misc_feature: GYAE6OF02HBN1L.25.32.C10.1.454.CMB.1.raw
  modified_base (498)..(498): a, c, t, g, unknown or other
  misc_feature (498)..(498): n is a, c, g, or t
tcagactgtacagtcacgaccggtgctcgatttagtatagacatcaacacacaaaggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctcccagactcctcctctatggtgcttccaccagggcccctgactactccccgcaggttcagtggcagtgggtctgggacagagttcactctcaccatcagcagcctgcagtctgaagattttgctagtttattactgtcaccagtataataactgcctcgtgacgtttggccaagggaccaaggtgaagcgaaacgactgtagctgcaccatctgtctntac

SEQ ID NO: 131971 - DNA, 503 bp, Homo sapiens
  misc_feature: GYAE6OF02H0MLK.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctcccagactcctcctctatggtgcttccaccagggcccctgatatccccgccaggttcagtggcagtgggtctgggacagagttcactctcaccatcagcagcctgcagtctgaagattttgcagtttattactgtcaccagtataataactggcctcgtgacgtttggccaagggaccaaggtggaaagcaaacgaactgtggctgcacatctgtcttctac

SEQ ID NO: 131972 - DNA, 506 bp, Homo sapiens
  misc_feature: GYAE6OF02F4XR9.25.32.C10.1.454.CMB.1.raw
  modified_base (304)..(304): a, c, t, g, unknown or other
  misc_feature (304)..(304): n is a, c, g, or t
  modified_base (401)..(401): a, c, t, g, unknown or other
  misc_feature (401)..(401): n is a, c, g, or t
  modified_base (503)..(503): a, c, t, g, unknown or other
  misc_feature (503)..(503): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctcccagacctcctcctctatggtncttccaccagggcccctgactactccccgcaggttcagtggcagtgggtctgggacagagttcactctcaccatcagcagcctgcagtctgaacgtnttttgctagtttattactgtcactagtataatactgcctcggtgtacgttggccaagggaccaaggtgaaagcgaaacgactggtagctgcacatctgtctntac

SEQ ID NO: 131973 - DNA, 527 bp, Homo sapiens
  misc_feature: GYAE6OF02IF962.25.32.C10.1.454.CMB.1.raw
  modified_base (206)..(206): a, c, t, g, unknown or other
  misc_feature (206)..(206): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggngccaccctctcctgcagggccagtcagagcgttggcaggaacttagcctggtaccagcagaaacctggccagcctcccagactcctcctctatggtgcttccaccagggcccctgatactcccccgccaggttcagtggcaggtggtctgggacagagttcactctcaccatcagcagcctgcagtctagaagtattttgacttagtttattactgtcaccatataataactggaccttccgtagtacgtttggccgtaaagggaccaaggtggaaagacgaaacgaacgtggtagctgactaccattctgtccttatacg

SEQ ID NO: 131974 - DNA, 582 bp, Homo sapiens
  misc_feature: GYAE6OF02IASAA.25.32.C10.1.454.CMB.1.raw
  modified_base (234)..(234): a, c, t, g, unknown or other
  misc_feature (234)..(234): n is a, c, g, or t
  modified_base (406)..(406): a, c, t, g, unknown or other
  misc_feature (406)..(406): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagngcgttggcaggacttagcctggtaccagcagaacctggccagcctcccagacctccctcctctatggtgccttccaccgacgggcccctgactactccccgcaggttcagtggcaggtgggtctgggacagtgttcactctcaccatcagcacgcctgcagtctagaacgtnttttgcttagtttattactcgtacactagttataaacttaacgtcggcccttccggttacggtacgttttcgggaccgtaaagggacccgtaagggtacgggaaacgtaccgaaaacggtaacgttaggtacggtacgtacggacctaccgtaattccgttagttccttactaccg

SEQ ID NO: 131975 - DNA, 513 bp, Homo sapiens
  misc_feature: GYAE6OF02F907Q.25.32.C10.1.454.CMB.1.raw
  modified_base (405)..(405): a, c, t, g, unknown or other
  misc_feature (405)..(405): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaacctggccagcctcccagactcctcctctatggtgccttccaccagggccccctgactactcccccgcctacggttcagtggcaggtggtctgggacagagttcactctcaccatcagcacgccttcagtctgaagtnttttgctagtttattactgtacacctagtataatactgcctcgtggtacgtttggccaaggacaggtgaagcaacggacgtgtcggctgcacatctgtcttcattccg

SEQ ID NO: 131976 - DNA, 502 bp, Homo sapiens
  misc_feature: GYAE6OF02HRLX4.25.32.C10.1.454.CMB.1.raw
  modified_base (499)..(499): a, c, t, g, unknown or other
  misc_feature (499)..(499): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctccagacctcctcctctatggtgcttccaccagggcccctgatactccccgccaggttcagtggcagtgggtctgggacaggattcactctcaccatcagcagcctgcagtctgaagtattttgctagtttattacttgtcaccagtataataactgcctcgtgtacgtttggcaaggacaggtagaagacgaacgactgtggctgacacatctgtctntac

SEQ ID NO: 131977 - DNA, 539 bp, Homo sapiens
  misc_feature: GYAE6OF02HTLZ0.25.32.C10.1.454.CMB.1.raw
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccaccctctcctgcagggccagtcagagcgttggcaggaacttagcctggtaccagcagaaacctggccagcctcccagacctcctcctctatggtgccttccaccngggcccctgatactccccgcaggttcagtcgcagtgggtctgggacagngttcactctcaccatcagcagcctgcagtctagagtatttgcttagtttatactgtcactagtataatacgtggtccttcgtaggtacgtttcggacaacgggacctaagggtaggaaacgacgaaacggtaactggtacgtacgtgacctaccgattcctagttccttagtacccg

SEQ ID NO: 131978 - DNA, 649 bp, Homo sapiens
  misc_feature: GYAE6OF02H693U.25.32.C10.1.454.CMB.1.raw
  modified_base (206)..(206): a, c, t, g, unknown or other
  misc_feature (206)..(206): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatgccactggaagaaattgtgatgacgcagtctccagcctcctgtctgtgtctcgtggggaagngccaccctctcctgcgagggccagtcagagtcgttggcaggtaacttgccgtggtaccagcaacgaacctggccacgccctccagacctccctctctagtggtcgtcctaccaccgccggtccctgactacccgccccgtacgtacggttacgacgtcggacgtggtcggtcgaggacagtcgtcactctaccactactcgacgctaccgtctacgactagttctaaggttaacttgttttcgacgtttaagtttttactacgttcgtactaacgtaagttaattaaaccgtaccgttcgtacccgttggtacggttacggttaccggaaccggaacgggtaacgtagggtaacgaaccgtaaccggaaacggttacggttagggtacgtaccctacggaccctaacgtagtttcccggttacgtttaccctaccttacccgg

SEQ ID NO: 131979 - DNA, 604 bp, Homo sapiens
  misc_feature: GYAE6OF02HF3TY.25.32.C10.1.454.CMB.1.raw
  modified_base (207)..(207): a, c, t, g, unknown or other
  misc_feature (207)..(207): n is a, c, g, or t
  modified_base (392)..(392): a, c, t, g, unknown or other
  misc_feature (392)..(392): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgaagcagtctccagcctccctgtctgtgtctccgtggggaaggngcccaccctctcctgcagggccagtcagagcgttggcaggaacttagcctggtaccagcagaaacctggccagcctcccagacctccctcctctagtggtcgtcttccaccgacgggcccctgactactcccccgcgtacgttcagtggctaggtcggtctgggacagtagttcactcgtcaccntcagcacgtcctgctagttctaggtaattattttggacttaagttttactactcgttaccactaaggttaactaacttaacgtcggtacccttcggtggtaccgtttggaccgtaaaggggtacctaagggtacggaaagtaccgtaaaacggtaccgttagggtacgaccgtagaccgtaacccgtagttcgttacgttaccttctaaccg

SEQ ID NO: 131980 - DNA, 540 bp, Homo sapiens
  misc_feature: GYAE6OF02IVKVF.25.32.C10.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggngccaccctntcctgcagggccagtcagagcgttgcaggacttagcctggtaccagcagaaacctggccagcctccagactcctcctctatggtgccttccaccacgggcccctgactactccccgcaggttcagtggcaggtggtctgggacagagttcactctcacntacagcagcctgctagtctgaacgtntttgctagtttattacgtgtacactagtataatactggccttcgtggtacgtttcggaccgaaacgggacctaagggtagaaacgtacgaaaacgtacgtggtacggctagacctacctattccgtagttcctataccg

SEQ ID NO: 131981 - DNA, 546 bp, Homo sapiens
  misc_feature: GYAE6OF02JQ3CL.25.32.C10.1.454.CMB.1.raw
  modified_base (269)..(269): a, c, t, g, unknown or other
  misc_feature (269)..(269): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (534)..(534): a, c, t, g, unknown or other
  misc_feature (534)..(534): n is a, c, g, or t
  modified_base (543)..(543): a, c, t, g, unknown or other
  misc_feature (543)..(543): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactgggagaaattgtgatgacgcagtctccagcctccctgtctgtgtctcctggggaggagccacccctctcctgcaggggccagtcagagcgtttggcagggaacttagcctggtaccagcngaaacctggccagcctcccagactcctcctctatggtgcttccaccagggccccctgatactcccccgccaggttcagtgggcagtggggtctgggacngagttcactctcaccatcagcagcctgccngtctgagattttgctagtttattactgttcaccagttaattaaataaccttgggcccttccggtggtaccgggtttggacctaaggggacccaagggttgggaaaggccgtaaaacggaacgtagtggctgcaccntctgtcttntac

SEQ ID NO: 131982 - DNA, 550 bp, Homo sapiens
  misc_feature: GYAE6OF02GJEFR.25.32.C10.1.454.CMB.1.raw
  modified_base (325)..(325): a, c, t, g, unknown or other
  misc_feature (325)..(325): n is a, c, g, or t
  modified_base (545)..(545): a, c, t, g, unknown or other
  misc_feature (545)..(545): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaaggagccacctctcctgcagggccagtcagagcgtggcaggacttagcctggtaccagcagaacctggccagcctccagacctcctcctctatggtgcttccaccacgggcccctgactacnccccgcaggttcaggtcggacaggtcggtctagggacaggtacgttcacctctcaccatcagcacgcctgcagtctagtaagtatttgactagtttattactgtctacctagtataactacgtgtccgtcgtaggtacgtttcggaccgaaagggccgaaggtaggaacgacgaaacgtacgtacggtacggtactggtacacgtactcgtacgttcttntaccg

SEQ ID NO: 131983 - DNA, 548 bp, Homo sapiens
  misc_feature: GYAE6OF02H2UUD.25.32.C10.1.454.CMB.1.raw
  modified_base (206)..(206): a, c, t, g, unknown or other
  misc_feature (206)..(206): n is a, c, g, or t
  modified_base (415)..(415): a, c, t, g, unknown or other
  misc_feature (415)..(415): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagngccaccctctcctgcagggccagtcagagcgttggcaggacttagcctggtaccagcagaacctggccagcctccagacctccctcctctatggtgtccttccaccgacgggcccctgactactccccgctaggttcagtcggcgtaggtgggtcgtgggacaggtacgttcacttctcacctatcagcacgcctgctagtctagaatnttttgcttagtttattctgtcactagttataaataacgtggtccttcggtggtacgtttcggaccaacgggaccaagggtagaacgacgaaacggtaactggtacgctagaccactattcgtagttcctctac

SEQ ID NO: 131984 - DNA, 653 bp, Homo sapiens
  misc_feature: GYAE6OF02HWNET.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaatttgtgatgacgcagtctccagcctccctgtctgtgtctccgtggggaaggaggccaccctctcctgcgagggccagtcagagcgttggcaggacttagcctggtaccagcagaacctggccagcctccagacctccctcctctagtggtcgcctttaccgaccgacgggcccctgacttaccgtcccccgacgtacggttccaggtcggacaagggttcgggtacgtggggacctaggtacgtttccaacttccgtaccaccattccgagcacgccctagactagtcgtagtaagttattttgacttagttttattacttcgtacactagtaacttaataacgttcggtaccgttaccggttacggttaccgtttacgggaccgtaaacggggtaaccgtaagggtacgggaaacgtacgaaaacggtaaccgtagggtacggtacgtacggaccgtaaccgtacgttaccgtttacggttaccttacgttaaccg

SEQ ID NO: 131985 - DNA, 519 bp, Homo sapiens
  misc_feature: GYAE6OF02F7N6N.25.32.C10.1.454.CMB.1.raw
  modified_base (304)..(304): a, c, t, g, unknown or other
  misc_feature (304)..(304): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctcccagacctcctcctctatggtncttccaccacgggcccctgactactcccccgcaggttcagtggcagtggtctggacagtagtcactctcaccatcagcagcctgcagtctagaagtattttgcttagtttattactgtcactagtataatactgtcctcgtggtacgtttgaccgaagggacaaggtgaagacgaaacggaactggtaggctggaccacgatcgtattcctctac

SEQ ID NO: 131986 - DNA, 556 bp, Homo sapiens
  misc_feature: GYAE6OF02GGNKB.25.32.C10.1.454.CMB.1.raw
  modified_base (405)..(405): a, c, t, g, unknown or other
  misc_feature (405)..(405): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcctggggaagacgccaccctctcctgcagggccagtcagagcgttggcagggaacttagcctggtaccagcagaaacctggccagcctccagactcctcctctatggtgccttccaccgacgggcccctgactactccccgcacggttcagtcggcaggtggtctgggacagagttcactctcaccatcagcacgcctgcagtctagaagtnttttgcttagtttatactgtcactagtataataactggccttcggtggtacgtttcggaccgaacgggaccaagggtacgaaagccgaaacggtaacttcggtacggtaccgttagaccctaacctagttccgtacgttaccttctaaccg

SEQ ID NO: 131987 - DNA, 592 bp, Homo sapiens
  misc_feature: GYAE6OF02IY1X2.25.32.C10.1.454.CMB.1.raw
  modified_base (206)..(206): a, c, t, g, unknown or other
  misc_feature (206)..(206): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagngccacctctcctgcagggccagtcagagcgttggcaggaacttagcctggtaccagcaagaaacctggaccagcctaccagacctccctcctctagtggtcgcttccaccgacgggcccctagactactccccgcgtagtcagtgcaggtggtctggactagtagtcactctacacctatcacgctagtccttcacgtctagaagtattttacgacttaagtttattactgttacaacctataataactacgtgtaccttcgtaggtacgtttcggaccgaacgggtaaccgaagggtacggtaacgacgtaaacggtaacgttaggtacgggtcttacggacctaaccgtacttaccgtacggttacttacgtaccgtttacccg

SEQ ID NO: 131988 - DNA, 580 bp, Homo sapiens
  misc_feature: GYAE6OF02HQHYD.25.32.C10.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (561)..(561): a, c, t, g, unknown or other
  misc_feature (561)..(561): n is a, c, g, or t
tcagactgtacagtcacgaccggtgctcgatttagtatagacatcaacacacaaagggggaggaactgctcagttagggacccagacggaaccatggaagcccagcgcagcttctcttcctcctgctactctggctcccagatgccactggagaaattgtgatgacgcagtctcagcctcctgtctgtgtctccgtggggaagngccaccctctcctgccgagggccagtcagngcgttggcaggaacttgcctggtaccaggacagaaaccgnggccagtccctaccagcctcctcctnttacgtggactccttaccaacgccggccctgaacttcncccccgacnggttccaggtcggctaggtgggttcgagggatagtacgttacactctacacctatcagctacgccttaggcagtctagaagtcttttgactagtttatactcgtactacgtagttaataactaatcggtacctcggttgtaacgtttcggacgttaagggaccgtaagggagtaacgacgaaaacgtacgtagtccggatacggacctaacgtntcgtacgtccttactaccg

SEQ ID NO: 131989 - DNA, 574 bp, Homo sapiens
  misc_feature: GYAE6OF02F3ARC.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggacttagcctggtaccagcagaaacctggccagcctcccagactcctcctctatggtgccttccaccagggcccctgatactccccgcaggttcagtggcaggtggtctgggacagagttcactctcaccatcagcagcctgcagtctagaagtattttgcttagtttattactgtacacctagtaataataacgtggcccttcggtggtacgtttcggacctaaaggggacccaaagggtacggaaaaggaccgtaaaaacggaacgttacggtagggaccgttaggaccgtaacccgtaattccgttacggttacccttcgtaacccg

SEQ ID NO: 131990 - DNA, 533 bp, Homo sapiens
  misc_feature: GYAE6OF02GGRZ0.25.32.C10.1.454.CMB.1.raw
  modified_base (528)..(528): a, c, t, g, unknown or other
  misc_feature (528)..(528): n is a, c, g, or t
tcagactgtacagtcacgaccggtgctcgatttagtatagacatcaacacacaaagggggaggaactgctcagttagggacccagacggaaccatggaagccccagcgcagcttctcttcctcctgctactctggctcccagatgccactggagaaattgtgatgacgcagtctccagcctccctgtctgtgtctccgtggggaagagccaccctctcctgcagggccagtcagagcgttggcaggaacttagcctggtaccagcagaacctggccagccctcccagacctccctcctctagtcggtcgccttccaccgacgggcccctgactacgtcccccgcaggttcaggtggctaggtgggtctgggatagagttcactctcaccatcagcacgcctgctagtctagaagtatttgcttagtttattactgtcactagtataatactcgcctcgtgtacgttcgacgaaggacgaggtacgaacgacgaaacgtactggtcgactagacacgtatctcgtactntaccg

SEQ ID NO: 131991 - DNA, 596 bp, Homo sapiens
  misc_feature: GYAE6OF02HCOCN.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaaggagccaccctctcctgcagggccagtcagagcgttggcaggaacttagcctggtaccagcagaaacctggccagccctcccagacctccctcctctatggtcgccttccaccgacgggcccctgactactccccgccaggttcaggtcggcaggtgggtctgggacagtagttcactctacaccatccagcacgcctgctagtctagaagtattttgacttaagttttacttactgtaccacctaagttaataaattaactcggtacccttccggttagggtacgtttcggacccgtaaagggtacccgtaagggtacggaaacgaccgtaaacggtaaccgtggtacggtacgtacgaccgtacctagttccgtagttacttacctacg

SEQ ID NO: 131992 - DNA, 718 bp, Homo sapiens
  misc_feature: GYAE6OF02GSIZ0.25.32.C10.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (284)..(284): a, c, t, g, unknown or other
  misc_feature (284)..(284): n is a, c, g, or t
tcagactgtacagtcacgaccggtgctcgatttagtatagacatcaacacacaaagggggagaactgctcagttaggacccagacggaaccatggaagccccagcgcagcttctcttcctcctgctactctggctccagatgccactggataaattgtgatgacgcagtctccagcctcctgtctgtgtctcgtgggaagcnccacctctcngcgaggccagtcagngcgttggcagtacttagcctgtacngcaagaacctgcancctccagacctactcctntagtcggtagccttaccgaccgtacgggtccctaggtaacttacccgtcccccgacgttaaggttccgaacggtggaccgttaagggttcggggttacgtagggaacctaggttaaccgtttccaaccgttcaaccgaaccctatccgacgaccgtaccgtcctacggtactacgttacctaaggaacgtttatttacgacgtttaagttttacttaccgttatacctaaactaagttaaacttaacgtaaccgttcggtacccgtttaccgggttacggttaaccgttttgggaaacccgtaaacggggtaccgtaaaggggtaacggaaaacggtacccggtaaaacggttaacgttcgggttaaccggtaacgttaccggtaaccttaccggtaacttccggtttacgtttacccgttaccgttaaccccg

SEQ ID NO: 131993 - DNA, 562 bp, Homo sapiens
  misc_feature: GYAE6OF02GHCGG.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctgggggaaggagccaccctctcctgcgagggccagtcagagcgttggcaggaacttagcctggtaccaacagaaacctggccagcctcccagacctcctcctctatggtgccttccgaccacgggcccctgactactcccccgcacggttcagtggcaggtgggtcgtgggacagagttcactctccaccatcagcagcctgcagtctagtagtattttgactagtttatactgtccactagtattaataacgtcggtaccctcggtggtacggtttcggacctaaacggggaaccaagggtaggaacgacgaaaccggaacgttacgtggactcgacctacgtactcgttgttcttcacttcccg

SEQ ID NO: 131994 - DNA, 788 bp, Homo sapiens
  misc_feature: GYAE6OF02HQ4Y8.25.32.C10.1.454.CMB.1.raw
  modified_base (98)..(98): a, c, t, g, unknown or other
  misc_feature (98)..(98): n is a, c, g, or t
  modified_base (152)..(152): a, c, t, g, unknown or other
  misc_feature (152)..(152): n is a, c, g, or t
  modified_base (158)..(158): a, c, t, g, unknown or other
  misc_feature (158)..(158): n is a, c, g, or t
  modified_base (166)..(166): a, c, t, g, unknown or other
  misc_feature (166)..(166): n is a, c, g, or t
tcagactgtacagtcacgaccggtgctcgatttagtatagacatcaacacacaaagggggaggaactgctcagttaggacccagacggaccatggaanccccagcgcagcttctcttcctcctgctactctggctcccagatgccactgganaattgngatgacgnagtctcagcctcctgctgtctctaccggtgggaacgacgccctacctctaccgtggcgacgggtcctagtccaaggtcggtcggttcggacctaagggtaaccgttacgccgttaggtaacccgagtacgaaacggtaacctcggacccgtacgtcccgtacctaaggtaccttccccgttacgtacgttacgtacggtacctaccgtttacccgtaaccgtaccgggtcccctaggtaaccgtttaccgtccccggtacgtaacggtttccacggttcggaccgtacgggttcggtacgtacggaactaacggttaccgttccgaacgttccgtaaccgtaccgtacgtcgtaacggtaccgtacgtcccggttaacgccgttaacggttaccggtacgtaaagtttccgtttacggtacgttaacgttttacctacgttacgtaccgtaaccgttagtaaaccgttacgttacgtaccggtaccgttaccggttaacggttaccgttacggaaccgtaacgggttaccgtaggtaaccggtaacgtaacgtacggtaaccgtttcggaaccggttacgtaccgtaacgtacctcgtacggttccttaccgtagttacccg

SEQ ID NO: 131995 - DNA, 677 bp, Homo sapiens
  misc_feature: GYAE6OF02I4Z3D.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactgtagaaattgtgatgacgcagtctccagcctccctgtctgtgtctccgtggggagagccaccctctcctgcagggccagtcagagcgttggcaggacttagcctggtaccagcagaacctggaccagccctcccagacctcctcctctagtggtgccttccaccgtacggggcccctagactacctcccccgccgtacggttcacggtcggccgtaggttcggggtcgtggggactaggtacgttccaccgttctaccacctactccgacggccacgtcccgtagcgtacggttcgtaggtaagttagttttcgacgtttagttttactttacgttgttaccctaccgtaagtttaactaaacgttaaccgttcggtacccgttaccggttcgggttaaccggttttacgggacccgtaaacgggtacccgtaaagggtacgggaaacgtaaccgtaaaacggtacgttacggtacggtacttaccggacctaccgtacgttacccgttcgttacctttaccgtaccg

SEQ ID NO: 131996 - DNA, 665 bp, Homo sapiens
  misc_feature: GYAE6OF02FHELK.25.32.C10.1.454.CMB.1.raw
  modified_base (306)..(306): a, c, t, g, unknown or other
  misc_feature (306)..(306): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagagccaccctctcctgcagggccagtcagagcgttggcaggacttagcctggtaccagcagaaacctggccacgccctcccagacctccctcctctatggtntccttccaccgcgggcccctgactaccgtcccccgcgtacggttcgaggtcggcgtggtcgggtcgtagggacgtacgtacgttcaccgttcctaccaacctactaccgacgcgacgtccgtacggacgtacgttcgtaagtaacgtttacgttttacgtacgtttaagtttactttacgttcgtacctaacgtaagttaactaaacttacgtccggtacccgttacgggttacggttaccggtttcggaaacccggtaacgggtaaccgtaagggtaacggaaaccgtaacgtaaacggtacgtacggtacggtcgtacgaccgtaaccgtcgttacgtcgtttccttacgttacccg

SEQ ID NO: 131997 - DNA, 718 bp, Homo sapiens
  misc_feature: GYAE6OF02HRC5L.25.32.C10.1.454.CMB.1.raw
  modified_base (234)..(234): a, c, t, g, unknown or other
  misc_feature (234)..(234): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaggacgccaccctctcctgcagggccagtcagngcgttggcaggactagcctggtaccagcagaacctggccacgcctcccagacctccctcctctagtcggtcgccttccgacccgagggccccctagactaccgtcccccgccgtaggttcaggtcgggctaggtcgggtccgtggggacaggtagttcctaccttccgtaccaacctattaccgacggtccacggtccccttaggacctaggttcctagggttaaacgttacgtttttcgacctttaagtttttacgttacctttcggtacctaaaccgtagttaaacgttaaacgttaaaccggttccggtaccccgtttaccgggttacgggtttaacccggttttacggggaacccggtaaacgggggtaacccgtaaaggggtacgggaaaaccgtaaccggaaaacggtaaccggttagggtacgggttaccgtacggaccgtaaccgactttaccgttacgtttccttaccgtaaccg

SEQ ID NO: 131998 - DNA, 527 bp, Homo sapiens
  misc_feature: GYAE6OF02F491T.25.32.C10.1.454.CMB.1.raw
  modified_base (411)..(411): a, c, t, g, unknown or other
  misc_feature (411)..(411): n is a, c, g, or t
  modified_base (523)..(523): a, c, t, g, unknown or other
  misc_feature (523)..(523): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccacctctcctgcagggccagtcagagcgttggcaggacttagcctggtaccagcagaaacctggccagcctcccagactcctcctctatggtgccttccaccacgggccccctgactacgtcccccgcctacggttcagtcggctaggtgggtctgggacagacgttcactctcgaccatcagcagcctgcagtctagaagtntttgcttagtttacttactgtctaccagtataatacgtcgtccttcggtgtacgtttgaccgaaggacaggtagaagcgaaagtacgtgtacgctagccactatctgtactntacg

SEQ ID NO: 131999 - DNA, 549 bp, Homo sapiens
  misc_feature: GYAE6OF02FL06A.25.32.C10.1.454.CMB.1.raw
  modified_base (305)..(305): a, c, t, g, unknown or other
  misc_feature (305)..(305): n is a, c, g, or t
  modified_base (413)..(413): a, c, t, g, unknown or other
  misc_feature (413)..(413): n is a, c, g, or t
  modified_base (518)..(518): a, c, t, g, unknown or other
  misc_feature (518)..(518): n is a, c, g, or t
  modified_base (544)..(544): a, c, t, g, unknown or other
  misc_feature (544)..(544): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggagccaccctctcctgcagggccagtcagagcgttggcaggaacttagcctggtaccagcagaaacctggccagcctcccagacctcctcctctatggtcnccttccaccgacgggcccctgactactcccccgcctaggttcaggtggcaggtgggtctgggacaggagttcactcacaccatcagcagcctgctagtctaggaagtntttgcttagtttattactgtccactagtactaataacgtgccttcggtgtacgtttcggacgtaacgggaccagggtagaagtacgaaacgtacgtggtacggtntacggacacgtactctacgttccttntaccg

SEQ ID NO: 132000 - DNA, 670 bp, Homo sapiens
  misc_feature: GYAE6OF02H0Q6V.25.32.C10.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
tcagactgtacagtcacgaccggtgctcgatttagtatagacatcaacacacaaagggggagaactgctcagttaggacccagacggaaccatggaagccccagcgcagcttctcttcctcctgctactctggctcccagatgccactggagaaattgtgatgacgcagtcctccagccctcctgtctgtgtctccgnggggaagcnccacctctctgcaggccagtcagngtcgtggcaggtactcgcctggtaccagcaagaacctcggaccacgccctaccgagtacctccctcctctagtggtacgtccttaccgaccggtccggcccctgacttccncccccgcgtaggttcaggtcggctaggtcgggtccngggacaggttactcacgtctacacctagtccagcctacgcctggacgtacgttcgtaggtaaacgtttcgtttttacggactttaaacggttttacttaccgtcggttacctaaacgttaagttaacttaaacgttaaccggtcggttacccgttaccggtttaagggttaccggtttaacgggacccgtaaaggggtaccgtaagggtaacggtaaacgtaaccgaaacgtacggttcggttaccggcgtaccggactaaccgtcgttacgttaccgttcgttactacccg

SEQ ID NO: 132001 - DNA, 834 bp, Homo sapiens
  misc_feature: GYAE6OF02G9VN9.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctccagatgccactggagaaattgtgatgacgcagtctccagcctccctgtctgtgtctcggtagggagacgccctacctcctctcgcggacggacctacgtcgagcgttcggttacggagtaacggtaacgttacgccggttacggtaccgacgaccgaaaccgtaaccggtcggacccgaaccggtccccctacccgaacgttaccccttcccgttacccgttacgtttaggtccgggttccgttacccttaccccggaacccggtacccggtacccgtacgtaaccgttacccccgtcccccggtaccggttacggttaccgtagggttccggaccggttaggggttccgggtacgggtacgggtaaccgaacgggtttaccgtacccgtaccgtttccctaacccgaccgttaacgtaccgaacgtccgtaaccccgtccgtcgacggtaccggtagttaacggttaaatttcgtttccgaaacggtttttaagttttacttaccggtactaacctagttaaaacgttaacttaacgttaccggttcccggttaccctttacggggttaccgtttaccggggttaccggaacggtaacgggtaaccggtaaggttacgggaaactaaccggtaaagttacggtaggtccgtacgtaccgaccgttacaccgtttcggtaccttacgttacctccgg

SEQ ID NO: 132002 - DNA, 549 bp, Homo sapiens
  misc_feature: GYAE6OF02G3TQP.25.32.C10.1.454.CMB.1.raw
  modified_base (213)..(213): a, c, t, g, unknown or other
  misc_feature (213)..(213): n is a, c, g, or t
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccacctntcctgcagggccagtcagagcgttggcaggacttagcctggtaccagcagaacctggccagcctccagactccctctctatggtgcttccaccngggcccctgatactccccgcaggtcagtgcngtggtctgggacagngttcactctcaccatcagcagcctgcagtctgaatnttttnactagtttatctgtacactagtataattacgtgcctccgtaggtaccgtttggaccgtaaagggcctaagggtacggaaaggtccgaaaacggtaaccgtgttacgggaccttaggacccgtacggtacttaccgttcgttaccttcgtaacccg

SEQ ID NO: 132003 - DNA, 707 bp, Homo sapiens
  misc_feature: GYAE6OF02JIFAE.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgcctactctggctcccagatgccactggagaaattgtgatgacgcagtctccagcctccctgtcctgtgtctccgtgggggaacgcgccctacccgtctccctggcctagtcgggccctaaggtcaagtacgcggtttcggactaggtaacttaggcctggtaccagcaacgaacctcggccacgccgtcccaaggacctcctccgtctacgtcggtcgcctttccgaccgaggggtcccctggactaaccgtccccgcgtacggtttcacgggtcgacgtacgggtgggttccgcggggtaacctaaggcgttttaccaaccgttctccgaaccgtataccgtagccgacgtcctcggcctaggttacctaggtacgttagtttccgggaacttaacggttttaacttaccgtagttacccaacgtttagtaacgtttaacttaacccggtcgttacccggttcggttacgttaaccggtttcggaaccgttaaccgggaacctacgggtaaggaaccgaaacgtaaccgtaaggtcgttacgtcgaacggtacccgaactaggtttcctacggttacttcg

SEQ ID NO: 132004 - DNA, 701 bp, Homo sapiens
  misc_feature: GYAE6OF02F3D4A.25.32.C10.1.454.CMB.1.raw
tcagactgtacagtcacgaccggtgctcgatttagtatagacatcaacacacaaaggggggaggaactgctcagttaggacccagacggaaccatggaagccccagcgcagcttctcttcctcctgctactctggctcccagatgccactggaagaaattgtgatgacgcagtctccagcctcctgtctgtgtctccgtggggaagacgccaccctctcctgaccgagggccagtcagagtcgttggcaggtacttagcctggtaccagacaacgaacctcggccacgccctacccacgtacctccctaccgttctagtcggtctccttaccgaccgtacgggcccctagtactaccgtcccccgtcgtacggttcaggtcggcgtagggttcggtacgtagggacgtagtacgtttccaacttccgtaccaccctagtccgacgacgacggtcccgttagaccgtacgtactagggtaaacggttgttttacgtacgtttaaagttttctttaacgttcgtaacttaaccctaaggttaaacttaaccgtaacgttccggtcccgttaccgggttacggttaccgtttaccggaaccggtaacgggtacgtaaacgggtacggaaacggtaaccgtaaaacggtacgtacgggtagtaccgtagacctacgtacgttccgttcgttacctccgttacccg

SEQ ID NO: 132005 - DNA, 620 bp, Homo sapiens
  misc_feature: GYAE6OF02FTCEJ.25.32.C10.1.454.CMB.1.raw
  modified_base (392)..(392): a, c, t, g, unknown or other
  misc_feature (392)..(392): n is a, c, g, or t
tcagactgtacagtcacgaccggtgctcgatttagtatagacatcaacacacaaaggggggaggaactgctcagttaggacccagacggaaccatggaagccccagcgcagcttctcttcctcctgctactctggctcccagatgccactggagaaattgtgatgacgcagtctccagcctccctgtctgtgtctccgtggggaagagcccaccctctcctgcagggccagtcagagcgttggcagggaacttagcctggtaccagcagacacctggccagccctcccagacctcctcctctagtcggtgcttccacgacgggcccctgactactcccgctaggttcagtcggcaggtcgggtctggggacagtacgttcacgtctccactntcacgcagcctgcacgtctaggaattatttcgcttagtttacttacgtacgtcaactagttaactaactaacgttcggtaccgttacgttacggtaccgtttcggaccgtaaacggggtaccgaaagggttacgggaaaacggtaaccgtaaaacgggtaaccgtcgggttacgggtaccgttacggaccgtaaccgttacgttaccggtacgtttaccgtttaaccc

SEQ ID NO: 132006 - DNA, 670 bp, Homo sapiens
  misc_feature: GYAE6OF02FWJJR.25.32.C10.1.454.CMB.1.raw
  modified_base (401)..(401): a, c, t, g, unknown or other
  misc_feature (401)..(401): n is a, c, g, or t
tcagactgtacagtcacgaccggtgctcgatttagtatagacatcaacacacaaaggggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaaggagcccacccgtctcctggcagggccagtcagagcgttggcaggaacttagcctggtaccagcacgaaaccgtcggcccagccctcccagacctccctcctctagtcggtgcctccgaccgaccggccctggactaccgtccccgcctagtctacggtggcaggtcggtcgtgggacagacgttcactcctacncctatcgagtcacgtccgtcgctagtccgtagtaacgtttacgttttcgtacgttagttttaacctttacggttaccgttacctaaccggtaagttaacttaaacgtacgttccgggtaccgttcccgggttaggttacccggtttacgggaacccggttaaagggtaacccgtaaggggttacggtaaaacggaccgtaaaacgggtacgttacgggtacgggtacctacggaccctacgttagttccgtgtttaccgtcttacccgg

SEQ ID NO: 132007 - DNA, 843 bp, Homo sapiens
  misc_feature: GYAE6OF02GRJ0W.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggcctcccagatcgccacgtggaagtaaattggtagatggaccgctaggtcctccacgccctccctgtctgtcgttcctccggtagggggaacggacgtcccctacccgttcctccgtagccggacgggccctagtaccgaaggtacggtcggttagggaccaagggtaaccttacggccgttacggtaaccgacgtaaccgaaaccgtaaacccggtccggacccaccgcccccgttacccaacggtacccttcccgttaccccttcgttaacggtccgggttccgtaccccttaccccgaacccgggtacccgggtcccctagtaaccgttacccgtccccccggtacgttacggttccgaacggtcggtaccgtagggttcgggtcggtacgggaacgttcgtaaccggtctaccgtcctaccgtaacctagtccgaacgtccacgtccgtcggtacgtcgttacgtaagggaacgtttacgtttcgaaccgtttaagttttacgttacgttcggtaaccttacgtaacttaagtaaaccgttaccgtaccgggtaccctttcgggtaacgttaccgggttaccggaacggtaaaccgggtaacgtaacggggtaacgaacggtaacccgtaaacgggtacttcggggtaccgtaactaccgggtaccctaacgtcggttacctttaccgttacttaccctaacccgg

SEQ ID NO: 132008 - DNA, 678 bp, Homo sapiens
  misc_feature: GYAE6OF02FUR7J.25.32.C10.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcgtggggaagngccaccctctcctgcagggccagtcagagcgttggcaggacttagcctggtaccagcagaaacctggccagccctcccagacctccctcctctatggtcncttcccaccgacgggcccctagactaccgtccccgccaggttcaggtggccgaggttcggtcgtcgggaactaggtacgtttccacttccctacgacctactcgtacgaccgacgtccctggcctagttccgtaaggtaacgttagtttttcggacgtttaagtttttactttacgttcgttacctaaccgttagtttaaacttaaacgttaaaccgtcggttaccccgttaccggttacgggttaaccgttttaccgggacccgtaaaggggacccgttaaagggtacggaaacggacgtaaaacggaccgtttagggtaccggtaccgttagacccgtaaccgtacttccgttacgttcctttacctaccg

SEQ ID NO: 132009 - DNA, 601 bp, Homo sapiens
  misc_feature: GYAE6OF02IWIX0.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtcctcctggggaagagccacctctcctgcagggccagtcagacgcgttggcaggaacttagcctggtaccagccaacgaaacctggcccagccctccagacctcctcctctagtggtcgcttccaccgcgggcccctgactactccccgctaggttccaggtcggctaggtggtctgggacaggtacgttcacgtctacgacctatcagccacgcctgctacgtcgtagaagtattttcgacttagtttacttacgttgtactacctagttaactaacgtaaccgtgtacccttacggttggttaaccggtttcggaccggtaaaacgggtaccgaaggggtacgtaaacgaccgaaacggtaacgtcgggtaggaccgtcgacacctacgttcctacggttctaccgtac

SEQ ID NO: 132010 - DNA, 691 bp, Homo sapiens
  misc_feature: GYAE6OF02HBO3M.25.32.C10.1.454.CMB.1.raw
  modified_base (210)..(210): a, c, t, g, unknown or other
  misc_feature (210)..(210): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagccctccctgtctgtgtctccgtggggaaggacnccaccctctcctgcagggccagtcagagcgttggacaggtaactagcctggtaccagcaacgaacctggccagccctccagacctccctccgtccttagtcggtacgtcccttaccgacccgtaccggggtccccctaggtaacttacccgtcccccgaccgtacggttcgacgtcgggcctaggttcggggtntcggganaggtcttacactctcacctanctacgctacgactgacgtagtcgtacgtaagttactttgacgttaagttttactactcgtacctactaaggtaataaacttaccgtacgttaccctcggttacggtaccgtttacggacccgtaaacggggtacccgtaaaggggttacgaaaaccggtaaccggtaaaaccggtaacggttaccgggttagggtacccgttacggaaccccgtaacttaaccggttacctttaccgggtttaccttaacgttaccccg

SEQ ID NO: 132011 - DNA, 732 bp, Homo sapiens
  misc_feature: GYAE6OF02HJM5S.25.32.C10.1.454.CMB.1.raw
  modified_base (211)..(211): a, c, t, g, unknown or other
  misc_feature (211)..(211): n is a, c, g, or t
  modified_base (269)..(269): a, c, t, g, unknown or other
  misc_feature (269)..(269): n is a, c, g, or t
  modified_base (719)..(719): a, c, t, g, unknown or other
  misc_feature (719)..(719): n is a, c, g, or t
  modified_base (725)..(725): a, c, t, g, unknown or other
  misc_feature (725)..(725): n is a, c, g, or t
tcagactgtacagtcacgaccggtgctcgatttagtatagacatcaacacacaaagggggaggaactgctcagttaggaccagacggaaccatggaagcccagcgcagcttctcttcctcctgctactctggcctcccagatcgccactggagaaattgtgatgacgcagtctccagcctccctgtcctgtcgtctccgtggggaaggacnccacctgtcctgcgtaggccagtcagagcgttgactaggacttacggcctggtaaccngaccaagaacccgtgggacccacggtccctaccgtaacgtacccgttcccctccgtacgttaacgtggtacctcccgtttacccgaaccgtcccggggtacccctggtaccttacccgtccccccgacggtaacggtttccgaccggtcgggtaccgacggggttacggtaccggttggggaactacggggttactttccgtaacctccgttcccaaccggaatttccgacggttaccgacgccccggttgaccgttaccgtacgggtagtaacggttacgttttcggaaactttacggttttaactcggttacgaaccttaaccgtaattaacgtaacttaacccggtcgtccgttacgtaccggtacgtttcggaaccgtaacggggtactacgggtacggaaactacgtaaacgacgttcgaggtactgacccgtatagtcctttanccgttntaacccg

SEQ ID NO: 132012 - DNA, 787 bp, Homo sapiens
  misc_feature: GYAE6OF02H7X8U.25.32.C10.1.454.CMB.1.raw
  modified_base (175)..(175): a, c, t, g, unknown or other
  misc_feature (175)..(175): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggaagtaaattgtgatgacgcagtcnccagcctcctgtctgtgtctccgtggggaagacgccacctctcctgcgagggccagtcaggagtcggttggcaagggtaacttagccgttacggtaaccaacgccaacgaaaacccgtcggacccacggccccgtaccccaacgtacctccccgttcccttacgttagtcgggttcgtcctttaccccgacccggacgggtccccctagtaaccttaacccgtcccccggaccgtaggttaccgtaggttcggacgtaacgggttcgggttacggtcgggacgaacggttacgttcccaaacgttccgtaccctaccgtactacgacgtccgacgtccctaggtcgtaacgttcgtaaggtaaaggtttacgtttttagaccgtttaagtttttaacttacgttacgtactaaccgttaagttaaacgtaaagttaccggttcggtacccgtttcgggttaccggtttaccggtttaaccgggaaccggtaaacggggtaaccgggtaaacgggtaggtaaaacggtaacgaaaaccgggttacgttacgggtacggtaccgttacgacccgtaacgttacgttaccgtacggtttaccttaccgttacccg

SEQ ID NO: 132013 - DNA, 685 bp, Homo sapiens
  misc_feature: GYAE6OF02FYPFX.25.32.C10.1.454.CMB.1.raw
  modified_base (208)..(208): a, c, t, g, unknown or other
  misc_feature (208)..(208): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtcctccgtggggaaggngcccaccctctccgtgcagggccagtcaggacgcgttggcaggaacttgcctgtaccagcagaaactcggccacgcctcccagtacctcctcctctagtggtcgtccttcccacgacgggtcccctgactacctccccgccgtaggttccaacggtggctagggttcgggtcgtacggggacacggtagttccaacctcgttacccaccgtatcgacgccacggtccctagtcgtacgtcctaaggtaacgtttacttttcggtaactttacgtttttacttacgttcgttacctaaccggtaatttaaacgttaacttaacggttcggtacccctttacgggtacgggtttaccgtttacgggaaccgtaacggggaacccgtaaggttacgggaaacgtaccggaaaacgtaccggttagggtcgtaccgtccggacctaacttcggttaccgtcgtttaccgtccgttaacccg

SEQ ID NO: 132014 - DNA, 649 bp, Homo sapiens
  misc_feature: GYAE6OF02J0IUP.25.32.C10.1.454.CMB.1.raw
  modified_base (153)..(153): a, c, t, g, unknown or other
  misc_feature (153)..(153): n is a, c, g, or t
  modified_base (161)..(161): a, c, t, g, unknown or other
  misc_feature (161)..(161): n is a, c, g, or t
  modified_base (539)..(539): a, c, t, g, unknown or other
  misc_feature (539)..(539): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactgganaaattgtnatgacgcagtctcagcctccctgtctgtgtacctcgtaggggagacgcccacctctcctgacgacgggtccagtcagacgtcggttggacaggtaacttgccttacggacagcaacgaacctggaccacgccctccagtacccttcccgcctactaagtcggtcgtacctttaccgacccggtaacgggccccctggtaacctaccgttccccccggtagtaacgggtttcaacggtggtacccgtagggtttcgggtccggaacgggtaccaacggttacgtccaacttccggactaccgtactcggaacgtcgacgcgtgtacgcgtcctaggagttcttagtcttaatttcgtacgtacgtactcaacgtttaanacgtactcggtacgtcgttgtacgtcgacgaacgacgtcgaagacgacgaaggttacctagggccgtactacgggtaccaaccgtagttaccgctttagaccttacccgg

SEQ ID NO: 132015 - DNA, 646 bp, Homo sapiens
  misc_feature: GYAE6OF02HBOIW.25.32.C10.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
tcagactgtacagtcacgaccggtgctcgatttagtatagacatcaacacacaaaggggaggaactgctcagttaggacccagacggaaccagtggaagcccagcgcagcttctcttcctcctgctactctggctcccagatgccactggagaaattgtgatgacgcagtctccagcctccctgtctgtgtctcctggggaagngccacctctcctgcaggccagtcagagcgttgcaggacttagtctggtaccagcagaacctggccagcctccagacctcctcctctatggtcnccttccaccacgggtcccctggactactccccccgcgtacggttccaggtcggactaggtcgggtctgggacctaggtacgttcacgttcacgaccctatccgaagtccaggaccccttgacccgtacggttcctaggtaacggtactttttacggacttaacggttttacttacgtcgttaccacctagttaactaactaacgttcggcccttaccggtggtaacccgttttggaacccgtaaaggggtacccaagggtacggtaaacgaccgtaaaccggtaacgttacgggtacggaccctttaggacctaaccgtacgttccgttacggttacctttcgtaaccg

SEQ ID NO: 132016 - DNA, 557 bp, Homo sapiens
  misc_feature: GYAE6OF02IJE4G.25.32.C10.1.454.CMB.1.raw
  modified_base (207)..(207): a, c, t, g, unknown or other
  misc_feature (207)..(207): n is a, c, g, or t
  modified_base (396)..(396): a, c, t, g, unknown or other
  misc_feature (396)..(396): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (551)..(551): a, c, t, g, unknown or other
  misc_feature (551)..(551): n is a, c, g, or t
tcagactgtacagtcacgaccggtgctcgatttagtatagacatcaacacacaaagggggaggaactgctcagttaggacccagacggaaccatgggaagccccagcgcagcttctcttcctcctgctactctggctcccagatgccactggagaaattgtgatgacgcagtctccagcctccctgtctgtgtctccgtggggaagngccaccctctcctgcgagggccagtcaggagcgttggcaggtaacttagcctggtaccagcaagaacctggccagcctcccagacctccctcctctatcggtgtccttccaccgacgggcccctgactaccgtccccgctacggtcagtcggcgaggtcgggtctgggacaggtagttcactctcaccntcagcacgctgcagtcagagtntttgnttagtttntactcgtcactagtataatacgtgtcctcgtggtacgttcgacgtaacggacgtaggtacgaaagtacgaaacgtacgtggtacggtactacggtccaacgttacgtcgtacgttccttntacccg

SEQ ID NO: 132017 - DNA, 739 bp, Homo sapiens
  misc_feature: GYAE6OF02HCHA2.25.32.C10.1.454.CMB.1.raw
  modified_base (238)..(238): a, c, t, g, unknown or other
  misc_feature (238)..(238): n is a, c, g, or t
tcagactgtacagtcacgaccggtgctcgatttagtatagacatcaacacacaaaggggggaggaactgctcagttaggacccagacggaaccatggaagccccagcgcagcttctcttcctcctgctactctggctcccagatgccactggagaaattgtgatgacgcagtcctccagccctccctgtctgtgtctccgtaggggaagcgcccacctctcctgcagggccagtcagngcgtggcaggaactagccgtagtaccagcaacgaaacctcggccacgccctacccacgacctccctccctcgttacgtcggtcgtcccttaccgacccgggaccggtcccccgtagaccttaacccgtccccccggtaccgtaacggttcacggttcgggacgtagggtggggttccgtaggggactacggtacgttcctacctacctacgacctagtaccgacgaccgtaccgcctaggcctaaggttcgtaaggtaagtttactttacgaacttaaccgttttattaccgttaacgaaccctaaaacttaacttaaatttaaaacgtttaactttaaccgttaacccgtaaccgttttaaccggtttaccgggacgggttaaaccgggtaaccgtaagggttacggaacgttaacgtaacggtaaacgttaaccggtacggttacggtaactcgtaacccgacctttacgttccgtttaacgttccttaccgttacccg

SEQ ID NO: 132018 - DNA, 766 bp, Homo sapiens
  misc_feature: GYAE6OF02IL127.25.32.C10.1.454.CMB.1.raw
  modified_base (540)..(540): a, c, t, g, unknown or other
  misc_feature (540)..(540): n is a, c, g, or t
tcagactgtacagtcacgaccggtgctcgatttagtatagacatcaacacacaaagggggaggaactgctcagttacggacccagacggaaccatggaacgccccagcgcagcttctcttcctcctgctactctggctcccagatcgcccactggaagtaaatttggtagaatcggaaccgctagttcctcccgaagtcccttccctgttcttggtgttcctccggtagggggaaaggcgccctaccccttctccctggaccgacgggccctaggtccaggacgtcggttggacgtaaggtaacctttacggccttacggtacccaggacctaaacgaaaccgtcggacccacgccctaccccgaagtacccttccctaccttacgttagttcggtcttaccttaccgaccgtacgggtcccctagaacttaccgtccccgcgtaggttccaggtcggcgtacgggtcggtctagggacaggttacgttccactccgtacaccgatcgacgctacgtccttagacgtactagtaacgttnttttacgactttaattttacgtacgtacgttacctaacgtaagtaaattaacgtacggttaccgtcccgtttacgtcgggttaccggtttacggaacccgtaaagggtaaccgtaaagggtacggtaaacgaaccgtaaaccggttaacggttacggtacgggtaccgtacgaaccgttaccgtaacgtttaccgttacggtttaccttaccgtaccgttaccccg

SEQ ID NO: 132019 - DNA, 781 bp, Homo sapiens
  misc_feature: GYAE6OF02JXTG8.25.32.C10.1.454.CMB.1.raw
  modified_base (140)..(140): a, c, t, g, unknown or other
  misc_feature (140)..(140): n is a, c, g, or t
  modified_base (173)..(173): a, c, t, g, unknown or other
  misc_feature (173)..(173): n is a, c, g, or t
  modified_base (230)..(230): a, c, t, g, unknown or other
  misc_feature (230)..(230): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
tcagactgtacagtcacgaccggtgctcgatttagtatagacatcaacacacaaaggggaggaactgctcagttaggacccagacggaaccatggaagcccagcgcagcttctcttcctcctgctactctggctcccagntgccactggagaaattgtagactgacgcagtcnccagcctccctgtctgtcgtctccgtggggaagcgccaccctctcctgcacgggccngtcagagtcgttggcacggacttagccgtggaccagcgaacgaaccgtgaccgacgtcctacccacgacctccctcctctagtcggtcgtccctttccaccgaccgggtacccctgacctaccgttcccccgacgtacggttacacggtcggacgttcgggtgggttaccngggtaaccgagtcggtttanccccttataccccgattacccgcgacggtacctaccggtcccgtgccgtacgtacgttaacggtagtttaacgtttacgtaccggttaaacgtttttacttaccggttaaccgttaccgtaaacccggttaagtttaaacgttaaacttaaccggttaccgggtaccccttaccggggtttacgggttaaccgttttacccggggtaaccccggtaaaagggttaacccggaaggggtttaaccggaaaggttaacccggtaaaacgggtttaaccggtggttaaaaccgggttccgtaacgtttacccgaaaccgtttaccggtaccgtttaacgggtttcctttaacccgttaccccg

SEQ ID NO: 132020 - DNA, 809 bp, Homo sapiens
  misc_feature: GYAE6OF02JD705.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctcctgtctgtgtctcgtaggggaaggcgccaccctctcctgcgagggccagtcgagagtcggttggacaaggtaacttcgccgtcgggtaccagacgaacgtaaaccgtcggacccacgtccctaccccgagtacccttcccgtaccctcgttacgtggtcgtccttaccgaaccgccgggtcccctagtaccttacccgtacccccggaccgtacggttacgacggttcgggaccgtagggttccggggttaccgtaggggtaaaccgaggttaacggtttccctaaccgttcccgtaccaacccgtagttaccgacgtaccgaccgtccgtcggtccgtaggttaccgtaggtaaacgtttacggttttcggtaacgttttaacggttttacctttacgtacgttaaccgttaaccgtaaagtttaaacttaaacgttaccgttaccgggtacccgtttacccgggttaggtttaaccgggttaaccgggtaaccggtaacgggtaaccggtaaggggtaacgtaaacggaaccggtaaacggttaaaccggttgggtaaccggtaccggttacgaacccgttaaccggtacggtttaccgttaccgtttaccgttaccgttaacccg

SEQ ID NO: 132021 - DNA, 618 bp, Homo sapiens
  misc_feature: GYAE6OF02GV2U0.25.32.C10.1.454.CMB.1.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
  modified_base (334)..(334): a, c, t, g, unknown or other
  misc_feature (334)..(334): n is a, c, g, or t
  modified_base (409)..(409): a, c, t, g, unknown or other
  misc_feature (409)..(409): n is a, c, g, or t
  modified_base (437)..(437): a, c, t, g, unknown or other
  misc_feature (437)..(437): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatgccactggagaaattgtgatgacgcagtctccagcctccctgtctgtgtctccgtaggggaagcgccctaccctctcctgcgagggccaggtcagncggttgcaggtaacttgcngtacgagcagtaacgcggccagcctccagcctccctctctagtgtcncctaccgaccgacggtccctgacttccnccccgcgtagtccgacgtggcgtggtcggtcgtcggacagtcgtctctcgaccactagtacgagcgactccgtancgttacgtgtaacgttagttgttttacncgttatttaacgttctagtcctaactagttaacgttaacacggttccgtaccgttacggtacggttaccgttacgaaccggaagggtaaccgaaggtaaccggacgtaaccgaaacggttaccgtaggttccgacgtaccgacgtaccgttacgttaccgtacgttaccttacgtaccccg

SEQ ID NO: 132022 - DNA, 647 bp, Homo sapiens
  misc_feature: GYAE6OF02FZRDT.25.32.C10.1.454.CMB.1.raw
  modified_base (241)..(241): a, c, t, g, unknown or other
  misc_feature (241)..(241): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggcctcccagatgccactggagaaattgtgatgacgcagtctccagcctccctgtctgtgtctcgtgggaggacgccacctctcctgcagggccagtcagagcgttggnaggacttagcctaggtaccagcaacgaaaccgtggacccacgcctaccccagacctcctaccctcgtagttcggtcgtcctcccgaccgacgggtcccctgactaccgtcccccgtactaccggttcaggtcggtcgtacggtcgggttcggtacgggtaacgtacggtacgtttaccgtaacccttcgtacccgtacccgtagttaccgacggtcctaaccggtccgtacggcgtacgttcgtacgtaacgttagtttttcgacgtttaacgttttacgtttacgtcgttacaaccgtagttaataacgtacgtcggtaccttcggtagtcgtttcggaccggtaagacgtaggtagaacgtcgaaagtacgtgacgtcgtagactcgtacgtctgtcgtatccg

SEQ ID NO: 132023 - DNA, 500 bp, Homo sapiens
  misc_feature: GYAE6OF02FJL5F.25.32.C10.1.454.CMB.1.raw
  modified_base (366)..(366): a, c, t, g, unknown or other
  misc_feature (366)..(366): n is a, c, g, or t
  modified_base (484)..(484): a, c, t, g, unknown or other
  misc_feature (484)..(484): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaagagccaccctctcctgcagggccagtcagagcgttggcaggaacttagcctggtaccagcagaaacctggccagcctccccagacctccctcctctatggtcgccttccaccagggcccctgactactccccgcaggttcagtggcagtgagtctgggacagngttcactctcaccatcagcagcctgcagtctgaagtattttgctagtttattactgtcactagtataatactgcctcgtgacgtttgcgaaggtaccagtgaacgacaacgactgtgntcgcaccatctgtctc

SEQ ID NO: 132024 - DNA, 637 bp, Homo sapiens
  misc_feature: GYAE6OF02G1BIG.25.32.C10.1.454.CMB.1.raw
  modified_base (168)..(168): a, c, t, g, unknown or other
  misc_feature (168)..(168): n is a, c, g, or t
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (407)..(407): a, c, t, g, unknown or other
  misc_feature (407)..(407): n is a, c, g, or t
  modified_base (435)..(435): a, c, t, g, unknown or other
  misc_feature (435)..(435): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgnagtctccagcctcctgtctgtgtctccgtggggaagcgcccaccctctcctgcgacgggccagtcagagtcgtgganaggacttgcctgtaccngacaagaaccgtcggccacgtcctcccgagtacctcctccgtctagtcggtcgtccttccgaccggtacggcccctagactaccgtccccgcgtacggttcgagtcggcgtaggtcgggtcgtacggacgagtcgttcacgtccncactatcgagactgacctgcagttctanaagttctttgactttaggtttacttccgtattaccgactaagttaacttaacgttaaccgcccggtaaccgttcggttacggttacgttacggaccggtaaagggtacctaaggggtacaaacggtaacgaaaccgggttaactcggggttacgaccgttagtaccgccgttaagttccttaccggtttatacccgttaccg

SEQ ID NO: 132025 - DNA, 804 bp, Homo sapiens
  misc_feature: GYAE6OF02IACOZ.25.32.C10.1.454.CMB.1.raw
  modified_base (152)..(152): a, c, t, g, unknown or other
  misc_feature (152)..(152): n is a, c, g, or t
  modified_base (211)..(211): a, c, t, g, unknown or other
  misc_feature (211)..(211): n is a, c, g, or t
tcagactgtacagtcacgaccggtgctcgatttagtatagacatcaacacacaaagggggaggaactgctcagttaggacccagacggaaccatggaagcccagcgcagcttctcttcctcctgctactctggctcccagatgccactgganaaatttgtgatgacgcacgtctccagccctccctgtctgtgtctccgtagggggaagcnccctacctctcctgcgagggtccagtcagtagcgttgcaggaacttgcctggtaccagcaagtaaccgtggacccacggccctaccgagtactccccttacctcgttaacgtgggtaccttccttaccccgaaccggtacggggtccccctaggaacttaaccccgtccccccggagttaacgggtttccaacgggttcggaccgtacggttcgggggttacctacggggacttaaggggcctttacacctttccgtaccaacgtaccgtacgacgacccgtacgtacccgttacgtaccgtaacgttccgtaaggttaaacgtttagtttttacggtaccgtttaagtttttaccgtttaacgttccgttaacgtaaccttaacgggttaaactttaaaaccgttaaccggtccggttacccgttaccgggttacgggttaccgttttaccgggaaacccggtaacgggggtaacccgtaaagggtaccgggtaaaaggtacccgtaaaaacggtaccggttacgggtaccgggtaccgtcggtaaccgtaacgtaccgttacggtttaccgtttacccttacgtaacccgg

SEQ ID NO: 132026 - DNA, 750 bp, Homo sapiens
  misc_feature: GYAE6OF02G4PTE.25.32.C10.1.454.CMB.1.raw
  modified_base (164)..(164): a, c, t, g, unknown or other
  misc_feature (164)..(164): n is a, c, g, or t
  modified_base (173)..(173): a, c, t, g, unknown or other
  misc_feature (173)..(173): n is a, c, g, or t
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
tcagactgtacagtcacgaccggtgctcgatttagtatagacatcaacacacaaaggggggaggaactgctcagttaggacccagacggaaccatggaagccccagcgcagcttctcttcctcctgctactctggctcccagatcgccacgtggagaaattggngatgacggnagtctccagcctccctgttcngtctcacgtggggaagcgtccacctcttcngcgaggcctagtcagagtcggttaggctaaggtaacttacgccgtacggtaccgagtacaacgaaccgtgccacggtccctacccagtacccttccttccttactacgtcgtccgtccttacccgaccggtacccggtccctagactccctacccccggtcagggtttcacgtggccgtggttacgggtccgaggaactaggtacgttcctacttccggactaccagttcagtacgtacgaccgtcgtacctagtcgtaacgttaaacggttccgttttaggtacttacggtttaaccttagtccgtacgtaacctagttaaacttaacgttaacggaccggtcccgtttacgggtaccgggttttacgggttaccggtaaaccgtaaccggggtaaacgtaaggggttaacggtaaaccggtaaccggtaaaacggtaccggttttaaggggcccccgttaagggtaaccgtaccggttaaccctggtttaacgttccgtttacccggttaccgtttaaccccgg

SEQ ID NO: 132027 - DNA, 637 bp, Homo sapiens
  misc_feature: GYAE6OF02FIAS5.25.32.C10.1.454.CMB.1.raw
  modified_base (206)..(206): a, c, t, g, unknown or other
  misc_feature (206)..(206): n is a, c, g, or t
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctccagcctccctgtctgtgtctcctggggaaggngcccaccctctcctgcagggccagtcagagcgttggcaggaacttagcctggaccagcagaacctggccagccctcccagacctcctcctntatgtgccttccaccgacgggcccctgactctcccccgctaggttcnggtcggctaggtcgggtcgtagggacaggtacgttccaccttccgtacaccatacacgacacggcccttaaggacgtcctaggaacgttatttcgacttagttttaactactacgtaccagtcctccgaacgtaacggaacggtcggtacccttaaccgtaatttaccgttaccttaccggttttcccgggacccgttaggggtaaccctaaagggtcggtaacttaacgtaacccgtaaacgttaaccgttggtacggtacgtaccgtaccgaaccttacgtaccttaccgg

SEQ ID NO: 132028 - DNA, 740 bp, Homo sapiens
  misc_feature: GYAE6OF02FVLSQ.25.32.C10.1.454.CMB.1.raw
  modified_base (327)..(327): a, c, t, g, unknown or other
  misc_feature (327)..(327): n is a, c, g, or t
  modified_base (376)..(376): a, c, t, g, unknown or other
  misc_feature (376)..(376): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtagatgacgcagtctccagccctcctgtctgtcgtcctccgtaggggaacgacgccgacccttctccgtagacgaacgggtcccaagttccaagacgcggttggacaggaacttagcctggtaacagtcaagaaaccgtggaccacgcctcccaagcctccctacctntacgtggtctccttaccaccgacgggtcccctagtactacctcccccgntacggttccagtcggctacggtcggtacgtacgggactaaggtacgttacgactccgtacgtaaccacgttacgacgacacgtccgtagaccgtaacgttccgtaaggtaacgttacgttttcggaccgtttaaagttttaactttaacgttcgtaaacctaccggtaaattaaaccgttaaaagttaaccgtaccggttacccgttaccggtacggttacccggttttaacggaacccgtaaacggggtaacccgtaaagggtacgaaaacggtaacccgtaaaacggtaacgttcgggtaacggtaccgttaacggacccgttaacggtaactttcccgtacgttaccgttcttaaacccgg

SEQ ID NO: 132029 - DNA, 731 bp, Homo sapiens
  misc_feature: GYAE6OF02GD5K3.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgtgatgacgcagtctcagcctcctgtctgtgtctcgtgggaagagcccacctctcctgcgacgggccagtcagagcgttggcaggtaacttacgccgtggtaccagacaacgtaaaccgtcggaccacgccctacccgacgtaccctaccctcctacttacgtcgggttctccttccccgaaccggaccgggtcccctagtacctacccgtaccccggtccgtacggttccacggtcggccgtacggttcggggtaccgtggggaactacggttacgttaccaaccttccgtaccctacctacgtccgacggtaccacgtccgtacgcgtaacgttcgtaaggttaagttacgttttcgtaacgtttaacgttttacttaccgttacgtaccgtaacctaaggttaacttaaaccgtaccggttccggtacccgttacgggtttaccggttaccggtttacggaccgtaaagggaccctaaggggtaacgtaacggaaccgtaaacggtacggttcggtacggtacgtacggtacctaccgtagttcccgtttacgttcccgttacttacccg

SEQ ID NO: 132030 - DNA, 723 bp, Homo sapiens
  misc_feature: GYAE6OF02F6JQ2.25.32.C10.1.454.CMB.1.raw
  modified_base (160)..(160): a, c, t, g, unknown or other
  misc_feature (160)..(160): n is a, c, g, or t
  modified_base (167)..(167): a, c, t, g, unknown or other
  misc_feature (167)..(167): n is a, c, g, or t
  modified_base (322)..(322): a, c, t, g, unknown or other
  misc_feature (322)..(322): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatgccactggagaaattgngatgacncagtctccagcctccctgtctgtgtctccgtggggaagacgcccaccctctcctgacgagggcctagtcagagcgttggcaggtacttagcctggtaccagcgaagaaccgtggacccagtccctacccagaccttccctcctcttagtcggtcncttcccgaccgtacgggcccctagactcgtacccccgcgtaacggttccaggtcggactacgggttcgggttaccgtcggggactacggtagtttacccgccttaccgtccaacccgtacttacccgacggtaccctaacggtcccgtcgacccgtagttcgtacggtaaagtttacttttacgtacggttaacttttaccgttacgttccgttacaacccgttagttaaacttaaacgtacggttcgtacccgttaccgggtggtttaaccgggttacggacccggtaacgggtaaaccgtaggggtaacgaacggtaaccggtaaacggttaacgtacggttcgggaccgttacggaccttaaccgtaccgttaccgtccgtttaccttacgttacccg

SEQ ID NO: 132031 - DNA, 714 bp, Homo sapiens
  misc_feature: GYAE6OF02H661E.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactctgctcccagatgccatggaagaaattgtgatgacgcagtctccagtccctcctgtctgtcgtctcgtaggggaagcgccaccctctcctgcgaggccagtcagagtcgttggcaggtaactgcctgtaccgagcaacgaaccgtgaccacggtccctaccgagtaccctccctaccttcgtagtcggtcgtcccttaccgacccggacgggtcccctagtacctacccgtccccgtacgtcggttacgacggtcgtacgtgggtcgggtcgacggtacgacggttcgttactacgtcccgtaccacctaacgtcgaccgtacgacccgtccggttacgtaccgtacggttacgttaaaggtaaaccggttttgttttaaccgaacccgttttaagttttccttaacgtcgtactaaaccgttaggttaaacctttaaaccggtacgttccgtacccggtttggtaccgggtttaacgttccggaaacggaaccggttagaacgggtacgaacgtaacgtaacggtacttggaccggttactaggtacccaacgttcgttaccgtttagtccccgtattacccg

SEQ ID NO: 132032 - DNA, 817 bp, Homo sapiens
  misc_feature: GYAE6OF02GX9Y6.25.32.C10.1.454.CMB.1.raw
  modified_base (182)..(182): a, c, t, g, unknown or other
  misc_feature (182)..(182): n is a, c, g, or t
  modified_base (806)..(806): a, c, t, g, unknown or other
  misc_feature (806)..(806): n is a, c, g, or t
tcagactgtacagtcacgaccggtgctcgatttagtatagacatcaacacacaaagggggagaactgctcagttagacccagacggaaccatggaagccccagcgcagcttctccttcctcctgctactctggtcctccagatcgccacgtggaagtaaattgtgatcgacgtcaggttccnccagcctccctgtctggtctcctcgtaggggagacgccctccctcgtccgtgaccggacgggtaccaggttacgaaggtagtacgggttcggtacgtacggtaaaccgttttacggcccgtaacggtaacccgaaagtccgaaaaacgtaacccgtcggaaccctacggtcccttaccccgaacgtacccttccccggtaacccttcggttacgtccgggtaacttcccgtaaccccgtaacccggcccgggtaccctagttaaccgttcccttacccccggacgtttacggttcaacggggttcggcccggtaggggtttccgggctttaaacgggacgtaacgggttaccttaaccctccctaccgttaaccaacccgtttagaccggaactcccggtaaccggtcctacggtaccgttacgttcggtacggttaattttacggttaccgttaccttttaaggtttacttacggttacttactaccgtaaagttaacgttaacgttaccggttccgtacccgttcgggtaaccgtttacggttaccggacggtaaacggtaacgtaagggacgtaacgaaccgaaagtacgtaggtacgcgtataccgactcctagtccttntaccgttcccg

SEQ ID NO: 132033 - DNA, 716 bp, Homo sapiens
  misc_feature: GYAE6OF02HA1E7.25.32.C10.1.454.CMB.1.raw
  modified_base (291)..(291): a, c, t, g, unknown or other
  misc_feature (291)..(291): n is a, c, g, or t
  modified_base (444)..(444): a, c, t, g, unknown or other
  misc_feature (444)..(444): n is a, c, g, or t
  modified_base (487)..(487): a, c, t, g, unknown or other
  misc_feature (487)..(487): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
  modified_base (708)..(708): a, c, t, g, unknown or other
  misc_feature (708)..(708): n is a, c, g, or t
tcagactgtacagtcacgaccggtgctcgatttagtatagacatcaacacacaaaggggaggaactgctcagttaggaccagacggaaccatggaagcccagcgcagcttctcttcctcctgctactcgtggcctccagatcgccaactggagaaattgagatcggacgcagttccaccacgtccctccctgtctggtcgttcctacggtaggggaagcgccctaccgtctccgtagcgagggtccagtcaaggtgccgttggcgaaggaaccttacgcgtacgtaccganacgacgaaaccgtcggcgtaacgccctaccagacctacccgtcctactacgtacgggtcctaccgttcccaccgtacccgggtcccctacggaaccgttccgaccccccgtacgtacggttcctaggtaccgggctaacgggtcggggttacncggggtaacctaggtcgttaccaacgttcctaccgaactgacncgacgcgcctgcacgttacncggttaanacgttttgacttagttttactacgtactcggaataaaccgttataaaccgttaagtcggtacccgttacgtacgggtttaacgtccggaaacgtaaccgggtaaccggtaaggtacgggtaaactacgaaaacccggttaagtcgggtaacggtccgtagccgtaaccggttactccgggttcttacccggtntaacccgg

SEQ ID NO: 132034 - DNA, 746 bp, Homo sapiens
  misc_feature: GYAE6OF02JWQX8.25.32.C10.1.454.CMB.1.raw
  modified_base (124)..(124): a, c, t, g, unknown or other
  misc_feature (124)..(124): n is a, c, g, or t
tcagactgtacagtcacgaccggtgctcgatttagtatagacatcaacacacaaaggggaggaactgctcagttaggacccagacggaaccatggaagccccagcgcagcttctcttcctcctnctactctggctcccagatgccactggagaaattgtgatgacgcagtctccagccctcctcgtctgtgtcgtccgtggggaaggtcgcccaccctcctccgtcgtcgacgggtccacgtacgacgacggtcggttcggctaacggtaaccttaggtcccgttacgtaacccgaggacctaacggtaaaccgtcggtaccgaccgtacccgaccccgtaagtaccctcccttcccgtacgttcgttcgggtacgtcccttacccgaaccgtacgggtccccttagtaccttacccgcccccggtccgaacggtttccgaacgtcgggtactagggtcgggttaccgtacggggtacaaggttaccgttccaccggtttcccaccgtaacccgtactaccgtagtaccgtaccgtacccttcgaccgtacgtcgtaacgtagttacttagtaccgttagttttaccgttacgttacgtaccgttactacgttaattaacgtaccgtacgtcccgttacgtcggttacgttcggtaccgaacggtacgtaacgtagggaactacggaaacgtacgtaaggtccgtaagtcgacgtaccgtacgttacgtcggtacttccgtaaccg

SEQ ID NO: 132035 - DNA, 730 bp, Homo sapiens
  misc_feature: GYAE6OF02FSXKY.25.32.C10.1.454.CMB.1.raw
  modified_base (154)..(154): a, c, t, g, unknown or other
  misc_feature (154)..(154): n is a, c, g, or t
  modified_base (290)..(290): a, c, t, g, unknown or other
  misc_feature (290)..(290): n is a, c, g, or t
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
tcagactgtacagtcacgaccggtgctcgatttagtatagacatcaacacacaaaagggggaggaactgctcagttaggacccagacggaaccatggaagccccagcgcagcttctcttcctcctgctactctggctcccagatgccactgganaaattgtgatgacgcagtctccagcctcctgtctgtgtctcgtggggaagcgcctacctctctgcgaggccagtcagagtcgttggacaaggtacttacggcctaggtaccagacaacgaacctggcccacgcccncccacgtacctccctcctactagtcggtctcctcccgaccgaccggtcccctagactcctccccggacgtacggttcaggtggctagggtcggtacgngggactaggtacgttccncgttcctaccgaaccgtagtacgacgtacaccgtccgtagtacgtacgttccggtaaggtaaacggtttgtttaccggtacgttttaaacggttttactttacggtaccgttaaccgtaaccgttaaagggtttaaaccttaacggttaaccggtcccgggtttacccgttaccggggttaccggtttaaccgggtttacggaacccgggtaaaacgggtacccggtaaagggttaacgaaaccggaacccgttaaacggtacggttcggtaacgtcccgtacggaccctacgttaccgttcgtacgtttaccctacgttaccc

SEQ ID NO: 132036 - DNA, 845 bp, Homo sapiens
  misc_feature: GYAE6OF02HDNNJ.25.32.C10.1.454.CMB.1.raw
  modified_base (209)..(209): a, c, t, g, unknown or other
  misc_feature (209)..(209): n is a, c, g, or t
tcagactgtacagtcacgaccggtgctcgatttagtatagacatcaacacacaaagggggaggaactgctcagttaggacccagacggaaccatggaagccccagcgcagcttctcttcctcctgctactctggctcccagatcgccactggagaaattgtgaatgacgcagtctccagcctccctgtctgtcgtctcgtggggagacnccaccctctccgtgcgaggccagtcagacgtgttggcaggtaacttcgctggtaccagcagaaccgtggaccacggccctacccagtacctccctcctctagtcggtctcctttaccgacccggaccgggtcccctagtaccttacccgtacccccgtaccgttacgggtttaccgacggtcggtaccggtagggttaccggggttacgtaacgggggaacgtacggttaccgtttccgaacccttcccggttaaccctaaacccgttaagttcccggaacggtacccgtaaccggtaccccgttacgggtacccgttaagttaccgttaaacggttaacggttttaccgtttttacggtaccgtttaacgtttttaaccgtttaccgtaaccgggtttaccctaaaccgttaaggtttaaacttaaaccgggttacgttacccggggtacccctttacggggttacggtttaaccggggtttacccgggaaaccggtaaccggggtaaccggtaaaggggtaaccgttaaaaccgggaccggttaaaacccggggacttacggggtaccggtaaccgttcggtaacccttaaccgttacggtttaccgttaccggtttacctttacgtaaccccg

SEQ ID NO: 132037 - DNA, 960 bp, Homo sapiens
  misc_feature: GYAE6OF02H8ALL.25.32.C10.1.454.CMB.1.raw
  modified_base (143)..(143): a, c, t, g, unknown or other
  misc_feature (143)..(143): n is a, c, g, or t
  modified_base (158)..(158): a, c, t, g, unknown or other
  misc_feature (158)..(158): n is a, c, g, or t
tcagactgtacagtcacgaccggtgctcgatttagtatagacatcaacacacaaaggggggaggaactgctcagttaggacccagacggaaccatggacgccccagcgcagcttctcttcctctagctactctggcctccagntcgccacgtgggaanaaattggtgatggaccgcgtacgtcctccacgccctacccgtgtctggtcgttccgtacgggtaggggaacggcgaccctcccctactccgtacggaccggtacggtccgagtccgaagggtgtaccgggtttaggacgtaagggtaaccgtttacggcccgtttacggaaccgacgtaaccgaacgtaaaccggtcggacccgtaccgtccccgttacccgaaacgtccgttaaccccttccttacggttaacgttccggtaacttcccgttaacccgaacccggttacccggtacccttcggaaccttaccgtacccccggtacgttacgggtccgttaacggacgggtacgttacggggttcggttaaccggaagggtactaaacgggttcccgtttaacgcccggtttaaccctaacccgaaaccgttaccgtaaccggtaccggtaaccgtaccggtaacccgttacggtaacggttaccggtttaacgtaagttaacgggtttactttttacgggttaacctttaaacgtttttaacgttaccggtttaacgttacctaaacccgttaaaggtttaaccgttaaaccgttaaccgttcccgggttaaccggtttaccgggtttacgggttaaccgggttaccggtaaaccgggtaaaccggggtaacggttaaacggggaacggtaaccgggtaaacccggaaacggttaaccggtaacgggttacggtaaccggttaccgtaccggttaaccgtaaggtttaccgttacgtttaaccctttaccggtttaacccc

SEQ ID NO: 132038 - DNA, 781 bp, Homo sapiens
  misc_feature: GYAE6OF02FY1Q9.25.32.C10.1.454.CMB.1.raw
tcagactgtacagtcacgaccggtgctcgatttagtatagacatcaacacacaaagggggaggaactgctcagttagggacccagacgggaaccatggaagccccagcgcagcttctcttcctcctgctactctggctcccagatgccactggaacgtaaattggtgagtgacgcagtctccacgcctcccgtgtcttgtcgtctccgtgggggaaggtcgcccacccgtctccgtcgcgacgggccagtacgagtagtcggttcgggactagggtaaccttacggtccgttacgggtaaccacggacgtaaacggtaaaacctcgggcccaacggtcccctacccgagtaccctccttccgttactacgttcgggtctccctaccgaaccgccggggtccctagtaaccgtacccgtcccccggaccgttacgggtttaccgaggttacggccggttacgggttcggggttacggtacggggtaactacgggttacgtttacccaccgttaccgtacctaaccgtactccgtacggaccgtacggtccgtcggtactacggttacgttacgtaacgttactttacggtacgtttagtttaacgtttcgtcggtaacctacgtaagttaaacgtaacgttacggtccgttacccgtacgggtttcgtaccggttttacggaccggtaacgggtaacgtaacggttagaaacggtacgaaacgtacggtacggtaacggtacgtcggacttaccgtcgttactccgttcgttaccgttaccc

SEQ ID NO: 132039 - DNA, 773 bp, Homo sapiens
  misc_feature: GYAE6OF02HQMS9.25.32.C10.1.454.CMB.1.raw
tcagactgtacagtcacgaccggtgctcgatttagtatagacatcaacacacaaagggggaggaactgctcagttaggacccagacggaaccatggaagccccagcgcagcttctcttcctcctgctactcgtggctcccagatcgccactgggataaagttgtgaatgacgcagtctaccagccctccctgtctagtgtctccggtgggggagacgccctaccctcgtccgtgcgacggccagtcaagcgcgttggactaaggtaacttcggccgtacggtaccaggaccaacgtaaaccgtcggcccaacgtccctaccgaacgtacctccctccttatacggtggtctccttccgaaccggtaccggtcccttagactaccctcccccggtacgtacggttccgaggtacggccgtagggttcgggtaccggtacgggactaacggttacgttaacccgctacctacctacccgtaagttccgaacggtccgaccgtacgtacgcttacggttctaaggttacgttagttttacgcgtttacgttttattaccggttacgtaccgttaacgttaacgttaaacgttaaacgttaccgttccggaacccggtttccggttaacgggttaccgggtttaccggaaaccggtaacggggttaacccggtagggtaacggaacgttaaacccggaacggttaaccggtacggttccggtacgtccggtaacccgtactaccggtttaccgttcggttacgttccgttaaccccg

SEQ ID NO: 132040 - DNA, 711 bp, Homo sapiens
  misc_feature: GYAE6OF01DKDUG.44.21.B10.1.454.CMB.1.raw
  modified_base (230)..(230): a, c, t, g, unknown or other
  misc_feature (230)..(230): n is a, c, g, or t
tcagacagtatatacacgaccggtgctcgatttagtgtcgtcgcaagagaggagggggggatctcaggaggcagctctctcggaatatctccaccatggcctgggctctgctcctcctcaccctcctcactcagggcacaggatcctgggctcagtctgcctggctcagcctccctcgtgtccggtctcctggacagtcagtcaccatctcctgcacgtcggaaccaacngtcgacggttcggttcgttttgaccgttgtcctcgtggtaccagcacgaccccagaaaccacgacccctaaactctatttactttagcgacggtcaagttcgttccgtcccgtttccgggtcgtcccgtgacgcgtcctttctcgtcgggtacccaaggttccgtaggaccaaacgtaccgggtcccttcccgtagaaccctagttcccgttcgtcgggtacctaccggtacgggtcgtaggacggaccggacggtcttagtaactttacgttacgtgctacgtactataacttaacgtaactaagggtacggtaaaccttacgtttaacgtagttaccgggacgtaacggtaacgggtaacctaaacggtccgtaacggttaaccccggttaccgttaacgggtcccgtaaaccggtacccgtaaacgggtcccttaccccgggtaccccccgttacgggttacccgtacccgtttcccg

SEQ ID NO: 132041 - DNA, 566 bp, Homo sapiens
  misc_feature: GYAE6OF01EY6C4.44.21.B10.1.454.CMB.1.raw
  modified_base (439)..(439): a, c, t, g, unknown or other
  misc_feature (439)..(439): n is a, c, g, or t
tcagacagtatatacacgaccggtgctcgatttagtgtcgtcgcaaggggggggtctcaggaggcagcgctctcaggacgtcaccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgaccccagaaaccacgacccccaaaactcaattatttatgcggtcaatgttcgcccttccggtgtccctgacgcgtcttctcgtgggtccaagtctggcaacacggcctccctgacctatctcgtcgggctccgaggctggaggacgaggctaggtaattattacgtgcagctnatatacaaggtcggaactacgtttaactagttccgggacgcgaagggaccagctacggacccgttcgtaggtcgacgacccaaggcctaccgccccctcggtacctactctccgttccccaccttcc

SEQ ID NO: 132042 - DNA, 782 bp, Homo sapiens
  misc_feature: GYAE6OF01C4B6P.44.21.B10.1.454.CMB.1.raw
tcagacagtatatacacgaccggtgctcgatttagtgtcgtcgcaaggggggggtctcaggaggcagcgctctcaggacgtcaccaccatggcctgggctctgctcctcctcaccctcctcactcagggcacagggtcctgggcccagtctgccctgactcacgcctccctccgcgtccgggtctcttggactagtcagtcaccatctcctgcactggaccaccgagcagtcgactagttggtgttataacgtttgtctccgtggtaaccaaccaccaccgaggacaaaccgccccaaattcatgattacgatgatgtactagtaacgtccggccctgtagggtttctcggtcgtcttcgtcgtcggcctccgtaaagtccgtaggaccaaccgaccggtccctacccgtacgaaccctattccgtcgtacgggtcctaccgacgggtccgtacggaacgggaccggtacggtccgttacggtaacttaacgtttaccgtacgtaccgtaacgtccgttaactaaacgttaaacgttaaaaacggaacgtaaacctaaacccgtaacgtttaacggttaacgtaacgggttttacccggggacggggtaaaccggaaccggtaaaccgtccggttaccggtaaaccccggtttacccgggtaaacccgggttacccggaaacccgggtaaaccccccgtaacggggtccccggttaaccccccggtaccccccggtttaccgggtacccccttaacccggttccccggtttacccccccggg

SEQ ID NO: 132043 - DNA, 831 bp, Homo sapiens
  misc_feature: GYAE6OF01EMWQQ.44.21.B10.1.454.CMB.1.raw
  modified_base (365)..(365): a, c, t, g, unknown or other
  misc_feature (365)..(365): n is a, c, g, or t
tcagacagtatatacacgaccggtgctcgatttagtgtcgtcgcaagagaggaggggggggatctcaggaggcagctctctcggaatatctccaccatggcctgggctctgcctcctcctccaccctcctcactcgagggcacaggactccgtgggctcagtctcgccctggctcacgccctccctcggtcgtccgggtctccgtggactacgtcacgtccaacctatccttccctgacctaccgtaaccggaaacccaacgtacggtacggtaccggtttcgggtttccgtttttacggacccgttcgttcctccggttacggtaaccacggacccgaaaccggaacccccaaaggaaaacccncccgaacccccctaaattaccttaattttacgtttacgccggtacggtaacttaacgttccggttcccgttccccgtttccggtcgttccccgtggacgtccttccgtttcgtcgtaccgggtactaacggtccgtacgacctaacccggcccggttccctacccgtacgaaccttacgttcccgtcgggttccggacccttaccgacgggtacgacgggtaacgggtaaccgggtagtccgttaaagttacgtttaacttaccgacgtaccgtacgtactaactaacgtaaacgtaacggtaaaggttaccggtaaactttaccgtttaacgttcggtaaccggaccgtaacggtaaccggtaacctacggtacgttaccgggtcccgttaacggaccggtccgaacccggtacccgaacccgttccggtccccgtaaccccgttcgtccgttccccgttcccgg

SEQ ID NO: 132044 - DNA, 718 bp, Homo sapiens
  misc_feature: GYAE6OF01ASRXN.44.21.B10.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
tcagacagtatatacacgaccggtgctcgatttagtgtcgtcgcaagagaggagggggggatctcaggaggcagctctctcggaatactctccaccatggcctgggctctgctcctcctcaccctcctcactcagggcacaggatcctgggctcagtctcgccctggcctcagcctccctccgtgtcccggtctcctggaccngtcagtcaccatctcctgcactggaaccangtgacgtcggtcgtttgaccgtgtctcgtggtaccagcacgaccccagaaaccacgaccccccaaactcctaatttactttaacgtcgtaccgggttacctaaacgttcggtttccgtcccccgtttccggtcgttcccctgtacgccgtccttcgtcgtcgggtccaacgtctcggacctaaccgaccggccctcccgtcgacccactccgtcgtcggtcctcccgaggtctaggacggtaccgtaggtccttaggtaactttagtaaccgtcgactagtcgttactacgtaacttaaccgaaggttacgggaaaccttaacgtttaaccttaacggtttccggaccgtaccggaacgggtaacccgtaacggtaccgttaccggtacccggttacccgttacgggtcccaccgttacccccgtaaacggtcccgttacccggttaccccccccgtccggttacccgtacccgtttacccccgg

SEQ ID NO: 132045 - DNA, 718 bp, Homo sapiens
  misc_feature: GYAE6OF01C8CY3.44.21.B10.1.454.CMB.1.raw
  modified_base (215)..(215): a, c, t, g, unknown or other
  misc_feature (215)..(215): n is a, c, g, or t
  modified_base (317)..(317): a, c, t, g, unknown or other
  misc_feature (317)..(317): n is a, c, g, or t
tcagacagtatatacacgaccggtgctcgatttagtgtcgtcgcaagagaggaggggggggatctcaggaggcagctctctcggaatatctccaccatggcctgggctctgctcctcctcaccctcctcactcagggcacaggactccgtgggctcagtctcgccctgctcagccctccctcgtcgtccggtctccgtggacagtcagtccactntcctcctgactacgtacggaaccacgtagtacgtaccggttcggttcgttttacgaccgttgtccttccgtaggtaccagccaaccgaccccaaagaaaccnccgtaaccccctaaatctaattttaacgttagtacggtacgtactaagttcggttacccgtcccgtttcggtaccttccgaggtcgcgttcgttaccgtcgtacggtaccctagtcgtcggaacctaacgtaccgtccctcgacgtactactcgtcgtcgcctcgtacggtcgtacggacggacggcgtacgttagttaacttacgttacgcgtacgtacgtacctagtaactaacggtaacgtaggttaaaccggttaaactttacggttaacttcggttaccggaccggtaacggacccggtaacaccggtaccgtaaccgttcccggtagtaccggcccgaaaccgtacccggaaccgtccctaacccggtcccgtacgtaaccctcccgttaccccg

SEQ ID NO: 132046 - DNA, 739 bp, Homo sapiens
  misc_feature: GYAE6OF01EIVOV.44.21.B10.1.454.CMB.1.raw
  modified_base (226)..(226): a, c, t, g, unknown or other
  misc_feature (226)..(226): n is a, c, g, or t
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
  modified_base (561)..(561): a, c, t, g, unknown or other
  misc_feature (561)..(561): n is a, c, g, or t
tcagacagtatatacacgaccggtgctcgatttagtgtcgtcgcaagagaggaggggggggatctcaggaggcagctctctcggaatatctccaccatggccgtgggctctgcctcctcctccaccctcctcactcgacgggcacaggactccgtgggctcgacgtctcgcctggctcacgccctcccgtcgtcgtccggtctccgtggacagtcacgtaccaccnttcctccgtgccacgtacggaaaccaacgnggtcggacggttccggttcgtttcgaccgttcgtccttccggtcgtaccngacccgaccgaacccgaaagaacccgacccgtaaccccctaaactcttaacgttagttacgtccggtacgtactaacgttccgttcccgtcccgtttccggtccgttccgtagtccgtccgttcttcgtaccgtcgggtacctacgtcgtacgacctacgtccgtcctccgtacgacctagttccgtcggtcgcctacgcgtacgtacggacggtacgacgtcgtattacttacgtacgcgacgtacctacttanacgttaacgtaacggtaacggttaacgtaacctttacgtttacgtcgtacgggtagaccggtaaacggtacgttaccggccgttaaccgggacccgtttacggaaccggtcccaaccgggaccccgtaccggggttcccgacccccgtccccggtttccgaccgttcccggtaccccg

SEQ ID NO: 132047 - DNA, 782 bp, Homo sapiens
  misc_feature: GYAE6OF01CFQ6W.44.21.B10.1.454.CMB.1.raw
  modified_base (237)..(237): a, c, t, g, unknown or other
  misc_feature (237)..(237): n is a, c, g, or t
tcagacagtatatacacgaccggtgctcgatttagtgtcgtcgcaagagaggaggggggggatctcaggaggcagctctctcggaatatctccaccatggcctgggctctgctcctcctccaccctcctcactcagggcacaggactccgtgggctcagtctgccctggctcacgccctcctccgtcgtccgggtctccgtggacagtcagtcaccatcctctgcactagaaccaanagtcggaccggtcggtttccgtttagaccggttcgttccgttccgtcggtaaccacgtccaaccgaacccccgaaacggaaaaccgtaaccccggaacccccctaaaaacgttccttaattttaactttacgtcggtaccggttactaacgttcggttcccgtccccgttttccggtccgttcccgtggtacgtccgttctttccgtcggtacggtacctaacggttcgtacgacctaaccgtccggtcccttcccgtacgtaccctattcccgtcggtccggtcctaccggaccggtcgtaagggaaccgggtacggaggtacgtacggttaccttaacgttacgcggaccgtagttcaaccttaaagtaaaacgtaaaacggaactacctaaaccgtttcgttaacgtttaacgttacgggttaccgggaacgggtaaccgggaaccgtaacggtccgtaccgggttacccggtaccgttaacggcccggtacgacccggacggtccgtacccccgtacccgttacggtccctacgttccccg

SEQ ID NO: 132048 - DNA, 716 bp, Homo sapiens
  misc_feature: GYAE6OF01D2EH3.44.21.B10.1.454.CMB.1.raw
  modified_base (208)..(208): a, c, t, g, unknown or other
  misc_feature (208)..(208): n is a, c, g, or t
tcagacagtatatacacgaccggtgctcgatttagtgtcgtcgcaagagaggagggggggggatctcaggaggcagctctctcggaatatctccaccatggcctgggctctgctcctcctcaccctcctcactcgagggcacgaggactccgtggctcgagtctcgcctgactcacgtccctcctcgtcgtccgggtcctccgtgacngtcacgtcacctactcctcctcgcctacgtacggaaaccaacgtacgtcggtaccggttcgggtttaccgttttcggaccgttcgtccgttccggtacggtaccacgaccgaaccgaacccaaacggaaaccaccccgtaacccccaaaacttacttaacgttttaactttacgtcgggtaccgttactacgttccggttcccgttcccgttccggtcgtacccgtggtaccgtcgttccttccgttcggttcgtacctacggtcctcggaacccgtaacgcccggtccccttaccgaccgactcgttcctcgggtcgtccgtacggaggtcgtagggaaccggtagcgtacgtagttactacgttcgcgtcacgtccaatatacgtaacgtaaggtacgtaacttacttacgtcgtacggcgaacggacgacgacgtccgtacggtccgtaccgtagcccgaacgtaccggacgtccgtcccgtacccgtacgtcctccgttcccgg

SEQ ID NO: 132049 - DNA, 700 bp, Homo sapiens
  misc_feature: GYAE6OF01DNW75.44.21.B10.1.454.CMB.1.raw
  modified_base (207)..(207): a, c, t, g, unknown or other
  misc_feature (207)..(207): n is a, c, g, or t
  modified_base (406)..(406): a, c, t, g, unknown or other
  misc_feature (406)..(406): n is a, c, g, or t
  modified_base (534)..(534): a, c, t, g, unknown or other
  misc_feature (534)..(534): n is a, c, g, or t
tcagacagtatatacacgaccggtgctcgatttagtgtcgtcgcaagagaggagggggggggatctcaggaggcagctctctcggaatatctccaccatggcctgggctctgctccctcctcaccctcctcactcagggcacgaggatccgtgggctcagtctcgccctggctcacgccctccctccgtggtccggtctcctggacngtcagtccacctactcctcctgctacgtacggaaccaacagtacgtacggttcggttccgttttggaccgttgtccgtcgtcggtaaccacgaccaaccgaaccccaacgaaaaccgacccgaaccccccctaaaagtccttaaatttacttacgtggtacggtactaacgttcggtccgtcccgttcggtcgtcccgngacgtctcgttccgtcgtggtacctagtcgtagaccacgtccgccctcccgcgtactactcgtcgtcggtccacgtacgcgtaggacggacgtacggtactacggttacttaagttaccgcggtaccnggtactacgtaataattaacggtaaggtacggttaacttacgttaacgttacgtcggcgacggtaaccggaacgacggtccgtcgtaacccgtcggtaaggtacccgaacgtacccggaaccgtcccggtaccccgtacccccggtttgaccctcccgtttacccg

SEQ ID NO: 132050 - DNA, 741 bp, Homo sapiens
  misc_feature: GYAE6OF01CS3QN.44.21.B10.1.454.CMB.1.raw
  modified_base (461)..(461): a, c, t, g, unknown or other
  misc_feature (461)..(461): n is a, c, g, or t
tcagacagtatatacacgaccggtgctcgatttagtgtcgtcgcaaggggggggtctcaggaggcagcgctctcaggacgtcaccaccatggcctgggctctgctcctcctcaccctcctcactcagggcacaggactccgtgggctcagtctcgcctggctcacgcctcctcgtcgtccggtctcgtggacagtcacgtcacactcctcctcgcacgtcggaaaccaacgagtcgacgttcggttcgtttcgaccgtgtctcgtcggtaccagccaacgacccaaagaaccaccgaccccaaactcctctacttcgtttaacggaaactaacgtcgtccggtaccgtacggtaccgggtcctacgtaccgttacttctcgtcggtacctacgtaacgttcgtacggacctaccgtcaccgtccctccgtcggacctacgtccgaacggcggtcctacggnggtacgtacggaacgtcggttagggtacgggtacgttacgtttaactaacgtcgtacgtaacgttactacgtacgacgtacggcctaacggtcccgtaggttacgggtttcggggtttacgggttcgggtaccggggaaccgggaacgggtaccgacgggttccggtaccgggtaccggttccgggtacgggtaaccgaccggaccggtacggccccgttcccgggtacccgttacccggttcctaccgtttcccggtacccgtttcccccttaacccgg

SEQ ID NO: 132051 - DNA, 658 bp, Homo sapiens
  misc_feature: GYAE6OF01CTQB7.44.21.B10.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
tcagacagtatatacacgaccggtgctcgatttagtgtcgtcgcaaggggggggtctcaggaggcagcgctctcaggacgtcaccaccatggcctgggctctgctcctcctcaccctcctcactcagggcacagggtcctgggcccagtctgccctgactcagccctccctccgcgtccggtctcgttggacngtcagtcacntcncctgcactgcacagcagtnactnttggtgttatacttgctctgtaccacaccaccagacaacgccccaaatcatctatttatgtactgactagtacgccggtcctacggacgggtcctgactccgtcttctcgtcgtctaccgagttcgacgacaacgccgtaccctccgtcgaccgtccgtcgtcgggtactccgacggtccgtggtaggtacgtgggtacgtacgtacggtacctttagttccgtcggtccggttacttacctttaacgtttacctaacgttcgttagtacggttacgggtttggggtccggttcgggtcgggtacggtacctcgttacccgtcgtaccccggttagtaccggtaccgaccgtacccggaacggtcccgttcccggtacccccgttccggtacccttaccggtcccctttcccggtacccccttaccccg

SEQ ID NO: 132052 - DNA, 711 bp, Homo sapiens
  misc_feature: GYAE6OF01C04GF.44.21.B10.1.454.CMB.1.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (321)..(321): a, c, t, g, unknown or other
  misc_feature (321)..(321): n is a, c, g, or t
  modified_base (700)..(700): a, c, t, g, unknown or other
  misc_feature (700)..(700): n is a, c, g, or t
tcagacagtatatacacgaccggtgctcgatttagtgtcgtcgcaagagaggaggggggggatctcaggaggcagctctctcggaatatctccaccatggcctgggctctgctcctcctcaccctcctcactcagggcacaggactccgtgggctcgagtctcgccctggcctcacgccctcccgtcggtcggttccggtctccgtggacagtcagtccaccnttcctcngccactacggaaccaacgtgtcgaccggttcggtttcgtttcgaccgttgtcctccgtggtaccagtaccgacgaaccccaaggtaaaccncccggaaccccaattacgtatttacttactcggaccgtactaagtttccgttcccgtcccgtttccggtcgtcccgtagtccgtcgtcctttcgtcggtcggtactaggtcgtacgaccaacgcccgtccctccgtcgacctgtactcgggacgtcctacggacggtcgtacggacggtacggacgtcgtacgttactaacttaccgggtcaccgtgttaaccaggtaaaccttacgaacggttaagggtaccggttttaaacctaaccggttttaccgtttaggtacccgggtcgaaccggaacgggaacctcggtggtaaccctaccggtcgtacggactacccggacgtacggcccttccggaccccgttacgccncggtttacccc

SEQ ID NO: 132053 - DNA, 202 bp, Homo sapiens
  misc_feature: GYAE6OF01CY1PQ.44.21.B10.1.454.CMB.1.raw
  modified_base (143)..(143): a, c, t, g, unknown or other
  misc_feature (143)..(143): n is a, c, g, or t
  modified_base (167)..(167): a, c, t, g, unknown or other
  misc_feature (167)..(167): n is a, c, g, or t
  modified_base (195)..(202): a, c, t, g, unknown or other
  misc_feature (195)..(202): n is a, c, g, or t
tcagacagtatatacacgaccggtgctcgatttagtgtcgtcgcaagagaggagggggggatctcaggaggcagctctctacggaatatctccaccatggcctggctctgcctcctcctcaccctcctcactcaggcacgagntcctggctcatctcgccctgctcncgcctccctcgtcgtccggtctccgtgnnnnnnnn

SEQ ID NO: 132054 - DNA, 812 bp, Homo sapiens
  misc_feature: GYAE6OF01E4UYB.44.21.B10.1.454.CMB.1.raw
tcagacagtatatacacgaccggtgctcgatttagtgtcgtcgcaaaggagagaggggggggatctcgaggaggcagctctctcggaatagtcctccaccatggcctgggctctgctcctcctcaccctcctcactcagggcacgaggatccgtgggcctcagtcctcgtcccgtggcctccacgtccctcccgtccgtgtccgggtctccgtggacacgtcacgtccacctactccgtcctggacctacgtacggaaccaacgtacgtcgtaacggttcgggttacgttttcgaccgtcgtaccgtaccgtacggtaccacgaccaccggaaccccaacgaaaccacccgaacccccctaaaactcgttaactttaactttacgtcggtaccgtacgtaaagttccggtttccccgtaccccgtttacccgggttccgtccccgttacgggaccgttcccgtccgtttccgtccggttacggtcccgtaaaacggttcgtacggaccgaacccgtaccgggtaccccttccgtaccgtaccctacttccgttaccgtacgggccctaccggacgggtcgaacgggacgggaacccggtacggtcgttacgtaactttacgttaccgtacgtacgtacgtctaactagtaaccgtaaggtaaccggtaacggaacctttaaccgtttaccgttacggttcggacgttacccggaacgggtaccgtaacggaccggttaccgtacccgttggttaaaccggccgacggtacccgacggtcctccccggtaccccgtccgtcctaccgttcccg

SEQ ID NO: 132055 - DNA, 863 bp, Homo sapiens
  misc_feature: GYAE6OF01C9IOK.44.21.B10.1.454.CMB.1.raw
  modified_base (122)..(122): a, c, t, g, unknown or other
  misc_feature (122)..(122): n is a, c, g, or t
  modified_base (398)..(398): a, c, t, g, unknown or other
  misc_feature (398)..(398): n is a, c, g, or t
  modified_base (558)..(558): a, c, t, g, unknown or other
  misc_feature (558)..(558): n is a, c, g, or t
tcagacagtatatacacgaccggtgctcgatttagtgtcgtcgcaagagaggaggggggggatctcagggaggcagctctctcggaatatcctccaccatggcctgggctctgcctcctccnccaccctcctcactcgacgggcacgaggtacgtccgtgggcctcgtcgtcgtcgcccgtggcctaccgcgtccccttcccgtccggttcggttcccggtcctcccgtaggacctcgttacacgtacccacctacttccgtccgtacacgaccgtaaccgaactaacggtcggtaggtaccggtttcggttttaccggtttcggacccgtttcgttaacccgttccggtacggttaaccgaccggtaccgaaacccgacccgtaaacggaaaacccnccccgtaacccctaaacgtacctttaatttacgttcgtacggtaccgacgttaacgttccgttcccgtcccgtttcggtcctaccgtcgacggttccttcctttacgtcggttccggaacgtacttacggcgaaccctacgtacccgtcccgtcccgtanaccgtcgttacgggtccgtccgggcctacggtcggtacggtacgggtacggacggtacggtacgttagttaaccgttagttcccgttacgaccgtacttaccggtacttaacgtaacgtaacgggtaacggttaaccggttaaacccgtttaacgttaccgttaaccggtcgggtacccggacggtaaccgggaaccgtccgtaaccggtccggtaccggtacgttaccggaacgttaccccggaacggttcccgtacccggtacccggttacccgccggtttacccttccggtttaccccccgg

SEQ ID NO: 132056 - DNA, 1000 bp, Homo sapiens
  misc_feature: GYAE6OF01A7WCF.44.21.B10.1.454.CMB.1.raw
tcagacagtatatacacgaccggtgctcgatttagtgtcgtcgcaagagaggagggggggatctcaggaggcagctctctcggaatactcctccaccatggcctgggctctgcctcctcctcaccctcctcactcgaggcacgaggactccgtggctacgacgtctcgtccctggctcgacgtcccttcccgtcgtcgtccgggtcctaccgtcggactacgtccacgtacctacctacgttccgtccgtacggacctaacgtacggaaaccctacgtaggtacgtaccgggttccggttacggtttacgaccgttgtacccttacgtaacggtacccgagaccgtaacccgaaccccgaagaaaaccgtccccgaacccctaaaacttaccttaagtttacgttaagtccggtaacgttaccgtaacgttcggttccccgtacccgggtttacgttaccggacccgttagggaccttaccgttccgtttacgtacccgggtttacgtaaccgttacggttaccgtacgggaacccttaacccgggtacccgtcccgttaccccgtagtaccccgtacttccggtaccggttaccggtaccctaccgggacgtaccggtaacgggtaaccgggttcggtaacgtaccggtttaacgtttaaccgtttaaccggtttaaccgtaccgtaaccgtacggtttaccggttaaacttaaaccgttaaccggttaaaccgggtttaaacggttaaaccccgggtttaaaacctttttaacccggttttaaccggggtaacccggtttaccgggtaccggtaaccggggaaaacccggggttaacccgtaaaaccgggttacccggttaaaccccggtacccgggttaaccccgttaaacggggacccccggttaacggaaccccggtttaacccggtaaccccggttaccccggttacccccggttaacccgtttccccccgttaaacccgggttttccccccgg

SEQ ID NO: 132057 - DNA, 571 bp, Homo sapiens
  misc_feature: GYAE6OF02GUAOP.44.21.B10.1.454.CMB.1.raw
  modified_base (378)..(378): a, c, t, g, unknown or other
  misc_feature (378)..(378): n is a, c, g, or t
tcagacagtatatacacgaccggtgctcgatttagtgtcgtcgcaagggggggtctcacggaaggcagcgctctcaggacgtccacccaccatggcctgggctctgctcctcctcaccctcctcactccagggcacagggtcctgggcccagtctgccctgactcagcctccctccgcgtccgggtctcctggacaggtcagtcaccatctcctgcactggaaccaacagtgacgtcggtcgttttgaccgtgtctcctggtaccagcgagaccccagaaacacgcccccaaactcattatttatgtcggtcaatgttcgcccttccggtgtccctgacgccgcttcgtctgggtccaagtctgacaacacgcctccnaccatctctggctcagctgaggacgaggctagacttagtactgctagctcatatacagtgggaactactttactacgttcgggctcgtacggaccctaagcctaggacccgtccgtaggttacacgacccgaaggtcctaccggcccccttccggtccaccgtccgtaccgttccccgcccttccctctaccg

SEQ ID NO: 132058 - DNA, 516 bp, Homo sapiens
  misc_feature: GYAE6OF02H9IYT.44.21.B10.1.454.CMB.1.raw
  modified_base (337)..(337): a, c, t, g, unknown or other
  misc_feature (337)..(337): n is a, c, g, or t
tcagacagtatatacacgaccggtgctcgatttagtgtcgtcgcaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcactggcaccagcagtgacattggtggttataactttgtctcctggtaccaacaccacccaggcaaagcccccaaaattcatgattcatgatgtcagtaatcggcctcaggggtttctggtcgcttcnctggctcaagtctggcaacacggcctccctgaccatcctctgggctccaggctggaggacgaggctgactattactgcagctacataataaaagaagacaaacactgttatattcggcggaaggaccaagctgaccgtcagtcagcccaaggcctcggccccctggtcaccgtctccgg

SEQ ID NO: 132059 - DNA, 518 bp, Homo sapiens
  misc_feature: GYAE6OF02FOV2X.44.21.B10.1.454.CMB.1.raw
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagacagtatatacacgaccggtgctcgatttagtgtcgtcgcaaggggggggtctcagggggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcactggcaccagcagtgacattggtgttataactttgtctcctggtaccaacaccacccaggcaaagcccccaaattcatcatttatgatgtcagtaagcggccctcaggggtccctgatcgcttctctggctccaagtctggcaacacggcctccctgacccgtctctgggcctccgaggctgaggatgaggctgacttatttctgctcctcatntgcnggcgataggttttngtcttcggactggaccagtcacgtcctacgtcagcccaagcccaacccgctcgtccactctcgttccctacccc

SEQ ID NO: 132060 - DNA, 786 bp, Homo sapiens
  misc_feature: GYAE6OF02JKSTD.44.21.B10.1.454.CMB.1.raw
tcagacagtatatacacgaccggtgctcgatttagtgtcgtcgcaagggggggtcgtcaggaggcagcgctctcaggacgtcaccaccatggcctgggctctgctcctcctcaccctcctcactcaggcacagggtcctgggcccagtctgccctgactcagcctccctccgcgtccggtctcttcggacagtcagtccaccatcctcctgccacgtcggccaccaggcaggtcgacagtttgggtacgttaattaacttttggtccttccgttcggttaaccctaaaccaccctaacccgaggtaccaaacgtaccccctaaattaccaactacctaacttttactaggtacttacgtacctaagttaaacggccggtaccccttcggaacggggttcccctagtactccggtacctttcgttccgtcggtacccttaccgtaaacggttccttacgggacctaaaccgtacccgggtccccttacccgtaccggtacccgttaccttccgttacggggcccttacccggacggtccgttcggaacgggtacttcgggaacggtccgttcgtaacgtttacctttcggttacgtcccgttacctacttacgttacgtcgtaccgacgggtaccgtacggttttacgggttttaacttcggtttacccgttaacgggtacttacgggacttacggtacccgtaccgttccgtaacgttacaccggtacccgtaacggacccctaacccgtcgtaccgtaccgtacgttccgttacccgttcccccg

SEQ ID NO: 132061 - DNA, 690 bp, Homo sapiens
  misc_feature: GYAE6OF02IGW7M.44.21.B10.1.454.CMB.1.raw
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
tcagacagtatatacacgaccggtgctcgatttagtgtcgtcgcaagggggggtctcaggaggcagcgctctcaggacgtcaccaccatggcctgggctctgctcctcctcaccctcctcactcaggcacaggatcctgggctcgagtctgccctggctcgagcctccctcgtgtccggtctccgtggacngtcagtcaccntctcctagcacgtggaaacccagagtgaccgtcggttcgtttttacggaccgttgttccttaccttcggtaccagccacgaccccagaaaccnccgaccccaaactcattatttangcgtacaattcgtaccgtccttcgtntccctgacnccgtccttctcgtacgggtaccaagttcgaggaccaaccgaccggtccttacccgtgaccctactcctcggtcggcttaccgaggccgtggaacggacgtagtccgtagtaactttactacgtgccggtcttacgtatttaaccaccgtttgtacggtagttacggtttggttcggttacgggacgggtaacgggttaccgttctaaccggttcgtacccggttcgttacggtaccgaccgtacccgggaaggtacccgtcccggtccccgttaccggttaccgtaccgttcccgttacccgttaccccccgtacccgttaccccttacgttaaccc

SEQ ID NO: 132062 - DNA, 700 bp, Homo sapiens
  misc_feature: GYAE6OF02JOHDU.44.21.B10.1.454.CMB.1.raw
  modified_base (288)..(288): a, c, t, g, unknown or other
  misc_feature (288)..(288): n is a, c, g, or t
  modified_base (360)..(360): a, c, t, g, unknown or other
  misc_feature (360)..(360): n is a, c, g, or t
  modified_base (665)..(665): a, c, t, g, unknown or other
  misc_feature (665)..(665): n is a, c, g, or t
tcagacagtatatacacgaccggtgctcgatttagtgtcgtcgcaagggggggggtcgtcaggaggcagcgctctcgggacgtctccaccatggcctgggctctgctattcctcaccctcctcacctcagggcacgagggtcctggggactgtctaccctgactcgacgcccgccctcaggtcgtccgggtactcctgggtcaggtccggtcaccattccttctgttccttccagcgtacaacttccacctcggtaccctttaaagtctccttactcagtcggtaccnctaggtcggtcccggaccgaccgacccctaacgttccctcgtttacgaccgttccttcggcggtcctcggcncgtccgtcgtccgtttcgcctcgtacgtcgtcgtcacgtcgtacccgtccgtcgacctctaccaactaaccgtccggtctaggacgactacgcggtctacgtactttacgtttgtacgttcgacttacttacgtttcgtaacttcgtactaacgtaacgtacgttacgtaccgttaacgggtaacggttccggggtacccacggtcgacggtaccgttccgtcgtcgttaccggaccgttaccgaccgtacccaacccgtacgtacgtctaccggtccttccgtcccctccgttacctaacgttntaacgttccgtcgttctacggtacggtcggtaccg

SEQ ID NO: 132063 - DNA, 692 bp, Homo sapiens
  misc_feature: GYAE6OF02GPJ6G.44.21.B10.1.454.CMB.1.raw
  modified_base (184)..(184): a, c, t, g, unknown or other
  misc_feature (184)..(184): n is a, c, g, or t
  modified_base (226)..(226): a, c, t, g, unknown or other
  misc_feature (226)..(226): n is a, c, g, or t
  modified_base (684)..(684): a, c, t, g, unknown or other
  misc_feature (684)..(684): n is a, c, g, or t
tcagacagtatatacacgaccggtgctcgatttagtgtcgtcgcaagggggggggtctcaggaggcagcgctctcaggacgtcaccaccatggcctgggctctgctcctcctcaccctcctacactcgacgggacacgtacgggtccgtcgggccctagtctcgtccctgactcacgccctccncgtcggtccggtcttcgtgacagtcatccactatcctcgtcncacgtcgccaacgagactagtactactaggttggttagttaacttaacttcgtctacgtacgtaaccaacaccgaccgacgaaccaaacctaccctaatcactactattatgtactcgtacgacgtacgccgtccgtacggcggtcctgtactcgttacttcggtcgactacgagtcgcgaacacgccgtacctccgagtaccctgtcgacggtcctacggtcgtacgtgaacgtcgtaggaccgttacgtattaacttacgttcgtacgtaccttacgtactaaggtacgtacggacggtaacggtaacggttaacggttttacgggttacggttacggttaaaccggacgggttaaccggtaaccgtaacccggttaccgtaaccgtccgtaacgtaccgaccgtaacccggaacctacccgacctcgtaccgtctaccgtccgtcccgttacccncgttaacc

SEQ ID NO: 132064 - DNA, 771 bp, Homo sapiens
  misc_feature: GYAE6OF02FWSYF.44.21.B10.1.454.CMB.1.raw
  modified_base (150)..(150): a, c, t, g, unknown or other
  misc_feature (150)..(150): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
tcagacagtatatacacgaccggtgctcgatttagtgtcgtcgcaaggggggggtctcaggaggcagcgctctcaggacgtcaccaccatggcctgggctctgctcctcctcaccctcctcactcagggcacaggatcctggctcagtcngccctggctcagccctcctcgtgtccggtctctggacagtcagtcacctatctccgtncctacgtcggaaaccaagngtcgacggttcggttcgttttcgaccgttgtcctcgtacggtaccagctacgacccgaagaacctaccgaccccaactcgtacttattacgtcgtacgtactagttcgttccgtaccttccggtatcccgtagacgtccgtacgttctcgtcggtacctagttcgtacggacctaaccgaccggtccctcccgtacaccgtacgttcgtaccggtcggtaccctacggacggtacgttacgggaacgggtaccggtacgggttcgttaacgttaacgttttacgttaccgtcggtaccgtaccgttacgtaacttaacgttaaacgtaaacggaacgggttaaccgggtaaactttaccgtttaacggtacgttacccgggacgtaacgggtaacggtaacccgtaaggtcccgtaacggttcccgttaccggtactacccgggtaccgtaacccggtaaccggtcccgttaccccggtaccccggttaccggttacccgttacccgttcccggttcccccgttaccccggtaccccttacccg

SEQ ID NO: 132065 - DNA, 832 bp, Homo sapiens
  misc_feature: GYAE6OF02HYQ36.44.21.B10.1.454.CMB.1.raw
  modified_base (245)..(245): a, c, t, g, unknown or other
  misc_feature (245)..(245): n is a, c, g, or t
tcagacagtatatacacgaccggtgctcgatttagtgtcgtcgcaagagaggaggggggggatctcaggaggcagctctctcggaatatctccaccatggcctgggctctgcctcctcctccaccctcctcactcgaggcacacggatccgtgggctacctagttcctcgcccgtggcctcgccgtccctcccgttccggtcgggttcccgggtcctccgtagggacctgtccgtactccacctnttcctccgtcgactacgtacggaacctaacgtaggtccggacggtttcggttcgtttcggacctcggttctcgtacggtacgtacgtaccgacccgaagaaccaccgacccctaactactaacgtttaacttcgtacggtacttactacgttccgtccgttcccgtttcggtccgtcgtcgtacgtccgttccgtttaccgtggttccggtacgtaacgttcgtaccgacggaacccggtccggtcccctccgttaccgaacccttcgttccggtaccgttcggtccgtaccggtacgggtacgtacggtacgggtaacggtccgggtacgttacggtttaacgtttaacgttaacgtccgtacgtccggttaactaccgtaataaccgttacggtaacgggttaaccgttaaacgtttacccgttaacggttccggttaaccgggtccgttaaacgggaacccgtaacgtacccggtaccgggttaccggtaaccggtaccggtttaccggccggtaaccgaaccggtacccgttccggtccccggttacccggttccgttaccggtaccccgttccggtccccgg

SEQ ID NO: 132066 - DNA, 160 bp, Homo sapiens
  misc_feature: GYAE6OF01EYNBT.3.53.E09.1.454.CMB.1.raw
  modified_base (160)..(160): a, c, t, g, unknown or other
  misc_feature (160)..(160): n is a, c, g, or t
tcagagacgcactccacgaccggtgctcgatttagagagagtgtgttgggtttgggctgaccaaggtcaccgtcctaggtcagcccaaggccaaccccactgtcactctgttcccaccctcctcgagtgcgtctctgagcgggctggcaaggcgcatagn

SEQ ID NO: 132067 - DNA, 184 bp, Homo sapiens
  misc_feature: GYAE6OF01BX9EH.3.53.E09.1.454.CMB.1.raw
  modified_base (127)..(127): a, c, t, g, unknown or other
  misc_feature (127)..(127): n is a, c, g, or t
  modified_base (154)..(184): a, c, t, g, unknown or other
  misc_feature (154)..(184): n is a, c, g, or t
tcagagacgcactccacgaccggtgctcgatttagagagagtgtgtggttggctgacctaaggtcacgtcctaggtcagccaaggccaacccactgtcactctgttcccgcctctcggagtgcgtcnctggagcgggctggcaaggcgcatagnnnnnnnnnnnnnnnnnnnnnnnnnnnnnnn

SEQ ID NO: 132068 - DNA, 160 bp, Homo sapiens
  misc_feature: GYAE6OF02I7EFE.3.53.E09.1.454.CMB.1.raw
  modified_base (160)..(160): a, c, t, g, unknown or other
  misc_feature (160)..(160): n is a, c, g, or t
tcagagacgcactccacgaccggtgctcgatttagagagagtgtgttgggtttgggctgaccaaggtcaccgtcctaggtcagcccaaggccaaccccactgtcactctgttcccgccctcctcgagtgcgtctctgagcgggctggcaaggcgcatagn

SEQ ID NO: 132069 - DNA, 172 bp, Homo sapiens
  misc_feature: GYAE6OF02HUQM6.3.53.E09.1.454.CMB.1.raw
  modified_base (158)..(172): a, c, t, g, unknown or other
  misc_feature (158)..(172): n is a, c, g, or t
tcagagacgcactccacgaccggtgctcgatttagagagagtgtgttgggttggctgaccaaggtcaccgtcctaggtcagcccaaggccaaccccactgtcactctgttcccgccctcctcgagtgcgtctctgagcgggctggcaaggcgcatagnnnnnnnnnnnnnnn

SEQ ID NO: 132070 - DNA, 161 bp, Homo sapiens
  misc_feature: GYAE6OF02HBI8K.3.53.E09.1.454.CMB.1.raw
  modified_base (160)..(161): a, c, t, g, unknown or other
  misc_feature (160)..(161): n is a, c, g, or t
tcagagacgcactccacgaccggtgctcgatttagagagagtgtgttgggtttgggctgaccaaggtcaccgtcctaggtcagcccaaggccaaccccactgtcactctgttcccaccctcctcgagtgcgtctctgagcgggctggcaaggcgcatagnn

SEQ ID NO: 132071 - DNA, 162 bp, Homo sapiens
  misc_feature: GYAE6OF02HP3J1.3.53.E09.1.454.CMB.1.raw
  modified_base (160)..(162): a, c, t, g, unknown or other
  misc_feature (160)..(162): n is a, c, g, or t
tcagagacgcactccacgaccggtgctcgatttagagagagtgtgttgggtttgggctgaccaaggtcaccgtcctaggtcagcccaaggccaaccccactgtcactctgttcccaccctcctcgagtgcgtctctgagcgggctggcaaggcgcatagnnn

SEQ ID NO: 132072 - DNA, 562 bp, Homo sapiens
  misc_feature: GYAE6OF01B5QPF.38.37.D04.1.454.CMB.1.raw
  modified_base (509)..(509): a, c, t, g, unknown or other
  misc_feature (509)..(509): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcaccgctttatcgttacttatgtcagcattcgcacttctgatacctcagcatgcctcacagcacaccttcacagcttacagaaccgctcccctaccaacaacgcaataacgcgtcgctgccgcacgcttcggncagttcggtttacgccccgtttcacttccttcccgctactctcgaacgtgtac

SEQ ID NO: 132073 - DNA, 580 bp, Homo sapiens
  misc_feature: GYAE6OF01EEE16.38.37.D04.1.454.CMB.1.raw
  modified_base (416)..(416): a, c, t, g, unknown or other
  misc_feature (416)..(416): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgtctttatcgttactatgtcagcattcgcacttcngactacctccagcatcgcctcacagcacaccttcacacggcttacagaacgcctacccctaacccaacaacgcaataacgcgtacgctcgccgcagccttcggtgctagttcggtttacgccccgttttcacttccttccccgcctacttcctagtaacgtgac

SEQ ID NO: 132074 - DNA, 581 bp, Homo sapiens
  misc_feature: GYAE6OF01DQ6TH.38.37.D04.1.454.CMB.1.raw
  modified_base (521)..(521): a, c, t, g, unknown or other
  misc_feature (521)..(521): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgttggacaggacccttggtcttccggcgagcgggcttttcacccgtctttatcgttacttatgtcagtcattcgctacttctgactacctcagcatcgcctacacatcacaccttcacacgcttacacgaaccgcctcccctaccaacaacgcaataacgcgtcgctcgccgcagtccttcggtnctagttcggtttacgtccccgttttcacttccttccccgctactctacgtaccgtgtacg

SEQ ID NO: 132075 - DNA, 578 bp, Homo sapiens
  misc_feature: GYAE6OF01A05XW.38.37.D04.1.454.CMB.1.raw
  modified_base (406)..(406): a, c, t, g, unknown or other
  misc_feature (406)..(406): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgcccccgattaacgttggacaggaacccttggtcttccggcgagcgggctttcacccgctttactcgttacttatgtcagcnttcgcacttctgactaacctccagcatcgcctcacagcacaccttcacagcttacacgaacgcctcccctaccaaccaacgcataagcgtcgctgccgcacgcttccggtgcagttcggttacgtccccggtttcactcccgttccccgtccacttctcgtaacggtgtacg

SEQ ID NO: 132076 - DNA, 616 bp, Homo sapiens
  misc_feature: GYAE6OF01C80YZ.38.37.D04.1.454.CMB.1.raw
  modified_base (360)..(360): a, c, t, g, unknown or other
  misc_feature (360)..(360): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggcaacatagccttctccgtcccccttcgcagtaacaccaagtacaggaatattaacctgtttcccatcgactacgcctttcggcctcgccttaggggtcactcaccctgcccgattaacgttgacaggaacccttggcttccggngacgcgggtcttttcgacccgtctttatcgttacttatgtcagctattcgctacttctagactacctcagcatcgcctcacacgcacaccttcacaggcttaacacgaaccgtcctacccctaacccaacaacgacaataacgcgtacgctcgcccgcacggtccttcggtcgtctaacgtttcgggtttaccgtcccccggttttacaccttcccgtttccccgtaccctacttccgttagaaccgttgtaaccg

SEQ ID NO: 132077 - DNA, 572 bp, Homo sapiens
  misc_feature: GYAE6OF01DUFHH.38.37.D04.1.454.CMB.1.raw
  modified_base (466)..(466): a, c, t, g, unknown or other
  misc_feature (466)..(466): n is a, c, g, or t
  modified_base (517)..(517): a, c, t, g, unknown or other
  misc_feature (517)..(517): n is a, c, g, or t
  modified_base (542)..(542): a, c, t, g, unknown or other
  misc_feature (542)..(542): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgtttcccatcgactacgcctttcggcctcgccttaggggtcgactcacccctgccccgattaacgttggacaggaacccttggtcttccggcgagcgggcttttcacccgctttatcgttacttatgtcagcattcgcacttctgatacctccagcatgcctcacagcacaccttcacagcttacagaaccncctacccctaccaacaacgcataacgcgtacgctcgccgcacgtcttcggngccagttcggtttacgccccgtttnacttccttcccgcctatcctgacgtgtaac

SEQ ID NO: 132078 - DNA, 587 bp, Homo sapiens
  misc_feature: GYAE6OF01B1QGN.38.37.D04.1.454.CMB.1.raw
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgtctttatcgttacttatgtcagcattcgcacttctgatacctccagcatgcctcacagcacaccttcacaggcttacagaacgcctcccctaccaacaacgcactaagcgtcgctcgccgcacgccttcggtgcctagttcgggtttacgtcccccggttttcacgttcccttccccgtccctacttcctgtaaccgttgtaacg

SEQ ID NO: 132079 - DNA, 606 bp, Homo sapiens
  misc_feature: GYAE6OF01CUJNH.38.37.D04.1.454.CMB.1.raw
tcagtcgatcacgtcacgaccggtgctcgatttagtagcatactgttgggtttggggtacgatttgatgttacctgatgcttagaggcttttcctggaagcagggcattttgttgcttcagcaccgtagtgcctcgtcatcacgcctcagccttgattttccggatttgcctggaaaaccagcctacacgcttaaaaccgggacaaccgtcgcccggccaacatagccttctccgtcccccttgcagtaacaccaagtacaggaatataacctgtttcccatcgactacgcctttcggcctcgccttaggggtcactcaccctgccccgattaacgttggacaggaacccttggtccttccggcgagcgggtcttttcaccgtctttatcgttacttatgtcagctattcgctacttctgataccctcagcatcgcctcacacgcaccaccttcacaggccttaacacgaacctcctcccctaacccaacaacgcaatacgccgtcgcctacgccgcacgtccgtttccggcgtctacgttcggtttacgtacccccgttttcacgttcccttccccgacctacttcctacggtaacgtgtaaccg

SEQ ID NO: 132080 - DNA, 610 bp, Homo sapiens
  misc_feature: GYAE6OF01BVI2V.38.37.D04.1.454.CMB.1.raw
  modified_base (181)..(181): a, c, t, g, unknown or other
  misc_feature (181)..(181): n is a, c, g, or t
  modified_base (469)..(469): a, c, t, g, unknown or other
  misc_feature (469)..(469): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgatttttccggatttgcctggaaaaccngcctacacgcttaaaccgggacaaccgtcgcccggccaacatagccttctcccgtcccccttgcagtaacaccaaagtacaggaatattaacctgtttcccatcgactacgcctttcggcctcgccttaggggcactcaccctgccccgattaacgtggcaggacccttggtctccggcagcggcttttcaccgtctttatcgttacttatgtcagcattcgctactttctgacttaccctccagtcatcgcctcacagcaacaccttcacaggtcttaacacgaccncctacccctaaccaaaccaacgcaataacgcgtaccgctcgcccacacgtcttacgggtcaccgtagttcggtttaacgtcccccgttttcaccttcccgttccccgacctacgttaccgtacgtaaaccggttgtaaccg

SEQ ID NO: 132081 - DNA, 604 bp, Homo sapiens
  misc_feature: GYAE6OF01BGRLM.38.37.D04.1.454.CMB.1.raw
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgatttttccggatttgcctggaaaaccagcctacacgcttaaaccgggacaaccgtcgcccggcaacatagccttctccgtcccccttcgcagtaacaccaagtacaggaatattaacctgtttcccatcgactacgccttcgcctcgccttagggtcgactcaccctcgcccgattaacgttggactttttaggaacccttggtcttccggcgagcgggtctttcgacccgtctttactcgttacttatgtcagcattcgctacttctgactacctccacgcatcgcctcacagcacaccttcacacgcttacacgaaccgcctcccctaacccaacaaccgcaactaacgccgtcgctcgcccgcacgcgttcggtcgactagttcggtttacgtccccgtttcctacgttcccttcccgccctacttaccgtcgtaacgtcggtaacg

SEQ ID NO: 132082 - DNA, 618 bp, Homo sapiens
  misc_feature: GYAE6OF01CGQ1V.38.37.D04.1.454.CMB.1.raw
  modified_base (368)..(368): a, c, t, g, unknown or other
  misc_feature (368)..(368): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttagggtcactcaccctgccccgattacgtgacagacctgtctcggcagcggctttcaccgtntttatcgttacttatgtcagctattcgctacttctagacttaccctccagtcatcgccctcaacacgccactacccttcacacggtacttaacacgtaaccgccctaccccctaacccaaaccaacgaccaataacgccgtcgcctcgcccgcacgtccgttccggtcgaccgtaggttcggttttaccgtcccccgttttcacctttcccttccccgtaccttacttaccttacggtaacgtcgtaacg

SEQ ID NO: 132083 - DNA, 673 bp, Homo sapiens
  misc_feature: GYAE6OF01EPA3E.38.37.D04.1.454.CMB.1.raw
  modified_base (384)..(384): a, c, t, g, unknown or other
  misc_feature (384)..(384): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgcctttcggcctcgccttaggggtcactcaccctgccccgattaacgttggacacggaacccttggtcttccggcgagcgggtcttttcacccgtntttactcgttacttatcgtcagtctattcgctactttctgtactaccctccagcatcgcctcacagccaactaccttcaacgacggtaccttaacgaacgtacccgtccctaccccctaacccaaaccgaaccgacctaactaaacggccgttaccgccgttcgacccgtacgtacgtccgtttaccgggtcgaccgttacgtttcgggttttaacccgtcccccggttttaccacccgtttcccttaccccggcctaacgttaccgtaacgtaaccggttgtaacccg

SEQ ID NO: 132084 - DNA, 766 bp, Homo sapiens
  misc_feature: GYAE6OF01DPQSV.38.37.D04.1.454.CMB.1.raw
tcagtcgatcacgtcacgaccggtgctcgatttagtagcatactgttgggtttggggtacgatttgatgttacctgatgcttagaggtcttttcctggaagcagggctatttgttgcttcagccaccgtagtgcctcgtcatcacgcctcagtccttgtacttttccggatttcgcctaggaaaaccagcctacacgtacttaaaccgggacaaccgtccgcccggacaacatacgccttcctcccgtcccccttgacacgtaaccaccaagtacaaggtaacttaacttaaccttgtttacccatcgactaccgtccgtttcggcctcgtccgttacggggtcacctcaccctcgccctattacgtggacacggtaccttggtcttccggcgacgtcgggttccttttcgaccgtcttttactcgttacttatcgtcagtctacttcgcttacctttctacggtaacttaccctccacgtcctacgtcgtaccctacgacctacgaccctaacctaacccgttcaaccgtacgggtacccttaaaccgaaccgtaaaccctccccgttaaccccctaacccaaacgaaccgtacctaaacgtaaccgtacccggttccgaccgttccggacccgtacgaccggttccgttcgggtaccgtacgttaacggtttccggtttacccgttccccgttttacctacccgtttaccccgttccccggtacccttaacgttcccgttaaccgtaaacgttcggttaacccg

SEQ ID NO: 132085 - DNA, 817 bp, Homo sapiens
  misc_feature: GYAE6OF01CZGKT.38.37.D04.1.454.CMB.1.raw
  modified_base (409)..(409): a, c, t, g, unknown or other
  misc_feature (409)..(409): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgtattttccggatttgcctaggaaaaccagcctacacgcttaaaccgggacaaccgtcgcccgcaacatacgccttcctcccgtccccccttgctaacgtaaccacctaagtacaggaatacttaacctcgtttcccatcgactacgtccttcggcctcgccgttaggggtcactcaccctcgacccgtattacgtggacaggacccttggtccttccggcgagtcggtctttccgaccgtctttatcgttacttntcgtcagtctattcgactacttcgtagaccttacctccatccaacgttcgaccctccaacacgaccctaacctacccttacaccgtacgggtacctttaaaccgaacgtaaacccgtacccccttaacccccccgtaaacccccaaaaccgtaaacccgtaaccctaaacgttaaaccggggtccccgttacccggcccgtttacccggacccccggtaccgtaaccgggtttaccccggtttacccggggtcgttaaccgttaaccgggtttttacccggggttttaaaccccggttttcccccccggttttaccgtttaacccccgtttcccccggtttacccccccgtacccttaaccgttttaccccggttaaacgggttaaacccgttccggttaaacccggg

SEQ ID NO: 132086 - DNA, 701 bp, Homo sapiens
  misc_feature: GYAE6OF01AX1Y7.38.37.D04.1.454.CMB.1.raw
  modified_base (184)..(184): a, c, t, g, unknown or other
  misc_feature (184)..(184): n is a, c, g, or t
  modified_base (601)..(601): a, c, t, g, unknown or other
  misc_feature (601)..(601): n is a, c, g, or t
tcagtcgatcacgtcacgaccggtgctcgatttagtagcatactgttgggtttggggtacgatttgatgttacctgatgcttagaggtctttttcctggaagcagggcatttgttgcttcagcaccgtagtgcctcgtcatcacgcctcagccttgatttttccggatttgcctaggaaaaccngcctacacgcttaaaccgggacaaccgtcgcccgccaacatagccttctcccgtccccccttcgcagtaacaccaagtacagaatattaacctgtttcccatcgactacgcctttcggcctcgccgttaggggtccactccacccctcgcccccgtatttaacggttggacctacggaaccctttggtccttccggcgagccggtcttttccacccgtcttttactcgtttaacttatcgtacacgtctattccgcctactttactgtaaccttccctcctaggacctagtcgtccctccactaacgcccaacctacccttccaaccgacggtaccttaccaaaccgtaacccgaccccttacccccctaacccaaacccaaccgcaaccgtaacggcgtaccggtctccggacccncgaccgtcggttcggtacgcttacggtttccggtttaccgtccccgtttactcccttcccgttccccgcccttaactccgttacgaaccggttgtaaccg

SEQ ID NO: 132087 - DNA, 746 bp, Homo sapiens
  misc_feature: GYAE6OF01C3R67.38.37.D04.1.454.CMB.1.raw
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgtattttccggatttgcctaggaaaaccagcctacaccgaccttaaaccgggaccaaccgtccgcccggaccaacactacgcccttcctccccgtccccccttcgcaacgtaaccaccaagtaccaggtaactattaacctgttcccatcgactacgtccttcgcctcgccgttagggcctactccaccctcgaccccgtaattacgttcggacacggtacccttggtaccttccggcgtacgtcgggtccttttccgacccgttctttacgttccgtttacttagttcggtacacgtctacgttccgacttacctttcgacgtacttacccctcgacgtctacgtaccgtccttaccgacacgaccctaacctacccgttacacgtacggtaccttaaccgaccgacccgtaccctaccccctaaccaaccgaaccgtccgaaacgtaccggtaccggtcccgtaccgtcgaccccgacgtaccggttccgtttccggccgtacgtacggtttccggtttacccgtaccccgtttctacccgttcccgttaccccgtaccgttaccttccggtacgtaacgttcgtaaccgg

SEQ ID NO: 132088 - DNA, 692 bp, Homo sapiens
  misc_feature: GYAE6OF01D6LS9.38.37.D04.1.454.CMB.1.raw
  modified_base (450)..(450): a, c, t, g, unknown or other
  misc_feature (450)..(450): n is a, c, g, or t
  modified_base (563)..(563): a, c, t, g, unknown or other
  misc_feature (563)..(563): n is a, c, g, or t
  modified_base (586)..(586): a, c, t, g, unknown or other
  misc_feature (586)..(586): n is a, c, g, or t
  modified_base (601)..(601): a, c, t, g, unknown or other
  misc_feature (601)..(601): n is a, c, g, or t
  modified_base (622)..(622): a, c, t, g, unknown or other
  misc_feature (622)..(622): n is a, c, g, or t
  modified_base (649)..(649): a, c, t, g, unknown or other
  misc_feature (649)..(649): n is a, c, g, or t
tcagtcgatcacgtcacgaccggtgctcgatttagtagcatactgttgggtttggggtacgatttgatgttacctgatgcttagaggtcttttcctggaagcagggcatttgttgcttcagcaccgtgtgcctcgtcatcacgcctcagtccttgtacttttccggatttcgcctaggaaaaccagcctacacgaccttaaaccgggacaaccgtccgcccgaccaacactacgcccttcctccccgtccccccttcgcaacgtaaccaccaagtacaggtaatactttaacctcgtttacccatccgacctaccgtcctttccggcctccgtccgttacggggtcctacctccacccgtcgtaccccgtagttaccggtggaacctacggtaacccttggtcgtccggcgtacggtccggtcctttcgacccttgttactcgttacttntcgtcgagtctacgttcgtacctacttcgtacgtactacccctacacgtaccgactccgtaccctacgacctaccgtaccctacctacccgtctaaccgacggttactacganaccgtccctaccaacacctaacnctaagtcgctccgcnccgctacgacgtccgtggtcncgttacgttcggttaccctccgttccnccttcccgttcccgactaccgtactacgggtaacctggtaccg

SEQ ID NO: 132089 - DNA, 725 bp, Homo sapiens
  misc_feature: GYAE6OF01BYR6N.38.37.D04.1.454.CMB.1.raw
  modified_base (186)..(186): a, c, t, g, unknown or other
  misc_feature (186)..(186): n is a, c, g, or t
  modified_base (228)..(228): a, c, t, g, unknown or other
  misc_feature (228)..(228): n is a, c, g, or t
  modified_base (394)..(394): a, c, t, g, unknown or other
  misc_feature (394)..(394): n is a, c, g, or t
  modified_base (445)..(445): a, c, t, g, unknown or other
  misc_feature (445)..(445): n is a, c, g, or t
tcagtcgatcacgtcacgaccggtgctcgatttagtagcatactgttgggtttggggtacgatttgatgttacctgatgcttagaggtcttttcctggaagcagggctatttgttgcttcagcaccgtgtgcctcgtcatcacgcctcagtccttgtacttttccggatttcgcctaggaaaaccngcctacacgacttaaaccgggacaaccgtccgcccgacaacntacgccttcctcccgtccccttgcaacgtaacaccaagtacaggtaatacttaacctgttcccatcgactacgtccttcggcctcgcgttaggggtcactccgacctgaccccgtattacgtcgacacgtaccttggtcctcgcgacgtcggtctttccgaccgtntttagtccgttattgtcgtacacgtctattcgctacttcagtacttacccncgagacctcgtcgcctacacgtacgccacctacttacacgtcgtaccttaacgaccgtaacctccctacccctaacgaaacctaacggtctaaacgtacgtccgtacccgacgttaccgacccggtataacccggttccgtttccgggtactaacccggtttaacggttttcccgggtttaaccccggttacccccggttttaccctaaccgtttcccccgtttaacccccggtcttaacccgttaccggttaaccggtaacggtttccggtaaacccgg

SEQ ID NO: 132090 - DNA, 848 bp, Homo sapiens
  misc_feature: GYAE6OF01ERBG2.38.37.D04.1.454.CMB.1.raw
  modified_base (96)..(96): a, c, t, g, unknown or other
  misc_feature (96)..(96): n is a, c, g, or t
  modified_base (189)..(189): a, c, t, g, unknown or other
  misc_feature (189)..(189): n is a, c, g, or t
  modified_base (543)..(543): a, c, t, g, unknown or other
  misc_feature (543)..(543): n is a, c, g, or t
  modified_base (718)..(718): a, c, t, g, unknown or other
  misc_feature (718)..(718): n is a, c, g, or t
tcagtcgatcacgtcacgaccggtgctcgatttagtagcatactgttgggtttggggtacgatttgatgttacctgatgcttagaggtcttttccnggaagcagggctatttgttgcttcagcaccgtagtgcctcgtcatcacgcctcagtccttgtacttttccggatttgaccctaggaaaacccngccctacgacgtaccgttaaaacccgggaccaaccgtccggaccccggaccaaactactacggtcccctttcccgtcccccgttccccccttgacctaacgtaaacccacctaaagtacaacggtaattacttaaccttcgtttacccagtccgaaccgttaccgtcccgttttccggaccttccgtaccggtttaaggggtcccacctccccacccgtcggtacccctagtttaaccggtcggaaccgtaccggtacccgtttcggtccgtccgggaccggtacggtcccggggtttacccttttaccccgaacccgttctttttaaccgttacggtttacttgtacggtacngttccttaacgtccgtaccttactttcgtacgttaaccctacccttacgacgtacctacgtccgtacctaccgacctaccgtaccctaaccgtaccttacgaccgtacgtactaaccgaccgtaccgtacccctaacccaaccaaccaccgtacctaacgtaaccgccggtaccnccgtccgaccgtacgtcgttccggttcggtaccgacgtttaccggtttcggtttaccccgtttacccgttcccttaccgttccccgttcccgtaccctaccgttaaccgtacggtacccgtcgtacccgg

SEQ ID NO: 132091 - DNA, 617 bp, Homo sapiens
  misc_feature: GYAE6OF01BSWFZ.38.37.D04.1.454.CMB.1.raw
  modified_base (364)..(364): a, c, t, g, unknown or other
  misc_feature (364)..(364): n is a, c, g, or t
  modified_base (407)..(407): a, c, t, g, unknown or other
  misc_feature (407)..(407): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacacaagtacagaatattaacctgttccatcgactacgctttcgcctcgccttagggtcgactcaccctgcccgattacgtgacagtacctgtctcgcgagcggtctttcaccgtnttactcgttacttatgtcagcattcgcacttctcgacttaccnctagctatcgcctcacacgcacctaccttcacgacggtctacagacccgtcctaccccctaacccaaaccaacgacctaacgtaaccgccgtaccgccgtcgtcccgagacggtccttccgggtcacgtacgtttcgggtttaacccgtcccccgtttctactttccccgttccccgtacctaacttccgtacgtaacgttcgtaaccgg

SEQ ID NO: 132092 - DNA, 1020 bp, Homo sapiens
  misc_feature: GYAE6OF01AGHG8.38.37.D04.1.454.CMB.1.raw
  modified_base (186)..(186): a, c, t, g, unknown or other
  misc_feature (186)..(186): n is a, c, g, or t
tcagtcgatcacgtcacgaccggtgctcgatttagtagcatactgttgggtttggggtacgatttgatgttacctgatgcttagaggcttttcctggaagcagggtctatttgttgcttcagcaccgtagtgcctcgtcatcacgcctcagtccttgtattttccggatttgacctaggaaaaccngtcctacacgacgttaaacccggactaaccgtccgcccggacaacatacgccttcctcccgtcccccttcgacaacgtaaccaaccgaagttaccgaaggtaactttaactttaaacccgtttcgttttaccccgagtttaccggtaacccgttacccggttcccgtttttacccgggccctttcccggggttaccccggttttaacggggggttacccgtaacccgttacccccgtaaccccccggttaccccggtaaccccccggttaaaggtttttaaacccggggttttaccgggaaacccgttaacccggggtaaaacccccggtttttcggggtttacccggtttaccccggggtaaccggtaccggggtttccccgggggttacccgttttttccccgggacccccggttttaccgttttttaacgtttaccccggtttttaaacgtttttaaccgttcggttaccccgtaacggttcccgttaaaccgttttcccggtaacctttaacccggttttacccgttaaacggtaaccccgtttaacccccgttacccgtaaccgtaccttaacgttacccgtacccgttacgaacccgtacgacccctaaacctacccgttacaaccgtacggtacctaaccgacgtacccgccctaacccctaaccaacctaacgctaacgacggtccgtcgtaccgtccgacccggtacgtaccgttcggttccgccggtacgttacggtttccggtttaccccggttaccccgtttctacccggtttcccccttccccggtaccttacgttacggtaccggttaacgttgtacccg

SEQ ID NO: 132093 - DNA, 630 bp, Homo sapiens
  misc_feature: GYAE6OF01A4AD5.38.37.D04.1.454.CMB.1.raw
  modified_base (487)..(487): a, c, t, g, unknown or other
  misc_feature (487)..(487): n is a, c, g, or t
  modified_base (583)..(583): a, c, t, g, unknown or other
  misc_feature (583)..(583): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccggacaaccgtcgcccgcaacatagccttctccgtccccctgcagtaacacaagtacaggaatattaacctgttcccatcgactcgcctttcggcctcgccttaggggcactcacctgcccctattaacgtggaccaggaacccttggtccttccggcgtacgcgggtcttttccaccgtctttacgtcgttacttatgtacagtctacttcgctacttctgactacctccagtcatcgcctacgactacgccctaacctaccttacacgacgtccttaacgacgtaccnccctaccccaaccaacgaacgctaaacgtacgccgttacgcctacgcccgacacgtcgttcggctacgttacgttcggtttaacctccccgtttanaccgttcccttacccgtacctacgttactacggtaaccgttgtaccg

SEQ ID NO: 132094 - DNA, 552 bp, Homo sapiens
  misc_feature: GYAE6OF02HD7Y5.38.37.D04.1.454.CMB.1.raw
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttagggtcgactcaccctgccccgattaacgttggacaggaacccttggtcttccggcgagcgggcttttcacccgcttatcgttacttatgtcagcattcgcacttctgatacctccagcatgcctcacagcacaccttcacaggcttacagaacgctcccctacccaacaacgcataagcgtcgctgccgcagcttcggtgcagtggtttacgccccgtttcactcttcccgcatctgacgtgac

SEQ ID NO: 132095 - DNA, 551 bp, Homo sapiens
  misc_feature: GYAE6OF02IVI7I.38.37.D04.1.454.CMB.1.raw
  modified_base (463)..(463): a, c, t, g, unknown or other
  misc_feature (463)..(463): n is a, c, g, or t
  modified_base (508)..(508): a, c, t, g, unknown or other
  misc_feature (508)..(508): n is a, c, g, or t
tcagtcgatcacgtcacgaccggtgctcgatttagtagcatactgttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctccgtcccccttcgcagtaacaccaagtacaggaatattaacctgtttcccatcgactacgcctttcggcctcgccttagggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacnctcccctaccaacaacgcataagcgtcgctgccgcagcttcggtncagtggtttacgcccgtttcatccttcccgcatctgacgtgac

SEQ ID NO: 132096 - DNA, 554 bp, Homo sapiens
  misc_feature: GYAE6OF02H3MVY.38.37.D04.1.454.CMB.1.raw
  modified_base (507)..(507): a, c, t, g, unknown or other
  misc_feature (507)..(507): n is a, c, g, or t
  modified_base (528)..(528): a, c, t, g, unknown or other
  misc_feature (528)..(528): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttactatgtcagcattcgcacttctgatacctccagcatgcctcacagcacaccttcacaggcttacagaacgctcccctaccaacaacgcataacgcgtcgctgccgcagcttcggngcatggtttacgccccgtttnactccttcccgcctatctgacgtgac

SEQ ID NO: 132097 - DNA, 562 bp, Homo sapiens
  misc_feature: GYAE6OF02JJRM6.38.37.D04.1.454.CMB.1.raw
  modified_base (500)..(500): a, c, t, g, unknown or other
  misc_feature (500)..(500): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttagggtcactcaccctgccccgattaacgttggacaggaacccttggtcttccggcgagcgggcttttcacccgctttatcgttacttatgtcagcattcgcacttctgatacctccagcatcgcctcacagcacaccttcacaggcttacagaacgcctacccctacccaacaacgcataagcgtcgctgccncagcttcggncagtcggtttanccccgtttcacttccttcccgcctatcctagaccgtgtac

SEQ ID NO: 132098 - DNA, 551 bp, Homo sapiens
  misc_feature: GYAE6OF02JEK7A.38.37.D04.1.454.CMB.1.raw
  modified_base (461)..(461): a, c, t, g, unknown or other
  misc_feature (461)..(461): n is a, c, g, or t
  modified_base (507)..(507): a, c, t, g, unknown or other
  misc_feature (507)..(507): n is a, c, g, or t
  modified_base (528)..(528): a, c, t, g, unknown or other
  misc_feature (528)..(528): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgttggacaggaacccttggtcttccggcagcgggcttttcacccgctttatcgttacttatgtcagcattcgcacttctgatacctcagcatgcctcacagcacaccttcacaggcttacagaacnctcccctaccaacacgcataacgcgtacgctagccgcagcttcggncagttggttacgccccgtttnactcctcccgcatctgacgtgac

SEQ ID NO: 132099 - DNA, 563 bp, Homo sapiens
  misc_feature: GYAE6OF02FKZF6.38.37.D04.1.454.CMB.1.raw
  modified_base (526)..(526): a, c, t, g, unknown or other
  misc_feature (526)..(526): n is a, c, g, or t
tcagtcgatcacgtcacgaccggtgctcgatttagtagcatactgttgggtttggggtacgatttgatgttacctgatgcttagaggcttttcctggaagcagggcatttgttagcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgcccccgattaaccgttggacaggaacccttggtcttccggcgagcgggcttttcacccgctttatcgttacttatgtcagcattcgcacttctgatacctccagcatcgcctcacagcacaccttcacaggcttacagaacgcctcccctaccaacaacgcatacgcgtcgctgccgcagcttcggtgcagtcggttacnccccgtttcacttccttcccgcctatctgacgtgacg

SEQ ID NO: 132100 - DNA, 627 bp, Homo sapiens
  misc_feature: GYAE6OF02H6I0P.38.37.D04.1.454.CMB.1.raw
  modified_base (181)..(181): a, c, t, g, unknown or other
  misc_feature (181)..(181): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggattttgcctggaaaaccngcctacacgcttaaaccgggcaaccgtcgcccggccaacatagccttctccgtcccccttcgcagtaacaccaagtacaaggaatattaacctgtttcccatcgactacgcctttcggcctcgccttagggtcgactcaccctcgccccgattaacgttggacaggaacccttggtcttccggcgagcgggtcttttcacccgtctttatcgttacttatgtcagctattcgctacttctgacttaccctcacgcactcgcctcacacgcacctacctcacacgtacttacgacgaaccgcctacccctaacccaaaccaaccgaccaactaacgccgtcgctcgccgcacgggggtcttcggtcgcgtacgttcggtttaccgttccccgtttacctaccttcccgtttccccgtccctaccttccgtacgtaccgtacgtaacg

SEQ ID NO: 132101 - DNA, 595 bp, Homo sapiens
  misc_feature: GYAE6OF02IMSO3.38.37.D04.1.454.CMB.1.raw
  modified_base (505)..(505): a, c, t, g, unknown or other
  misc_feature (505)..(505): n is a, c, g, or t
  modified_base (540)..(540): a, c, t, g, unknown or other
  misc_feature (540)..(540): n is a, c, g, or t
  modified_base (555)..(555): a, c, t, g, unknown or other
  misc_feature (555)..(555): n is a, c, g, or t
  modified_base (591)..(591): a, c, t, g, unknown or other
  misc_feature (591)..(591): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttagggtcgactcacctcgccccgtattaacgtgacaggaacccttggtcctccggcgagcgggtcttttcacccgtctttactcgttacttatgtcagcacttcgctacttctagactacctccagcatcgcctcacacgcactaaccttcaacgacggtcttaaccagaaaccgcctaccccctaaccaaaccgaacncaactaacgcgtaccgctcgccgcagtcctcgtancagttcgggttaccncccgtttcacttcctacccgcctactcctagacgtntacg

SEQ ID NO: 132102 - DNA, 599 bp, Homo sapiens
  misc_feature: GYAE6OF02GJ05U.38.37.D04.1.454.CMB.1.raw
  modified_base (361)..(361): a, c, t, g, unknown or other
  misc_feature (361)..(361): n is a, c, g, or t
  modified_base (469)..(469): a, c, t, g, unknown or other
  misc_feature (469)..(469): n is a, c, g, or t
  modified_base (491)..(491): a, c, t, g, unknown or other
  misc_feature (491)..(491): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctcccgtcccccttcgcagtaacaccaagtacaggaatattaacctgtttcccatcgactacgcctttcggcctcgccttaggggtcactcaccctgccccgattaacgtgacaggacccttggtctccggngagcgggtctttcgaccgtctttatcgttacttatgtcagcattcgctacttctgactaccctccagcatcgcctcacagcacaccttcacacgcttaacacgaaccnccctacccctaccaaccaaccncaataacgcgtccgctcgccgaccgacgtccttcggtcgctacgttcggtttaccgtccccgtttctacgttcccttcccggccttactccgtacgtaccgtagtacg

SEQ ID NO: 132103 - DNA, 587 bp, Homo sapiens
  misc_feature: GYAE6OF02I4LAY.38.37.D04.1.454.CMB.1.raw
  modified_base (495)..(495): a, c, t, g, unknown or other
  misc_feature (495)..(495): n is a, c, g, or t
  modified_base (527)..(527): a, c, t, g, unknown or other
  misc_feature (527)..(527): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgccttcggcctcgccttaggggtcgactcaccctgccccgattaaccgttggacaggaacccttggtcttccggcgagcgggcttttcacccgtctttatcgttacttatgtcagcattcgctacttctgatacctccagcatgccctcacagcacaccttcacaggcttacacgaaccgcctcccctaacccaacaacgacctanaacgccgtcgccgtcgccgcacgcttcggtcncgtagttcggtttacgtccccggttctacttcctcccgcctattcctcgtacgtcgtacg

SEQ ID NO: 132104 - DNA, 587 bp, Homo sapiens
  misc_feature: GYAE6OF02FU4S2.38.37.D04.1.454.CMB.1.raw
  modified_base (181)..(181): a, c, t, g, unknown or other
  misc_feature (181)..(181): n is a, c, g, or t
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
  modified_base (521)..(521): a, c, t, g, unknown or other
  misc_feature (521)..(521): n is a, c, g, or t
  modified_base (534)..(534): a, c, t, g, unknown or other
  misc_feature (534)..(534): n is a, c, g, or t
  modified_base (556)..(556): a, c, t, g, unknown or other
  misc_feature (556)..(556): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgatttttccggatttgcctggaaaaccngcctacacgcttaaaccgggacaaccgtcgcccggccaacatagccttctccgtccccccttgcagtaacaccaagtacaggaatattaacctgtttcccatcgactacgctttcgcctcgccttagggcgactcaccctgccccgattaacgttggacaggaacccttggcttccggngagcgggcttttcacccgtcttttancgttacttatgtcagcattcgctactttctgacttaccctccagctatcgccctcactagccacctaccttcacaggtcttaacacgaaccgcctacccctaacccaacaacgcaactaacgccgtcgctcgccncacgtcgttcggncagttcggttactccccgtttnacttcctcccgctactcgtacgacgtgtacg

SEQ ID NO: 132105 - DNA, 669 bp, Homo sapiens
  misc_feature: GYAE6OF02H2JK8.38.37.D04.1.454.CMB.1.raw
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccggccaacatagccttctcccgtcccccttcgcagtaacaccaagtacaggaatattaacctgtttaccatcgactacgcctttcggcctcgccttaggggtcactcaccctgccccgtattaacgttggacaggaacccttggtcttccggcgaggcggtcttttcgacccgtctttactcgttacttatgtcagctattcgctacttctgtacttaccctcagtcatcgccctacacacgcctaacctaccttcacgtacggtaccttaacgacgaaaccgtcccttacccctaaacccaaccaacgacctaactaacggccgttccgaccgttacgcccgacacgtccgtttcgggacgtaccgtacggtttccgggttttacccgttccccggttttacaccgtttccccgtttccccgccttacttccggtacggtaccgttcgtaaccg

SEQ ID NO: 132106 - DNA, 607 bp, Homo sapiens
  misc_feature: GYAE6OF02J2U2J.38.37.D04.1.454.CMB.1.raw
  modified_base (180)..(180): a, c, t, g, unknown or other
  misc_feature (180)..(180): n is a, c, g, or t
  modified_base (474)..(474): a, c, t, g, unknown or other
  misc_feature (474)..(474): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgctaaacgggcaaccgtcgcccggcaacatacgccttctcccgtcccccttcgcagtaacaccaagtacaggaatattaacctgtttcccatcactacgcctttcggctcgccgttagggcactcacctgacccattaacgtgactacggaccttggtcctcggcgaggtcggtctttcacccgtctttatcgttacttatgtcagtcacttccgactacttctcgtactcccacagccatcgacctcactacgccaccacttcacgacgtctaacgacgtaaccncctacccaacaacaacgctaacgtacgcgcgctcgccgcgtcgtcgttacggtcgtacgttacggttccgttccgtacccttaccgaccgttaccctaccgtacgtaccgttacgtacggtacgtacgtacgg

SEQ ID NO: 132107 - DNA, 596 bp, Homo sapiens
  misc_feature: GYAE6OF02HFOO7.38.37.D04.1.454.CMB.1.raw
  modified_base (532)..(532): a, c, t, g, unknown or other
  misc_feature (532)..(532): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcactcaccctgccccgattaacgttggacaggaacccttggtcttccggcgagcgggcttttcacccgtctttatcgttacttatgtcagcattcgctactttctgactaccctccagcctatcgcctcacagccacaccttcacacggtcttacacgaccgcctacccctacccaacaacgaccagtaacgccgtcgctcgccgacacgtcttcggncagttcggtttacgtccccgtttcacctttccgttccccgctaccttcgtacgtacgtgtaccg

SEQ ID NO: 132108 - DNA, 680 bp, Homo sapiens
  misc_feature: GYAE6OF02H3VDR.38.37.D04.1.454.CMB.1.raw
  modified_base (433)..(433): a, c, t, g, unknown or other
  misc_feature (433)..(433): n is a, c, g, or t
  modified_base (457)..(457): a, c, t, g, unknown or other
  misc_feature (457)..(457): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggcaaccgtcgccccggcaacatacgccttctcccgtcccccttgcagtaacaccaagtacaggatacttaacctgtttccatccgactacgtcctttcgcctcgccgttaggggtccactccaccctcgcccgtattacgtggacaggacccttggtcctccggcgagtcgggtcttttccgaccgttactttatcgtttacttatcgttcagtcctattcgactacttctnactacctcctagcatcgcctcacncaccaccaccttcacgacgtacttaacgacgaaccgtcctacccctaacctaaccaaccgtcaaacgttaacgccgttaccgtaccgtccggtacccgacgtaccgtccgtttaccggtcgtaccgttacggtttacggggttttaacccgtccccggttttactaacccgttcccgtttaccccggaccttacgttacccgttacggtacggttcgtaacgg

SEQ ID NO: 132109 - DNA, 610 bp, Homo sapiens
  misc_feature: GYAE6OF02F2I96.38.37.D04.1.454.CMB.1.raw
  modified_base (400)..(400): a, c, t, g, unknown or other
  misc_feature (400)..(400): n is a, c, g, or t
  modified_base (446)..(446): a, c, t, g, unknown or other
  misc_feature (446)..(446): n is a, c, g, or t
  modified_base (523)..(523): a, c, t, g, unknown or other
  misc_feature (523)..(523): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttacccatcgactacgcctttccggcctcgccttaggggtcgactcaccctgccccgattacgttggacacggaaccctggtcttccggcgagcggcttttcacccgtctttatcgttacttatntcagctattcgctacttctgtactacctacccagcactgcctcacngcacaccttcacagtacttacacgaaccgccttacccctaccaacgaaccgacaagtaacgccgtccgactcgcccnacggtaccgttcgtacgcgtacgttgggtttaccgtaccccgtttctacgttcccgttcccgcctacttcctacggaccgtgtaacg

SEQ ID NO: 132110 - DNA, 687 bp, Homo sapiens
  misc_feature: GYAE6OF02FN5RU.38.37.D04.1.454.CMB.1.raw
  modified_base (467)..(467): a, c, t, g, unknown or other
  misc_feature (467)..(467): n is a, c, g, or t
  modified_base (606)..(606): a, c, t, g, unknown or other
  misc_feature (606)..(606): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgtattttccggatttcgcctaggaaaaccagcctacacgcttaaaccggacaaccgtccgcccggcaacatacgccttctcccgtccccccttcgcagtaaccaccaagtacaggaattacttaacctgttcccatccgactaccgcctttcggcctcgtccgttaggggtcacctccacccctcggcccccgtaagtttaaccggttcggaaccacggtaaccccgtttcgggtaccgtttcccgggcggtacggtccggggttccttttcccaccccgttcttttactccgtttatttactcgtcacgtctnttcgcctactttcgtcgtacttaccctccagtctactcgccctacacctacgccaacctaccttcgaccgaggtaccttaacgacgaaccgtccctacccctacccaaacacgcctaagtacgcgtcgcctacgccacncgtcgtcggctcgtacgttcggttaccgttcccgttactacttcccgttacccgtctacgtacgtacggttacgtactacg

SEQ ID NO: 132111 - DNA, 623 bp, Homo sapiens
  misc_feature: GYAE6OF02JCCO3.38.37.D04.1.454.CMB.1.raw
  modified_base (180)..(180): a, c, t, g, unknown or other
  misc_feature (180)..(180): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (437)..(437): a, c, t, g, unknown or other
  misc_feature (437)..(437): n is a, c, g, or t
  modified_base (582)..(582): a, c, t, g, unknown or other
  misc_feature (582)..(582): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatagccttctcccgtcccccttgcagtaacaccaagtacaggaatacttaacctgtttccaatcgactacgcctttcggcctcgaccgttagggtcactcaccctgacccattaacgtgacaggtaaccctgtctcggngagcggtntttcgaccgtntttagcgttacttagtcgtacacgctattcgctaactctcgactacctccagctatccncctctacagtccactacccttacacgagtccttaacaacgaacccgtacctacccccttaacaaacaaccgtctaacgtaacgccgtaccgcctacgccgacgtacgtccgttcggcgtaacgagtttcgtttaccgccctttanccgttcctacccgtccacttcgtaaccggtacgtctaacgg

SEQ ID NO: 132112 - DNA, 664 bp, Homo sapiens
  misc_feature: GYAE6OF02GB8MT.38.37.D04.1.454.CMB.1.raw
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (220)..(220): a, c, t, g, unknown or other
  misc_feature (220)..(220): n is a, c, g, or t
  modified_base (390)..(390): a, c, t, g, unknown or other
  misc_feature (390)..(390): n is a, c, g, or t
  modified_base (436)..(436): a, c, t, g, unknown or other
  misc_feature (436)..(436): n is a, c, g, or t
tcagtcgatcacgtcacgaccggtgctcgatttagtagcatactggttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctanacgcttaaaccgggacaaccgtcgcccgcaacntagccttctccgtccccctgcacgtaacaccaagtacagatattaacctgttcccatcgactacgcctttcggcctcgccttaggggtcactcaccctgccccgtaattacgttggacagggtaacccttggtaccttccgggcgaggtccgggtcctttccgacccgtntttactcgttaacttgtcgtcacggtcacttcgacacctttcgtanactaccctccaagtcactcgaccctcacagcctactaccctacacgacggtacttacgaacgaaccgtcctacccctaacccgaaacaaccgtcaaacctaacggtccgtacgtccgtacgtcccgctaacgtccttacggtacgtacgtaacggtttcgggttaccttcccccgtttagtaccgttcccgttaccccgtctaccgttcctacggtacgtcgtaaccg

SEQ ID NO: 132113 - DNA, 938 bp, Homo sapiens
  misc_feature: GYAE6OF02JHECW.38.37.D04.1.454.CMB.1.raw
  modified_base (181)..(181): a, c, t, g, unknown or other
  misc_feature (181)..(181): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgacgttaaaccgggacaaccgtcgcccggccaacatacgccttcctcccgtccccccttcgctacgtaaccaccaagtacaggaatacttaacctgtttacccataccgactaccgtcctttccggccctcgtccgttaggggtccaccttccgacccctcgacccccgtagtttaaaccgttcggaccgtaacgggtaaccccttgggttaccttcccggggcgacgggtccggggttcctttttacccgaccccggttcttttaacgtccgttttaaccgtttatcggttaccaggtccttaacgtttccgacttacctttacgtacgtaacttaccccgtacctaacgtacctacgttaccggaccccttacgaacctacggtaccctaaaccgtaccccgtttaaccaaccggtacggtaacccgtttaaccgaaccggtaaaccccggtaccccctttaacccccccgtaaaccccgtaaaacccgtaaacccgtaccgtaaaaccggttaaacccggtacccggttacccggtacccgtacccggtaccccgtaccgtaaccgggttacccggtttacccgggttacgacccgtttaacgggttttaacccgggtttttaaccccggttacccccccggtttttaacttaacccccgggtttaccccccgttttaccccccggtaacccgtttaccggtttaccccggttaaccgggttaaccccggtttaccgtaacccggg

SEQ ID NO: 132114 - DNA, 668 bp, Homo sapiens
  misc_feature: GYAE6OF02F6JFL.38.37.D04.1.454.CMB.1.raw
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgtttcccatcgactacgcctttcggcctcgccttaggggtcactcaccctgccccgattaacgtggacaggaacccttggtcttccggcgagcgggtcttttcgacccgtctttagtcgttacttatgtcagctattcgctacttctgactaccctcagcatcgcctcacacgccaactacccgttacacgtacggtcttaacgacgaaccgtcccttaccccctaacccgaaacctaaaccgaccaacgttaaccggccgttacccgcgttccgcccgacgtacggtccgtttaccgggtcgtaccgtacggtttcgggtttaccgttacccccgtttctaccgtttccccgtttcccggaccttaacgttccgtacggtacgttcgtaacccgg

SEQ ID NO: 132115 - DNA, 615 bp, Homo sapiens
  misc_feature: GYAE6OF02FQBSE.38.37.D04.1.454.CMB.1.raw
  modified_base (289)..(289): a, c, t, g, unknown or other
  misc_feature (289)..(289): n is a, c, g, or t
  modified_base (415)..(415): a, c, t, g, unknown or other
  misc_feature (415)..(415): n is a, c, g, or t
  modified_base (447)..(447): a, c, t, g, unknown or other
  misc_feature (447)..(447): n is a, c, g, or t
  modified_base (490)..(490): a, c, t, g, unknown or other
  misc_feature (490)..(490): n is a, c, g, or t
  modified_base (540)..(540): a, c, t, g, unknown or other
  misc_feature (540)..(540): n is a, c, g, or t
  modified_base (553)..(553): a, c, t, g, unknown or other
  misc_feature (553)..(553): n is a, c, g, or t
  modified_base (596)..(596): a, c, t, g, unknown or other
  misc_feature (596)..(596): n is a, c, g, or t
tcagtcgatcacgtcacgaccggtgctcgatttagtagcatactgttgggtttgggggttacggatttgatgttacctgatgcttagaggcttttcctggaagcagggcatttgttgcttctagcaccgtagtgcctcgtcatcagcctcagccttgattttccggatttgcctggaaaccagcctacacgcttaaaccgggacaaccgtcgcccggccaacatagccttctccgtccccccttcgccagtaacaccaatcaggatataacctgttcccatccgacacncctttcggcctcgccttggggcgactcacccctgcccccgattaaccgttggactaggaaccccttggtccttccggcgagccggggtcttttccacccgtcctttagtcgtttctaatgtcagcnttacgctacttctgacttacctccagccatcncccttcactacgcacacccttcacaggcttaaccgagtaaccncgtaccccccaccaaacctaccgacgtactaacgcgtacgcctcggtccnctagcttcggtcnccagttccggttacgccccgtttcagtcccttacccgcccgtntaccgtgtaaccgtgtacg

SEQ ID NO: 132116 - DNA, 638 bp, Homo sapiens
  misc_feature: GYAE6OF02IDJ4Y.38.37.D04.1.454.CMB.1.raw
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctccgtcccccttgcagtaacaccaagtacaggaatattaacctgtttccatcgactacgcctttcggcctcgccttagggtcgactcaccctgcccgattaacgttggacaggaacccttggtcttccggcgagcgggtcttttcgacccgtctttatcgttacttatgtcagctattcgctacttctgactacctccagctatcgcctcacgagccactaccttcacgacggtacttaacacgaaccgcctacccctaacccaaacaaccgctaacgtaacgcgtaccgcttcgacccgctacgccgtttacggtcgaccgtacgttacgggttttacccgtacccccgttttcgacctttccccgttaccccgaccttaccttccggtaacgtaccgttggaaccg

SEQ ID NO: 132117 - DNA, 847 bp, Homo sapiens
  misc_feature: GYAE6OF02IJAN1.38.37.D04.1.454.CMB.1.raw
  modified_base (128)..(128): a, c, t, g, unknown or other
  misc_feature (128)..(128): n is a, c, g, or t
  modified_base (177)..(177): a, c, t, g, unknown or other
  misc_feature (177)..(177): n is a, c, g, or t
  modified_base (274)..(274): a, c, t, g, unknown or other
  misc_feature (274)..(274): n is a, c, g, or t
tcagtcgatcacgtcacgaccggtgctcgatttagtagcatactgttgggttggggtacgatttgatgttacctgatgcttagaggctttcctggaagcagggcatttgttgcttcagcaccgtagtncctcgtcatcacgcctcagccttgattttccggatttgcctggaaaccngcctacacgctaaaccggcaaccgtcgcccggcaacatagccttctccctccccttcgcaagtaccaccaagtacaggatattacctgtttacccancacttacgcctttcggcccttacgccgttacgggggtcgtaacctccgtaaccccgtcggtacccccggtaattttaaacccggttgggtaacctaacgggtaaacccccgttttggggtcccctttccggggacccggaggtcccgggggttacctttttaccgaacccccggttcttttaacgtccggttttaaccttacgttaggtaccgacggtacctacgtttaccgtccggtaactttccgttaggaaccttaccccgtacgtacgtaccgtaacgtcggtaccctccgtaaccgaacgtcctaaaccgtacccttaccgtaaccgacgttaccgttaacgtaacgaaacccggtaccccgttaccccctaaaccgaaacccgtaacgtaacccaagttaaccgtaccgtaccggtacgttcccggaaccgtccgtaaccggtactttacccgggtgaaccgttcccggtttaaccggtttacccgtacccccggtttaaccgtaaccccgtttcccgtcccgtaacccgtaccgtaccggtttaccgaacccggttcgttacccgg

SEQ ID NO: 132118 - DNA, 749 bp, Homo sapiens
  misc_feature: GYAE6OF02FNDG8.38.37.D04.1.454.CMB.1.raw
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatccacgcctcagccttgattttccggatttgcctaggaaaaccagcctacacgaccgttaaacccgggacaaccgtccgcccggaccaacatacgccttcctccccgtccccccttgcacgtaaccaccaagtacagaatacttaacctcgttccatcgactacgtccttcggcctcgccgttagggtcactccaccctcgaccccgaattaacggttggaaccgacggtaacccttcggtccgttccggcgacggtcgggtcctttaccgacccgtctttactcgttacttatcgtacagtctatccgcactttcgtcgtaaacctccctacccagtacctactcgacccctcgaactacgaccctaaccgtacccttaccgaaccgcggttacttaacgaacgtaacccgtcccttaaccccctaaccccgaaaccgtaacccgacctaaacgtaaccgtacccggtaccgtacccgttaccgacccgtaccgaccggttccgttaccgggtcgaccttacggttacggtttaacccgtccccgtttaccgtacctttcccgttaccccgcctttaacggtacccgtacggtaaccgtggttaacccgg

SEQ ID NO: 132119 - DNA, 702 bp, Homo sapiens
  misc_feature: GYAE6OF02I3IG6.38.37.D04.1.454.CMB.1.raw
  modified_base (181)..(181): a, c, t, g, unknown or other
  misc_feature (181)..(181): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgacttaaaccgggacaaccgtcgcccggccaacatagccttctcccgtcccccttgcacgtaacaccaagtacaggaactattaacctgtttcccatcgactaccgtccttcggcctcgccgttagggtcactcaccctcgacccctattaacgttggacgtacggtaacccttggtccttccggcgacgtccgggtctttccgacccgttcttttactcgttactttagtgtaccacgtctaattccgctaccgttctcgtaacctaccctccacgtcgtactacgtccctacaacgacgtaccaacctacccttacaacctacgttacgttacttaacgaaccgaaccttccccgtaacccctaaacccaaacgaacctaacaacgtaacgccgtacgtccgtaccgccgacgtacgtccgttacgggtcgtacgtcggtttaccggttaccgttcccgtttacctaccgtttcccgtacccgtccgtacttccggtacgtaccgttacgg

SEQ ID NO: 132120 - DNA, 748 bp, Homo sapiens
  misc_feature: GYAE6OF02I9XO7.38.37.D04.1.454.CMB.1.raw
  modified_base (400)..(400): a, c, t, g, unknown or other
  misc_feature (400)..(400): n is a, c, g, or t
  modified_base (718)..(718): a, c, t, g, unknown or other
  misc_feature (718)..(718): n is a, c, g, or t
  modified_base (741)..(741): a, c, t, g, unknown or other
  misc_feature (741)..(741): n is a, c, g, or t
tcagtcgatcacgtcacgaccggtgctcgatttagtagcatactgttgggtttggggtacgatttgatgttacctgatgcttagaggcttttcctaggaagcagggcatttgttgcttcagcaccgtagtcgcctcgtcatcacgcctcagtccttgtatttccggattttgcctaggaaaacctgacctacacgacttaaaccggacaaccgtccggcccggaccaacatacgtcccttctccccgtccccttcgcacgtaacaccaagtacagtaactacttaacctcgttaccatcgactaccgtcctttcggcctccggtccgttaggggccactccacccgtcgaccccgtaagtttaacggtcgaacgaccggtaaccgtttcgtcgtaccggngaacggtccggttctttaccgaccgtcttttacgtacgtttactacgtcgtcacgtactactcgactacttcgtagaccttacgtacacgtactctcgacccttaccaacgtaccgacctaaccgttacccttaacgaacccgtaacggttaccttaaaccgacggtaaccccttacccctaccccctaaaaccgaaaccgtaaaccgcgtaaaccgttaggtcccgttacgcccgttacggaccgaaccgttcgttaccgtcgtacgtagtacggtttaccggttacccggtcttaccgaccctttccggttacccncttaccgttaggaaccgttacgngtacccg

SEQ ID NO: 132121 - DNA, 759 bp, Homo sapiens
  misc_feature: GYAE6OF02HEADQ.38.37.D04.1.454.CMB.1.raw
  modified_base (459)..(459): a, c, t, g, unknown or other
  misc_feature (459)..(459): n is a, c, g, or t
  modified_base (505)..(505): a, c, t, g, unknown or other
  misc_feature (505)..(505): n is a, c, g, or t
  modified_base (675)..(675): a, c, t, g, unknown or other
  misc_feature (675)..(675): n is a, c, g, or t
  modified_base (734)..(734): a, c, t, g, unknown or other
  misc_feature (734)..(734): n is a, c, g, or t
tcagtcgatcacgtcacgaccggtgctcgatttagtagcatactgttgggtttggggtacgatttgatgttacctgatgcttagaggtcttttcctggaagcgagggctatttgttgcttcagcaccgtagtcgcctcgtacatcacgcctcacgtccttgtactttttcccggtatttcgaccgtacggaaaaccagccctaccgaccgaccgtttaaaaccggggaccaaccgttccggaccccgaccaaaacgattacgcccttccttccccgtcccccttgacaacgtaacccactaaagtacgaaggtaacttaacgtttaacctcgtttacccatccgaccgtaccgtccgtttccgccgttacgtccggttacggggtactacctcctacccgtcggaccccttaagtttaccggtaggaccaacggtacccgttcggtccttccgggacgnggtccgggttctttaccacccgttatttacgtaccgtttactcgtntaccaggtctacgtccgtactactgtacgacttacccctgacgtactctactcgtaccactacgaccacgttaccctcacgtacgtaaccgtttaaccgaaccgtaccgcccttaacccctaaccgaaacaccgtaacgtagaaccggtccttacgcgtaccgccgaacnccgttacgtcgcgtacgttccggtacgtttccctaccgttcctaccgtttcccgtaccnccggtcctacggtctacgtcgtacg

SEQ ID NO: 132122 - DNA, 720 bp, Homo sapiens
  misc_feature: GYAE6OF02HKFZX.38.37.D04.1.454.CMB.1.raw
  modified_base (183)..(183): a, c, t, g, unknown or other
  misc_feature (183)..(183): n is a, c, g, or t
  modified_base (337)..(337): a, c, t, g, unknown or other
  misc_feature (337)..(337): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtcgcctcgtcatcaccgcctcagccttgtattttccggattgacctaggaaaccncgcctacacgtacgttaaaccggacaaccgtcgcccggaccaacacgtacgccttcctcccgtcccccttcgacaacgtaaccaccaaagtaccaggaatacttaaccttcgttccatcgactacgtccgttccgcctcgtaccgttagggtcnctccacctcgacccgtattacgtcggaaccacggtaacccgttcggtccttccgggcgtacgggcggttccttttaccgacccgttctttacgtcgttacttgtcgtactacgctatccgctacttcgtacgtactacccgtcacgtctatccgtacctacgaccacgacctacctaccgttaccacgtacggtccttaacgaccggacctacccctaaccccgtaaccaaccggttaccaacctaacgtccgcggttaaccgccttacgcccgtataccgtcgttcgggctcgtaccgtttacgggtacccttacccgttcgttaacccttcccggttcccctaccgttaccgttaccggtacgttaccgtacgttaaccgg

SEQ ID NO: 132123 - DNA, 973 bp, Homo sapiens
  misc_feature: GYAE6OF02JZXU5.38.37.D04.1.454.CMB.1.raw
  modified_base (106)..(106): a, c, t, g, unknown or other
  misc_feature (106)..(106): n is a, c, g, or t
  modified_base (192)..(192): a, c, t, g, unknown or other
  misc_feature (192)..(192): n is a, c, g, or t
  modified_base (625)..(625): a, c, t, g, unknown or other
  misc_feature (625)..(625): n is a, c, g, or t
tcagtcgatcacgtcacgaccggtgctcgatttagtagcatactgttgggtttggggtacgatttgatgttacctgatgcttagaggcttttcctggaagcagggnatttgttgctcagccaccgtagtgcctcgtcatcacgcctcaggtccttgtacgttttccggattttcgacccgttaggaaaaccngcctaacacgaccgttaaaccgggacaaccgtccgccccggaccaacatagtcccttctaccccgtccccccttgacctaacgtaaccacctaacggtaccaagggtaaattaacttaacccgttcgttttacccccgagttaccgaaccttaaccggttccccgttttcggaccccttccggacccggtttacggggggtcctaaccgttccctaaccccctcggaccccccgtaaagttaaccggtttcggaaccgtacgggtaaccccgtttcgggtttacccgttaccccgggtcggtacccgggtccggggttaccttttaccccgtaacccggttccgttttaacttaccggtttaaccttacgttcggtactacgtactacgtttaccggaccttaccgtttccgtacctaacctaccgttacccnggtacctaagtccgtccctacgtaacgaaccgtccctaccgttaacccttacgtacgtaaccgggttaccctttaaccgaaaccgggttaaccccgtacccccgttaaaccccccgtaaaccccgtaacccgggtaaaaccctaccggtaaaccttaacccggtcccgggtaaaccgtcccgttccgaaccccgtacggtcccgtttaccgttccgggtttacccgtaacggttcggtttaacccggggttttaccccgttacccccgggtttaccttaacccggtttcccgtttaacccccggtaccgttaccttaacggtacccggttaaccggtaggttaccccg

SEQ ID NO: 132124 - DNA, 663 bp, Homo sapiens
  misc_feature: GYAE6OF02F5VX9.38.37.D04.1.454.CMB.1.raw
  modified_base (185)..(185): a, c, t, g, unknown or other
  misc_feature (185)..(185): n is a, c, g, or t
  modified_base (394)..(394): a, c, t, g, unknown or other
  misc_feature (394)..(394): n is a, c, g, or t
tcagtcgatcacgtcacgaccggtgctcgatttagtagcatactgttgggtttggggtacgatttgatgttacctgatgcttagaggcttttcctggaagcagggcatttgttgcttcagcaccgtagtgcctcgtcatcacgcctcacgccttgtacttttccggatttcgcctaggaaaaccngcctacacgaccttaaaccgggacaaccgtcgcccgacaacatacgtccttctccccgttccccctgaccagtaaccacaagtacaggtaattacttaacctgtttcccatccgactaccgtcctttcgcctccgtacgttagggccactcaccctcgccctattacggtgacacggtacctgcctcggcgcgcggtctttccgccgtntttactcttactatcgtacacgtctattcgactcgttcacgtactacctcagtcactcacctcaacgcgacctaccttacctctaaccgtacggtaccttaacgacgtacccgtcccctaaccccgaacctaacaaccgtcaacgtaacgtccgtcgacctccgacctacgtacgttccgttcgtactacgttacggtttccggttacccgttacccgtttacgcctttcccgtaccgtccttaacgtcggtaccggtaccgtcgtacg

SEQ ID NO: 132125 - DNA, 164 bp, Homo sapiens
  misc_feature: GYAE6OF01CX4SR.48.28.C06.1.454.CMB.1.raw
  modified_base (155)..(164): a, c, t, g, unknown or other
  misc_feature (155)..(164): n is a, c, g, or t
tcagagtatacatacacgaccggtgctcgatttagagctcacgtattgggtttgggaccaaggtggaagtcaaacgaactgtggctgcaccatctgtcttcatcttcccgccatctgatatgtatactctgaggcgggctggcaaggcgcatagnnnnnnnnnn

SEQ ID NO: 132126 - DNA, 248 bp, Homo sapiens
  misc_feature: GYAE6OF02G04OL.48.28.C06.1.454.CMB.1.raw
  modified_base (246)..(248): a, c, t, g, unknown or other
  misc_feature (246)..(248): n is a, c, g, or t
tcagagtatacatacacgaccggtgctcgatttagagctcacgtattgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnnn

SEQ ID NO: 132127 - DNA, 247 bp, Homo sapiens
  misc_feature: GYAE6OF02G6LH0.48.28.C06.1.454.CMB.1.raw
  modified_base (245)..(247): a, c, t, g, unknown or other
  misc_feature (245)..(247): n is a, c, g, or t
tcagagtatacatacacgaccggtgctcgatttagagctcacgtattgggtttgggggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccgccctcctctatgtatactctgagcgggctggcaaggcgcatagnnn

SEQ ID NO: 132128 - DNA, 247 bp, Homo sapiens
  misc_feature: GYAE6OF02GO1V6.48.28.C06.1.454.CMB.1.raw
  modified_base (245)..(247): a, c, t, g, unknown or other
  misc_feature (245)..(247): n is a, c, g, or t
tcagagtatacatacacgaccggtgctcgatttagagctcacgtattgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccgccctctctatgtatactctgagcgggctggcaaggcgcatagnnn

SEQ ID NO: 132129 - DNA, 278 bp, Homo sapiens
  misc_feature: GYAE6OF02I4TIT.48.28.C06.1.454.CMB.1.raw
  modified_base (244)..(244): a, c, t, g, unknown or other
  misc_feature (244)..(244): n is a, c, g, or t
  modified_base (250)..(278): a, c, t, g, unknown or other
  misc_feature (250)..(278): n is a, c, g, or t
tcagagtatacatacacgaccggtgctcgatttagagctcacgtattgggtttggggggtgtggtggtctccactcccgccttgacgaggctgattactactgtcagtcttttgataacaacaatcacgtggtcttcggcggagggaccagcctgaccgtcctaggtcagcccaaggctgcccccctggtcacgtctgttccccgccctcctctatgtatactctgagcgggctggacaaggcncatagnnnnnnnnnnnnnnnnnnnnnnnnnnnnn

SEQ ID NO: 132130 - DNA, 251 bp, Homo sapiens
  misc_feature: GYAE6OF02FUDCL.48.28.C06.1.454.CMB.1.raw
  modified_base (248)..(251): a, c, t, g, unknown or other
  misc_feature (248)..(251): n is a, c, g, or t
tcagagtatacatacacgaccggtgctcgatttagagctcacgtattgggtttggggggtgtggtggtctccactcccgccttgacgaggctgattactactgtcagtcttttgataacaacaatcacgtggtcttcggcggagggaccagcctgaccgtcctaggtcagcccaaggctcgccccctcggtcactctgttcccgccctcctctatgtatactctgagcgggctggcaaggcgcatagnnnn

SEQ ID NO: 132131 - DNA, 205 bp, Homo sapiens
  misc_feature: GYAE6OF01DQ21C.52.82.H05.1.454.CMB.1.raw
  modified_base (203)..(205): a, c, t, g, unknown or other
  misc_feature (203)..(205): n is a, c, g, or t
tcagcgcagtacgacacgaccggtgctcgatttagtcgagctctctcgcgggcacgaccggtgctcgatttagacagtatatatccgcgggcacgaccggtgctcgatttagacacatacgcagggaaaggggctggccctgacgtgtttctgttcccaccctcctctatacgatcgctgagcgggctggcaaggcgcatagnnn

SEQ ID NO: 132132 - DNA, 153 bp, Homo sapiens
  misc_feature: GYAE6OF01ACP9T.52.82.H05.1.454.CMB.1.raw
  modified_base (153)..(153): a, c, t, g, unknown or other
  misc_feature (153)..(153): n is a, c, g, or t
tcagcgcagtacgacacgaccggtgctcgatttagtcgagctctctcgcgggcacgaccggtgctcgagttatccacgcccagagctcgaaaacaccgttggtcaaggactacttcctatacgatcgctgagcgggctggcaaggcgcatagn

SEQ ID NO: 132133 - DNA, 201 bp, Homo sapiens
  misc_feature: GYAE6OF01AC8WR.52.82.H05.1.454.CMB.1.raw
  modified_base (199)..(201): a, c, t, g, unknown or other
  misc_feature (199)..(201): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcacgcgagaagggaagggctggcctgacgtgtttctgttcccgccctcctctatacgatcgctgagcgggctggcaaggcgcatagnnn

SEQ ID NO: 132134 - DNA, 155 bp, Homo sapiens
  misc_feature: GYAE6OF01CR16W.52.82.H05.1.454.CMB.1.raw
  modified_base (153)..(155): a, c, t, g, unknown or other
  misc_feature (153)..(155): n is a, c, g, or t
tcagcgcagtacgacacgaccggtgctcgatttagtcgagctctctcgcgggcacgaccggtgctcgagttatccacgcccagagctcgaaaacaccgttggtcaaggactacttcctatacgatcgctgagcgggctggcaaggcgcatagnnn

SEQ ID NO: 132135 - DNA, 514 bp, Homo sapiens
  misc_feature: GYAE6OF01CMCRJ.52.82.H05.1.454.CMB.1.raw
  modified_base (237)..(237): a, c, t, g, unknown or other
  misc_feature (237)..(237): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatattctgtcaaaccgttangcttatggtaccagcagaagccaggccaggcccctgtgttggtgatatataaggacactgagaggccctgagggatccctgagcgattctctggctccactcaggacactagcacgttgaccatcagtgagtccaggcagaggacgagggctggactaccgactgtacatacaacagacaagcagtggttcttatcgttcttcacaacgtcgggacctaaggtccaccggtccttaggtcacgacccaacggcccaaaccccntcgtcnccttaccg

SEQ ID NO: 132136 - DNA, 559 bp, Homo sapiens
  misc_feature: GYAE6OF01ECEJ3.52.82.H05.1.454.CMB.1.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatattctgtacaaaccgttntgtcttattggtaccagcagaagccaggccaggcccctgtgttggtgatatagtaaggacacgtgagacggccctcgagggactcccgtgacgcgattctcgtcggctccacctcgacgggactactagtctacgttacgacctatcgaggtggacgtccgaggcgaggaggacgagctagactaccatgtacaatcaacagacagacgtagtggttacttagtcgttctaccgactaacgtcgggaaccaaggttccgaccgttaccgtagggtccacggacccgaacggaccccaacccgactacgtcctacgttcccg

SEQ ID NO: 132137 - DNA, 166 bp, Homo sapiens
  misc_feature: GYAE6OF01DHZ71.52.82.H05.1.454.CMB.1.raw
  modified_base (165)..(166): a, c, t, g, unknown or other
  misc_feature (165)..(166): n is a, c, g, or t
tcagcgcagtacgacacgaccggtgctcgatttagtcgagctctctcgcgggcacgaccggtgctcgatttagtcacgcgagaaagggaaaggggctggccctgacgtgtttctgttcccaccttcctctatacgatcgctgagcgggctggcaaggcgcatagnn

SEQ ID NO: 132138 - DNA, 508 bp, Homo sapiens
  misc_feature: GYAE6OF01AK17E.52.82.H05.1.454.CMB.1.raw
  modified_base (329)..(329): a, c, t, g, unknown or other
  misc_feature (329)..(329): n is a, c, g, or t
  modified_base (443)..(443): a, c, t, g, unknown or other
  misc_feature (443)..(443): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctgagggatccctgagcgattcnctggctccacctcgacgggacactagtcacgttgacccatcagtggacgtccaggcaggaggacgaggctagacctaccactgtacaatcaatagacagacagtggttacttangttctcgcacgtggaccaaggtccaccgtctaggtcacgcccaacgcccaacccntctcncgtcc

SEQ ID NO: 132139 - DNA, 108 bp, Homo sapiens
  misc_feature: GYAE6OF01DIZZK.52.82.H05.1.454.CMB.1.raw
  modified_base (108)..(108): a, c, t, g, unknown or other
  misc_feature (108)..(108): n is a, c, g, or t
tcagcgcagtacgacacgaccggtgctcgatttagtcgagctctctcgcgggcacgaccggtgctcgatttagtcgagctctcgtagcgggctggcaaggcgcatagn

SEQ ID NO: 132140 - DNA, 500 bp, Homo sapiens
  misc_feature: GYAE6OF01E44SA.52.82.H05.1.454.CMB.1.raw
  modified_base (497)..(497): a, c, t, g, unknown or other
  misc_feature (497)..(497): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggactccctgagcgattctctggctccacctcagggcactagtcacgttgaccatcagtggagtccaggcagaggacgaggctgactaccactgtcaatcaacagacagacagtggttattatgttctcgcaactgggaccaaggtccaccgtctaggtcagaccccaaggcccaaccccatctccntcc

SEQ ID NO: 132141 - DNA, 566 bp, Homo sapiens
  misc_feature: GYAE6OF01DW5B5.52.82.H05.1.454.CMB.1.raw
  modified_base (548)..(548): a, c, t, g, unknown or other
  misc_feature (548)..(548): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagattattctgtcaaaccgttatgcttatggtaccagcagaagccaggccaggcccctgtgttggtgatatataaggacacgtgagacggccctcgagggactccctgacgcgtattctcgtggcctcccacctcgagggaccacgtacgtcacgttgaccatacagtggagtccgaggcaggaggacgaggctcgactaccgactgtacaatacaacagaacagctagttggttcttagtcgttccttacgactaacgtgggaacctaagggtcctaaccggttcctagggttcccaacggtaccccgaaacgggtcccccaaaaccccgtntacgtcccgacgttcccg

SEQ ID NO: 132142 - DNA, 509 bp, Homo sapiens
  misc_feature: GYAE6OF01BOOWX.52.82.H05.1.454.CMB.1.raw
  modified_base (237)..(237): a, c, t, g, unknown or other
  misc_feature (237)..(237): n is a, c, g, or t
  modified_base (328)..(328): a, c, t, g, unknown or other
  misc_feature (328)..(328): n is a, c, g, or t
  modified_base (429)..(429): a, c, t, g, unknown or other
  misc_feature (429)..(429): n is a, c, g, or t
  modified_base (502)..(502): a, c, t, g, unknown or other
  misc_feature (502)..(502): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatattctgtcaaaaccgttntgcttatggtaccagcagaagccaggccaggcccctgtcgttggtgatatataaggacactgagaggcctcagggatccctgagcgattcnctggctccactcagggacactagtcacgttgaccatcagtggatcaggcagaggacgaggctgactaccatgtacaatcaacgagacagactagtcggttnttaatgtcttcgcaacgtggaccaaggtcaccgtctaggtcacgtaccccaaggtccccaaccccattcgccncttaccg

SEQ ID NO: 132143 - DNA, 108 bp, Homo sapiens
  misc_feature: GYAE6OF01DFNCN.52.82.H05.1.454.CMB.1.raw
  modified_base (107)..(108): a, c, t, g, unknown or other
  misc_feature (107)..(108): n is a, c, g, or t
tcagcgcagtacgacacgaccggtgctcgatttagtcgagctctctcgcgggcacgaccggtgctcgatttagtcgagctctcgagcgggctggcaaggcgcatagnn

SEQ ID NO: 132144 - DNA, 597 bp, Homo sapiens
  misc_feature: GYAE6OF01AIVRD.52.82.H05.1.454.CMB.1.raw
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatattctgtacaaaccgttatgcttattggtaccagcagaagccaggccaggcccctgtgttggtgatatataaggacactgagaggccctcgagggactccctgagcgtattctctggctccacctcgagggaccacgtagtcacgttacgaccatcagtggacgtccgaggcaggacggacgaggctacgacctaccacgtgtacaactcaacagaacagactaggttggtttacttagttcgttcgttaccgacgtaacgtcgggaaccctaagggtaccctaacccggttacccgttagggtcccgaaccggtacccccgaaaccgggaccccctaaacccccgtacgtacccggttacctacccgtttaccccgg

SEQ ID NO: 132145 - DNA, 611 bp, Homo sapiens
  misc_feature: GYAE6OF01DSIHS.52.82.H05.1.454.CMB.1.raw
  modified_base (219)..(219): a, c, t, g, unknown or other
  misc_feature (219)..(219): n is a, c, g, or t
  modified_base (290)..(290): a, c, t, g, unknown or other
  misc_feature (290)..(290): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggccctcctatgagctgacacagccaccctggtgtcagtcgtccccaggacagacgccaggatcacctgctcgtgganatattctgtaccaaaccgttatgtcttattggtaaccagacagaagccaggccacggcccctgtgttggtntatatataaggactacgtggagacggccctcgaagggactcccgtgagcgtacttctcgtcggcctccaccgtgaggacacgtagtcacgttcgactatacaggtgacgtccgaggcaggacggacgaggctagactaccactgacaatcaacgacgaacagctaaggttggtttacttagtcgttcgttcgactaaccggtacgggaaccctaagggttacccgaccggttaccgtaacgggttacccgaacccggtacccccgtaaaccgggacccccctaaaacccccgtattacccggttcctaacccgttaccccg

SEQ ID NO: 132146 - DNA, 606 bp, Homo sapiens
  misc_feature: GYAE6OF01A8MEX.52.82.H05.1.454.CMB.1.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatattctgtacaaaccgttatgcttagtggtaccagacagaagccaggccacggccctgtgttggtgatataagtaaggacacgtgaagacggccctacgagggactcccgtagacgacgtacttctcgtcgcctccgaacccgtacgaacgggtacctaacgtacgtaccgtacgttagaccctatacgtagtaggtacgtaccgaggacaggacggacgaggctacgaacctacgacgtgtacaatacaacgacgacgagacgtagttcgttacttagtcgtcgttacacgtaacgtcggtaaccgtaagtccgaccgttaccggtacggtccgaaccgaaccccaacggtaccccaacccctagtacgtacccgtccgttcccg

SEQ ID NO: 132147 - DNA, 513 bp, Homo sapiens
  misc_feature: GYAE6OF01D7R9Y.52.82.H05.1.454.CMB.1.raw
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
  modified_base (503)..(503): a, c, t, g, unknown or other
  misc_feature (503)..(503): n is a, c, g, or t
tcagcgcagtacgacacgaccggtgctcgatttagtcgagctctctcgcgggggtgggtccaggaggcagaactctgggtgtctcaccatggcctggatcctctacttctcccctcctcactctctgcacaggctctgaggccctcctatgagctgacacagcccacccttcggtgtcagtgtccccaggacagacggccaggatcacctgctctgganatattctgtacaaaccgttntgtcttattcggtaccanacagaagccacggcacggccctgtgttggtgatatagtaaggacactgagcggccctgaggactcccgtagacgcgtattctcgtgtcctccacctcgagggactactacgtcacgttgaccatcgtagtgacgtcaggcaggaggacgaggctcgactactactgactatcaacngacagctaggttcgttnttatgtactnacgactggacacgtcgacgtcaggtcacgaccacgccaacccntcgctactcc

SEQ ID NO: 132148 - DNA, 238 bp, Homo sapiens
  misc_feature: GYAE6OF01C7244.52.82.H05.1.454.CMB.1.raw
  modified_base (220)..(220): a, c, t, g, unknown or other
  misc_feature (220)..(220): n is a, c, g, or t
  modified_base (225)..(238): a, c, t, g, unknown or other
  misc_feature (225)..(238): n is a, c, g, or t
tcagcgcagtacgacacgaccggtgctcgatttagtcgagctctctcgcgggcacgaccgtgctcgatttagtcgagctctctctcgcggcacgaccggtgctcgtatttagtcgagctctctcggcgggcacggaccggtgctcgtatttagtcgagctctcgcggcgggcacgaccggtgctcgtatttagcgagctctcgagcgggctggcaaggcnatagnnnnnnnnnnnnnn

SEQ ID NO: 132149 - DNA, 108 bp, Homo sapiens; identical to SEQ ID NO: 132143
  misc_feature: GYAE6OF01A6CNY.52.82.H05.1.454.CMB.1.raw
  modified_base (107)..(108): a, c, t, g, unknown or other
  misc_feature (107)..(108): n is a, c, g, or t

SEQ ID NO: 132150 - DNA, 565 bp, Homo sapiens
  misc_feature: GYAE6OF01C5EJH.52.82.H05.1.454.CMB.1.raw
  modified_base (387)..(387): a, c, t, g, unknown or other
  misc_feature (387)..(387): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgggcctcctatgaactgacacagccaccctcggtgtcagtgtcctcaggacagacggccaggatcacctgctcgtggagatgcactgccaaagcaatatgttattggtaccagcagaggccaggccacggcccccttatggtgatatataaggaccatgagacggcctcgagggactccctgagcgattctctggcctcctcctcgagggacaacgcgtctacgtgattcatcgagtggcgtccgggnagaggacgaggctgacttagttacacgtacaactcaacagaacgtaagtaggtaggttaacttagtggttagacgtggttaccgggacgggaacggaccgagtccgtaggacccggttactacggtaccgacggacccgtaacggacccgtcccggtaccccgccggttcgtaccccg

SEQ ID NO: 132151 - DNA, 860 bp, Homo sapiens
  misc_feature: GYAE6OF01CDJW7.52.82.H05.1.454.CMB.1.raw
tcagcgcagtacgacacgaccggtgctcgatttagtcgagctctctcgcgggggtgggtccaggaggcagaactctgggtgtctcaccatggcctggatccctctacttcctcccctctcactctctgcacaggctctgaggcctctatgagctgacacagcccacccgtggtgtcagtcgtcccaggacaggacgccaggactccacctgctcgtggagtattattctaggtacctaaaaccgtttgtcgtactttagttacggtaacccagtacgaaggtaacgacccggaccgggaccgtaccgggtccccgttagggtttcgggttacgggtaggtaacttaagtaacgtaaacgggacctacgtaggaacgggtaccggtaccctacggacgggtaacctccgtacggacggtacgtacgttccgttcgtcggaccttacccaccgtacggacggtaacgtacgtacggttacccgtacggttacgaaaccgtagttacgtacggggtacggtaacgtacccggacggtacgaaccggggacgggtaacggtaacgggccgtaaccggtacccgtaacgttaaccgtacgtaaccgtaacaaccgaaacggtaaccgaacggttacgtaacggtttaacgggttaccggtttaacgttttaacccggttcgtttacccggtttaacggaacccgggttaaacccgggttaccgggggaaaccgttaacccgggttacccgggtaaccccggtttacgggttaacccggtacccggtaaacccggtaacccccggtaaacccggacccccgttaaacccccggtacgttacccgtacccttaccccgtttaccccg

SEQ ID NO: 132152 - DNA, 816 bp, Homo sapiens
  misc_feature: GYAE6OF01DI6GK.52.82.H05.1.454.CMB.1.raw
  modified_base (246)..(246): a, c, t, g, unknown or other
  misc_feature (246)..(246): n is a, c, g, or t
tcagcgcagtacgacacgaccggtgctcgatttagtcgagctctctcgcgggggtgggtccaggaggcagaactctgggtgtctcaccatggcctggatcctctacttctcccctcctcactctctgcacaggctctgaggcctcctatgagctgacacagcccaccctcggtgtcagtcgtccccaggacaggacggccaggatcacctgctctggaagattattctgtaacctaaaccgtttangtcttttagttaggtaccagacacggaacgaccgacggaccgacggtcccccgtggttggttcggtaggtaattagttaacgtaaaagggaacctaccgtaggaacggtacgggtacccccttacggaacggggtaccttaccccggtagtaacggtaccggtaactttccgttcgtcgggcccttaccccgtaccctaccgggaacgggtaacctaaccgttaggtacccgtacggttaccgtaacctagtaccgtagggtacggtacggtacccgaagggaccaggggtaacggacgggtaggacgtacggtaaccctaccgtacggttacgaacttaaaccgtaccgaaacacgaacgtacgtacggttaacggtttcggggtttaacctttagggtttcctttacgttaccgttacccgtaaaccggttaccggggtaaacccgttaacggtacccggttaacccggttacccgttaaacggggtcccaaacccggtaccccggaaaccccgggacccccttaaacccccgtagtttacccgtacccgtaacccgtttcccccggg

SEQ ID NO: 132153 - DNA, 669 bp, Homo sapiens
  misc_feature: GYAE6OF01AMVWK.52.82.H05.1.454.CMB.1.raw
  modified_base (245)..(245): a, c, t, g, unknown or other
  misc_feature (245)..(245): n is a, c, g, or t
  modified_base (305)..(305): a, c, t, g, unknown or other
  misc_feature (305)..(305): n is a, c, g, or t
tcagcgcagtacgacacgaccggtgctcgatttagtcgagctctctcgcgggggtgggtccaggaggcagaactctgggtgtctcaccatggcctggatcctctacttctcccctcctcactctctgcacaggctctgaggcctctatgagctagacacacgccaccctcggtcgtcagtcgtcccaggacagacggccaggatcacctgctcgtggagtattattctacgtacctaaaccgttntgtacttagttcgtactagcaagaacgccgaggccacggccctgttggtggtctattaanagtaacggactacgtaggacggacggtaccctacgaacgggtctacccgtaggagtcgtaacttctacgtcggcctaccaccgtacgaacggactacgtacgtactacgttacgactagtcgaaggtcgacgtcgaacgtcgaaggacgaacgggagtcgtacgacctaaccgtatacgttaacaactaacaacgaccgaacgtagtacgtaggtttacgttactttaaggtcgttaccttacggaacgttaacggtcgggtaaaccgtaacggtcccgtaacccggttcgtaagggtaacccaccggtacccggaaacccgtacccgaaccctacgttcgtacccgttaaccgttttaccccg

SEQ ID NO: 132154 - DNA, 834 bp, Homo sapiens
  misc_feature: GYAE6OF01AZAGF.52.82.H05.1.454.CMB.1.raw
  modified_base (698)..(698): a, c, t, g, unknown or other
  misc_feature (698)..(698): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctggacggccctcctatgagctgacacacgcccacccgtggtgtcagtcgtccccgaggacacggaccggccaggactccaccttgcttcgtggaagtacttacgtttccgtcggttaacctaaaacccgtttgtcgttactttagttacggtaccagaccgaacgaacgcccgacgggcccgtaccggtccccgttggttacggtttaggtagtaacgttaagttaaagtaaacggacctaacggtacggtaacgggtaccggtcccgtacgggacgggtaccttaccgggtacggaccgtaccggttacgtttccgtacggttacccgggtcccctaaccccgtacccggttaccgggaaccgggtaacccgttaccggtttaaccggtaccgtttaaaccggtttacccgaacccgttaacgttaccgggtaacggttaccgggtaacgtacccgggtaacgggacggtaaacggggaaccgggtacgggaccggttacgtaacccggttaaccgtaacccgtacggttacgaacctaactaccgaacgtacgaacgngtaccgtacggttgtttacgttagttccgttacgtaccgtagtaccggttacggaacctaccggtaccgtccgttaccgtacggtccacccgacccgaacccgtacccctaccgtactacctccgtccgtaccccg

SEQ ID NO: 132155 - DNA, 829 bp, Homo sapiens
  misc_feature: GYAE6OF01ETIAS.52.82.H05.1.454.CMB.1.raw
  modified_base (288)..(288): a, c, t, g, unknown or other
  misc_feature (288)..(288): n is a, c, g, or t
  modified_base (635)..(635): a, c, t, g, unknown or other
  misc_feature (635)..(635): n is a, c, g, or t
tcagcgcagtacgacacgaccggtgctcgattttagtcgagctctctcgcgggggtgggtccaggaggcagaactctgggtgtctcaccatggcctggactccctctacttcctcccctctcactctctgcacgaggctcgtgacgcctctatgagctagacacacgcctacccgtcggtgtacacggttccgtacccgaggacgacggaccggacgaaggtactaccgtacctggtccttacggtaggaacgttacttacgtttacgtacgtaaccttaaacggttntcggttactttagtacggtacacggacgaacgtaccgccgtacggaccgtaccggtcctttggttacggtcgtaagtaacttaacgtaacggtaacgacgtacggtacggtaaccgggtacgtaccgtacggaacgtaccgttcggtaaggacgtacgtttacttccgtacggtccgtacccgtaccgaccggttacggaaccggtacttaaccggttacgttacgtaccggtttaacacgttacgtaggtacggtacgggtacctacggaacggacggtaacgggacggtacgtaacggtaccgttaaccgacttaacccggtgttacgaacgaacgtacgaaacnggaacttcgggacgttaggtttaccgttaacgtttcgtaccgttacggttaacccgacggttaaaccgggtacggtaaccgtaaccggttacccgtaacgggttacgttaacccggacggtttaaaccccaacccgggtaaccctacccccggtaaccttaccggttacgttaaaccgtcccgtttaaccccgg

SEQ ID NO: 132156 - DNA, 855 bp, Homo sapiens
  misc_feature: GYAE6OF01DX0ST.52.82.H05.1.454.CMB.1.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagaccggccaggatccacctgcctcgtgganatattctgtacaaacgttntcgtcttagttcggtacagacgagaacggcccgaggcccgacggtccccgtaggttggttggtagtaacttaagtaagttaaacgggactaacggtaggaacggaccggccccgttacggaacgggtaacctccccggtaggacggtccgtagtttccgtcggtacggtcccttacccgaccgttacggaaccgggaacctacgtacgtaccgtacggtttcgaacccgtagttaccggagggtttacgggaccgttaccgaacgggcggaacggggtaacggggaaccggtaaggggtcctaaccggtaacccgttaacccgtaacttcggtaaaccaaacttaacccgaaacctaacggaacgtaaggtacccgttaagggttttccggtttaacgttttaagtttacccgggtttaccctttacgggtaacccgttaaaacgggttcccggggaaaacccgttaaacggggtttcccccgttaaaacccgggtttaccccggttaacgggtaccccggttaaacccgggaacccccccgtaaaacggggtaccccccctaaacccccgtttaaacccggtccgttaaccccgttccccgttttacccccgg

SEQ ID NO: 132157 - DNA, 660 bp, Homo sapiens
  misc_feature: GYAE6OF01ELT8F.52.82.H05.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
  modified_base (300)..(300): a, c, t, g, unknown or other
  misc_feature (300)..(300): n is a, c, g, or t
tcagcgcagtacgacacgaccggtgctcgattttagtcgagctctctcgcgggggtgggtccaggaggcagaactctgggtgtctcaccatggcctggatccctctacttctccccctctcactctctgcacaggctctgaggcctctatgagctgacacagccctaccctcggtgtcagtcgtcccgaggacagacggccaggntccacgtgctcgnggatattattctgtacctaaacgttntggactttagttcgtacagacagacgccaggccgacggtccctgttgtgtgattanagtaagactacgtgagcggaccgacgaggactccgtagaggtactacgttctcgtcgactccgacctcggtaacggacacgttagtactacgttcgtaactactacggaggtcgacgtaccggacgacgtaaggaggacggtaggtctaccggactacctacgtacgtacaacgtaccaacgacgtaacgagtaacgtacgttacgttttaacttgttacgtttaccgtaccgtaaccggtaacggttaccggtaacgaaccgggttaccgtacccgtaccggttaccgacgtaaccccgaacccggtacccgaaacccccgttaacccgtacggttacccgtaccgtcccgttacccgg

SEQ ID NO: 132158 - DNA, 733 bp, Homo sapiens
  misc_feature: GYAE6OF01CSQPP.52.82.H05.1.454.CMB.1.raw
  modified_base (178)..(178): a, c, t, g, unknown or other
  misc_feature (178)..(178): n is a, c, g, or t
  modified_base (255)..(255): a, c, t, g, unknown or other
  misc_feature (255)..(255): n is a, c, g, or t
  modified_base (586)..(586): a, c, t, g, unknown or other
  misc_feature (586)..(586): n is a, c, g, or t
tcagcgcagtacgacacgaccggtgctcgatttagtcgagctctctcgcgggggtgggtccaggaggcagaactctgggtgtctcaccatggcctggatccctctacttcctccccctcctcactctctgcacaggctctgaggcctcctatgagctgacacacgcccacccgtggtntcacgtcgtccccgaggacaggacggccaggactccacctgcgtctggaacgtattacttctgtacctaaaccgttncgttattacgttacggtaaccagtacgagacgaccgacggcccgacggtcccttggttcggttggtagtaattaagtaagtaaacggaccttaacgaggaacggtaccggtacccgtacggaacgggtacctacccgtaggaccggtacgtaactttccgtcgtaccggtacccttacccgaaccgttacggaaacggtaacctaacgtaccgtacgttaacggttacaacccgtagtacggtaaggtggaaccgtcgaacgggacgaagggacggacggacggtactaccggaccctaaccgtacgtaacgtaccaacttaacccgaaanaccggtaacgagtaccggttacgtttacggttattacgttacgttacttaccggactaaccggtacggtaaccgtaccgtacgtaccggtactacggtaccgaacccgtacccgacggacccctaacgacgtcgccttaccgtcccg

SEQ ID NO: 132159 - DNA, 161 bp, Homo sapiens
  misc_feature: GYAE6OF02G5D6Z.52.82.H05.1.454.CMB.1.raw
  modified_base (160)..(161): a, c, t, g, unknown or other
  misc_feature (160)..(161): n is a, c, g, or t
tcagcgcagtacgacacgaccggtgctcgatttagtcgagctctctcgcggcacgaccggtgctcgatttagtcacgcgagaaagggaaaggggctggccctgacgtgttctgttcccgccctcctctatacgactgagcgggctggcaaggcgcatagnn

SEQ ID NO: 132160 - DNA, 107 bp, Homo sapiens
  misc_feature: GYAE6OF02IEXPZ.52.82.H05.1.454.CMB.1.raw
  modified_base (107)..(107): a, c, t, g, unknown or other
  misc_feature (107)..(107): n is a, c, g, or t
tcagcgcagtacgacacgaccggtgctcgatttagtcgagctctctcgcgggcacgaccggtgctcgatttagtcgagctctcgagcgggctggcaaggcgcatagn

SEQ ID NO: 132161 - DNA, 109 bp, Homo sapiens
  misc_feature: GYAE6OF02I8M5C.52.82.H05.1.454.CMB.1.raw
  modified_base (107)..(109): a, c, t, g, unknown or other
  misc_feature (107)..(109): n is a, c, g, or t
tcagcgcagtacgacacgaccggtgctcgatttagtcgagctctctcgcgggcacgaccggtgctcgatttagtcgagctctctcgcgggctggcaaggcgcatagnnn

SEQ ID NO: 132162 - DNA, 513 bp, Homo sapiens
  misc_feature: GYAE6OF02IC97Y.52.82.H05.1.454.CMB.1.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctagactaccacttgtcaatcaaacagacagacagtgttcttatgttcttgacaacgtgggaccaaggtccaccgtcctaggtcacgccctaaggcccaaccccgactcgtaccacttccc

SEQ ID NO: 132163 - DNA, 520 bp, Homo sapiens
  misc_feature: GYAE6OF02HJ4IT.52.82.H05.1.454.CMB.1.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaaccgttatgcttattggtaccagcagaagccaggccaggcccctgtgttggtgatatataaggacactgagacggccctcgagggactccctgagcgattctctggctccacctcaggacactagtcacgttgaccatcagtggacgtccgaggcaggaggacgaggctgactaccactgacaatcaacagacagcagtgttacttagtcgtctcgactaacgtgggaccaggtccaccggtcctaggtcacgacccaaggcccaacccgtacgtcgtaccacttcccg

SEQ ID NO: 132164 - DNA, 494 bp, Homo sapiens
  misc_feature: GYAE6OF02HB5GC.52.82.H05.1.454.CMB.1.raw
  modified_base (411)..(411): a, c, t, g, unknown or other
  misc_feature (411)..(411): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccagcagagcgaggctagactacactgtcaatcaanagacagcagtgttcttatgtcttcgctaacgtggaccaaggtccacgtctaggtcagcccaacggccaacccactgtcatccg

SEQ ID NO: 132165 - DNA, 206 bp, Homo sapiens
  misc_feature: GYAE6OF02GYTFJ.52.82.H05.1.454.CMB.1.raw
  modified_base (203)..(206): a, c, t, g, unknown or other
  misc_feature (203)..(206): n is a, c, g, or t
tcagcgcagtacgacacgaccggtgctcgatttagtcgagctctctcgcgggcacgaccggtgctcgatttagacagtatatatccgcgggcacgaccggtgctcgatttagacacatacgcagggaaaggggctggccctgacgtgtttctgttcccgccctcctctatacgatcgctgagcgggctggcaaggcgcatagnnnn

SEQ ID NO: 132166 - DNA, 519 bp, Homo sapiens
  misc_feature: GYAE6OF02GUOES.52.82.H05.1.454.CMB.1.raw
  modified_base (309)..(309): a, c, t, g, unknown or other
  misc_feature (309)..(309): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggccccctgtgttggtgatatataaggacactgagagccctnagggatccctgagcgattctctggctccacctcagggacactagtcacgttgaccatcagtggatccgaggcaggaggacgaggctgactaccactgtcaatcaacagacagcagtgttcttagtgtcttcgactaacgtgggaccaaggtcctaaccggtccttaggtccacgacccgaacggcccaaccccactcgtaccacttcccg

SEQ ID NO: 132167 - DNA, 509 bp, Homo sapiens
  misc_feature: GYAE6OF02F3PB6.52.82.H05.1.454.CMB.1.raw
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatcccgtgagcgattcctctggcctccacctcgacgggacactagtcacgttcgaccatcgagtggagtccgaggcaggaggacgaggctgacctacactgtcatacaacagacagcagtgttcttatgtctcganacgtggacagtcnccgtctaggtcacgcccgaacggcccaacccacgtcgacctactccc

SEQ ID NO: 132168 - DNA, 165 bp, Homo sapiens
  misc_feature: GYAE6OF02FSONJ.52.82.H05.1.454.CMB.1.raw
  modified_base (165)..(165): a, c, t, g, unknown or other
  misc_feature (165)..(165): n is a, c, g, or t
tcagcgcagtacgacacgaccggtgctcgatttagtcgagctctctcgcgggcacgaccggtgctcgatttagtcacgcgagaaagggaaagggggctggccctgacgtgtttctgttcccgccctcctctatcgatcgctgagcgggctggcaaggcgcatagn

SEQ ID NO: 132169 - DNA, 478 bp, Homo sapiens
  misc_feature: GYAE6OF02IQT54.52.82.H05.1.454.CMB.1.raw
  modified_base (363)..(363): a, c, t, g, unknown or other
  misc_feature (363)..(363): n is a, c, g, or t
  modified_base (475)..(475): a, c, t, g, unknown or other
  misc_feature (475)..(475): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatattctgtcaaaaccgttatgcttattggtaccagcagaagccaggccaggcccctgtgttggtgatatataaggacactgagaggcctcagggatccctgagcgattctctgctcactcaggacactagtcacgttgaccancagtggatccgagcagagagaggctagactacatgtacaatcaacagacagcagtgttctatgtctgcaactggacaggtcacgctagtcacgccaggccaacccatcgacnctc

SEQ ID NO: 132170 - DNA, 247 bp, Homo sapiens
  misc_feature: GYAE6OF02HOSDI.52.82.H05.1.454.CMB.1.raw
  modified_base (241)..(247): a, c, t, g, unknown or other
  misc_feature (241)..(247): n is a, c, g, or t
tcagcgcagtacgacacgaccggtgctcgatttagtcgagctctctcgcgggcacgaccggtgctcgatttagtcgagctctcgtcggcgggcacgaccggtgctcgatttagtcgagctctctcgcggcacgaccggtgctcgatttagctacgctctaagggaaaggggctggccctagcgtgttcctgttcccaccctcctctatacgatcgctgagcgggctggcaaggcgcatagnnnnnnn

SEQ ID NO: 132171 - DNA, 523 bp, Homo sapiens
  misc_feature: GYAE6OF02F12F1.52.82.H05.1.454.CMB.1.raw
  modified_base (237)..(237): a, c, t, g, unknown or other
  misc_feature (237)..(237): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttntgcttattggtaccagcagaagccaggccaggccccctgtgttggtgatatataaggacactgagaggcctcagggatccctgagcgattctctggctccacctcaggacactagtcacgttcgaccatcagtggagtccaggcagaggacgaggctgactaccactgtacaatcaacagacagcgagtgttcttagtgtcttcgactaacgtcggaccaaggtccgaaccggtcctaacggtcgacgcccgaacggccccaaaccccgactcgtccacgttcccg

SEQ ID NO: 132172 - DNA, 547 bp, Homo sapiens
  misc_feature: GYAE6OF02ILQJR.52.82.H05.1.454.CMB.1.raw
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccacctcggtgtcagtgtccccaggacagacggccaggatcacctgctctgganatattcngtcaaaccgttatgcttattggtaccagcagaagccaggccaggcccctgtgttggtgatatataaggacactgagaggccctcgagggactcctgagcgattctcgtggcctccacctcgacgggacactagtcacgttcgacctatcgaggtggacgtccgacggcgaaggaggacgaggctacgactaccatcgtacaatcaacagacgagcagtgttcttagtgttcttcgactaacgtcgggacctaaggtcctacggtaccgtacggtccacgaccccgaacgtacccgaaccccgtactcggtaccaccttacccg

SEQ ID NO: 132173 - DNA, 543 bp, Homo sapiens
  misc_feature: GYAE6OF02JITP2.52.82.H05.1.454.CMB.1.raw
  modified_base (437)..(437): a, c, t, g, unknown or other
  misc_feature (437)..(437): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatattctgtccaaaaccgttatgcttattgtaccagcagaagccaggccaggcccctgtcgttggtgatatataaggacactgagacggcctcagggactccctgagcggattctctggccttccaccttcgacggacactaagtcacttgaccatacagtggactccgaaggcaggaggacgaggctcgactaccactgttacaatacaacagacanctagtgttactatacgtcttacgactaacgcggtacgaacggtctacccggtactacggtacaacgtacccgaacggtcccaacccgtacgtcgtacaccgtaccg

SEQ ID NO: 132174 - DNA, 578 bp, Homo sapiens
  misc_feature: GYAE6OF02IEIXZ.52.82.H05.1.454.CMB.1.raw
tcagcgcagtacgacacgaccggtgctcgatttagtcgagctctctcgcgggcgcgaccggtgctcgatttagagagagtgtgttgggtttgggggaggcttggtaaagcggggggggtatctgagactctcctgttcagtctctggattcaccttaaataactatggcatgagctgggtccgccaggctccaggggaaggggctggagtgggtctcatttatcagtggtactggtggtagcacatactacgcagactccgtgaaggccggttcaccatctccaaagacaattccaagaacacgctgtatttacaaatgaacagcctgagagccgaggacacggccgtataattactgtgtagaaagatctcacgtctcgccccttggacctggttatttcgacttcgtgggtccagggaacctagtagccgtctcctcacgcctccaccaacgggcccagttccggtccttccccgtcgccaccctccctaccaacgacgccaccctcgtcggggtcacgacgccggccctgggcctggcctcggtcaacgggaccttaccgttcctacgtactacg

SEQ ID NO: 132175 - DNA, 612 bp, Homo sapiens
  misc_feature: GYAE6OF02ICDD5.52.82.H05.1.454.CMB.1.raw
  modified_base (348)..(348): a, c, t, g, unknown or other
  misc_feature (348)..(348): n is a, c, g, or t
tcagcgcagtacgacacgaccggtgctcgatttagtcgagctctctcgcgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctggagattattctgtaccaaaccgtttatgctttattggtaccagcagaacgccaggccacggcccctgtgttggtgatatataaggacacgtaggacgacggccctcgagggactcccgtgacgcgtattccncgtggcctcccacctcgacgggactacgtacgtctacgttcgaccatcgagtggacgtccagggacaggacggacgaggctcgaactaccgacgtgtacaactcaaacagacacgactaggtcgtttacttaagttcgttccttacgaccgtaacgttgggaaccctacggttaccgtaaccccggttcgttacgggtacccgaaccgaccccggtaacggacccccaaccccgtacccgttacgtcccgtaccgtttccccgg

SEQ ID NO: 132176 - DNA, 249 bp, Homo sapiens
  misc_feature: GYAE6OF02I3XWN.52.82.H05.1.454.CMB.1.raw
  modified_base (238)..(249): a, c, t, g, unknown or other
  misc_feature (238)..(249): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctctcgcggcacgaccggtgctcgatttagtcacgcgagaaagggaaagggctggccctgacgtgtttctgttcccaccctcctctatacgatcgctgagcggctggcaaggcgcatagnnnnnnnnnnnn

SEQ ID NO: 132177 - DNA, 220 bp, Homo sapiens
  misc_feature: GYAE6OF02HR347.52.82.H05.1.454.CMB.1.raw
  modified_base (182)..(182): a, c, t, g, unknown or other
  misc_feature (182)..(182): n is a, c, g, or t
  modified_base (213)..(220): a, c, t, g, unknown or other
  misc_feature (213)..(220): n is a, c, g, or t
tcagcgcagtacgacacgaccggtgctcgatttagtcgagctctctcgcgggcacgaccggtgctcgatttagtcgagctctctcggcgggcacgaccggtgctcgatttagtcgagctctacgtacggcgggcacgaccggtgctcggattttaccggagtacgcataaagggaaagggtncgtctctgagcgggctggcaaggcgcatagnnnnnnnn

SEQ ID NO: 132178 - DNA, 149 bp, Homo sapiens
  misc_feature: GYAE6OF02JXBU2.52.82.H05.1.454.CMB.1.raw
  modified_base (145)..(149): a, c, t, g, unknown or other
  misc_feature (145)..(149): n is a, c, g, or t
tcagcgcagtacgacacgaccggtgctcgatttagtcgagctctctcgcgggcacgaccggtgctcgatttagtcgagctctctcgcgggcacgaccggtgctcgatttagtcgagctctcgcgcgggctggcaaggcgcatagnnnnn

SEQ ID NO: 132179 - DNA, 699 bp, Homo sapiens
  misc_feature: GYAE6OF02HGMN0.52.82.H05.1.454.CMB.1.raw
  modified_base (175)..(175): a, c, t, g, unknown or other
  misc_feature (175)..(175): n is a, c, g, or t
  modified_base (309)..(309): a, c, t, g, unknown or other
  misc_feature (309)..(309): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcacctgctctggagatattctgtaccaaaccgttatgctttattcggtaccagcagaagccaaggccaggcccctggtcgttggtgatatataaggacactgagnggccctcgagggactccctgagcgattctctggctcccacctcgagggacacgtacgtctaacgttcgaccaatcgaaggtgggacgttaccgagggtacaagggtacgggaacggacgggtcctaggaaccctaacccgtaacttacgtccgaaaacttccgaaaccgaacgtaacgaacgtaccgtaaggttcgggtttacctttaagttcgttaccctttccggaaccgtttaaaccggtcggggaacccgtaacgggtttaccgtaaccccgggtttacccgtaacggggttaccccaaccgggtaaccccccggaaacccgggtacccccgtaaaacccccccgtaccgtttaacccgttacccggtaacccttttacccccggg

SEQ ID NO: 132180 - DNA, 746 bp, Homo sapiens
  misc_feature: GYAE6OF02JEOUO.52.82.H05.1.454.CMB.1.raw
  modified_base (236)..(236): a, c, t, g, unknown or other
  misc_feature (236)..(236): n is a, c, g, or t
  modified_base (340)..(340): a, c, t, g, unknown or other
  misc_feature (340)..(340): n is a, c, g, or t
tcagcgcagtacgacacgaccggtgctcgatttagtcgagctctctcgcgggggtgggtccaggaggcagaactctgggtgtctcaccatggcctggatccctctacttctccccctctcactctctgcacaggctctgaggcctcctatgagctgacacagccaccctggtgtcagtcgtcccaggacagacggccaggatcactgctcgtggagatattctgtacaaaccgttntgtactttagtggtaccagacagaacgccacggaccacggtccccgtgttcgttggtgtatagtaagtagacacgtgacgacgtccctacgacgggactaccgngacgtacgtattcgtcgtcggtcctaccgaccgtcgtacgggacctacgttacgtacgttaaccgttacggtaaccctacgtaccgtagggtacggtaacccgtaccggaacgggtaccggaagggaaccggggaacggtaacgggaccggttaaccgtaacccgtaacccgtaacgttaccggttaacctaaacgttaacccgaaaccgtaaacgaacccgtaaccggacggttaacggtttacggttttaacctttacggttagtttacccgtacgtaacccgtaacggttaaccgggtacccgtaacggttacccggtaacccgttaccggtacggtacccgaaccggtaccccgaaccggtaccccctaacccgttacgtacccgttaccgtaccttccccg

SEQ ID NO: 132181 - DNA, 350 bp, Homo sapiens
  misc_feature: GYAE6OF02G0H1L.52.82.H05.1.454.CMB.1.raw
  modified_base (336)..(336): a, c, t, g, unknown or other
  misc_feature (336)..(336): n is a, c, g, or t
  modified_base (342)..(350): a, c, t, g, unknown or other
  misc_feature (342)..(350): n is a, c, g, or t
tcagcgcagtacgacacgaccggtgctcgatttagtcgagctctctcgcgggaccggtgctcgatttagtcgagctctctcgcgggaccggtgctcgatttagcgtcgatctcagggatagaagttattcagcaggcacacaacagaggcagttacagacttcactctcaccatcagcaacctagagcctgaagactttgcagtttatactgtcagcagcgtagtaagtggcgcttcggccaagggcacgactggaggttaaacgaactgtggctgcaccatctgtcttcatcctcccgcatctgatatacgatcgctgacgcggctggcaaggcncatagnnnnnnnnn

SEQ ID NO: 132182 - DNA, 665 bp, Homo sapiens
  misc_feature: GYAE6OF02FNJOM.52.82.H05.1.454.CMB.1.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctggagatattctgtcaaaccgttatgctttattggtaccagcagaagccaggccaggcccctgtgttggtgatagtaataaggacactgaggacggcctcgagggactcccgtgaggctattctcgtggcctccacctcgagggacactacgtcgacgttgaccatcaggtcggagtaccgagggctaagggacggaacggacggcgttacgaaccgtaccgtaacgtgtaccgtaaattccaaactacggaaccaggacgtaacgggttacgttttacgtttaagtttcggttacccgttttaccgaaccgtaaccggttacggggtaaccctaagggttaccccgtaacccgggttacccgttaacgggtaaccgtaaccgtaccccgtaaacccggaccccgttaaaccccccgtacgttccgttaaccccgtccgtttacccccgg

SEQ ID NO: 132183 - DNA, 178 bp, Homo sapiens
  misc_feature: GYAE6OF02F71IB.52.82.H05.1.454.CMB.1.raw
  modified_base (167)..(178): a, c, t, g, unknown or other
  misc_feature (167)..(178): n is a, c, g, or t
tcagcgcagtacgacacgaccggtgctcgatttagtcgagctctctcgcgggcacgaccggtgctcgatttagtcacgcgagaaagggaaagggggctggccctgacgtgtttctgttcccaccctcctctatacgatcgctgagcgggctggcaaaggcgcatagnnnnnnnnnnnn

SEQ ID NO: 132184 - DNA, 220 bp, Homo sapiens
  misc_feature: GYAE6OF02I9YOM.52.82.H05.1.454.CMB.1.raw
  modified_base (194)..(220): a, c, t, g, unknown or other
  misc_feature (194)..(220): n is a, c, g, or t
tcagcgcagtacgacacgaccggtgctcgatttagtcgagctctctcgcgggcacgatcggtgctcgatttagtcgagctctctcgcgggcacgaccggtgcgtcgatttagtcgagctctctcgcgggcacgaccggtgctcgatttagtcacgcgagaagggagaggcgggcgtggcgaaggccgctatagnnnnnnnnnnnnnnnnnnnnnnnnnnn

SEQ ID NO: 132185 - DNA, 669 bp, Homo sapiens
  misc_feature: GYAE6OF02FMXNQ.52.82.H05.1.454.CMB.1.raw
  modified_base (225)..(225): a, c, t, g, unknown or other
  misc_feature (225)..(225): n is a, c, g, or t
tcagcgcagtacgacacgaccggtgctcgatttagtcgagctctctcgcgggcacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctcgccctcctgggacncctcggtcaagctcacctgccactctgacgcaggtcggcactaccacctaccgaccagtccgacagtcggcactccgagtctcgcaacggccgagaacggaccggtacccgttacggtacttggacgtcggagtcctaacgaacgtaggtacgagtcggaccgaagtccaacgacggacgggtacgggggaccgtacgtaccgtgtacgtcgtcttacgcgtacggtccgtaccggtcgtcggtacggtacgcgacgcgtcctaccgtacctaccgtaccttaccgtccctacggtccccgtttaaccgaccgttcggtaaccgggtacgggaccggtacgggtacgtaaccggtttaacgttaaccggttacggtacgtaacccgggttaggtaccggtaccgtacggttggtaccggttttacgggtttcgggttaccgggg

SEQ ID NO: 132186 - DNA, 660 bp, Homo sapiens
  misc_feature: GYAE6OF02GACZK.52.82.H05.1.454.CMB.1.raw
  modified_base (176)..(176): a, c, t, g, unknown or other
  misc_feature (176)..(176): n is a, c, g, or t
  modified_base (246)..(246): a, c, t, g, unknown or other
  misc_feature (246)..(246): n is a, c, g, or t
tcagcgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagcccaccctcggtntcagtcgtccccaggacaggacggccaggatcacctgctcgtggagtatattctagtaccaaaacgtttntcgtacttattcggtaccagaccaagaacgccacggccacggcccctggttcgttggtgatataataaggacactggagacggcctgagggactcccgtgagcgtattcgtctggcctccaccgttcgaacggtacacgtacgtacgtacgttacgaccatacgagtcggacgtccgaggcgaaggagggacgagggtcctacgacttaccaacgtcgtaccaaagactaaacaggtaaccagtacgtaggtttacgggtttcttaagttcggttaccttaccggaacctaacgggttaccgggaaccgttacgggtacccgtacccggttacccgtagggtaccctaaacccggcccgtaaaccgggtaacccctaaccccgtaccgtaccgttacccgtaccgttaccccgg

SEQ ID NO: 132187 - DNA, 732 bp, Homo sapiens
  misc_feature: GYAE6OF02JT68F.52.82.H05.1.454.CMB.1.raw
tcagcgcagtacgacacgaccggtgctcgatttagtcgagctctctcgcgggggtgggtccaggaggcagaactctgggtgtctcaccatggcctggatccctctacttctccccctcctcactctctgcacaggctctggaggcctcctatgagctgacacacgcccacccgtcggtgtcacgtcgtaccccaggacagaccgccgaggatcacctgctctggagtattattcgtacgttacgtaaaccgttatcgtctttacgttaggtaccagcaagaacgccgacggaccgacggtcccctggttcggttaggacggtataagttagtaacggtacacgttaggacggtaccgtcccccgtaggaacggtaccgtacccgtagaacggtctacgttcctcggtaccgccctaccgaccgttaggaaccggtaaacctcgttaacgaccgttaacggtacaaccgtactaacggtaggtaaccgggtacgtaccgacgggaacgtaacgggagggtaaccggaggtccgtaacgaaccgtacgtaacgtaccgtaacgtaacgtacaaccgaagtaccgaagtccggtaagttcgggtttactttacgtacttccgttacgaacggttaaccgacggggtaaccttcggttaacccgccgttaaccggtaaggtacccgacctaacccggtaccgaaccccttacccgacgtaccgtccgtaccctccg

SEQ ID NO: 132188 - DNA, 736 bp, Homo sapiens
  misc_feature: GYAE6OF02IDPLM.52.82.H05.1.454.CMB.1.raw
  modified_base (167)..(167): a, c, t, g, unknown or other
  misc_feature (167)..(167): n is a, c, g, or t
  modified_base (275)..(275): a, c, t, g, unknown or other
  misc_feature (275)..(275): n is a, c, g, or t
  modified_base (510)..(510): a, c, t, g, unknown or other
  misc_feature (510)..(510): n is a, c, g, or t
tcagcgcagtacgacacgaccggtgctcgatttagtcgagctctctcgcgggggtggtccaggaggcagaactctgggtgtctcaccatggcctggactccctctacttcctccccctcctcactctctgcacgaggtctctggacggcccttcctatgagctgacncgacgtcccacccgtggtcgtcgaggtccgtcccgaggacaggaccggaccgaggactccgaccttgccttgtaggacgtattacgttctacgtaaccgtaaacgttntgtactttaattcgtacagcgaaggtaacgccgacggccgaccggtccccgttagttcggtttggtacgtaataacgttagtaacggactacgtaggacggacggtccgtacggacgggtacctccgaggacgtacgttacttcgtacgtccgtccttaccgaccgtgtacggactacgtacgtcgtacgtgacctagtcgtaggtgtacggacgagggtacagggacggacggngtacccagtaccgtaaccgtgtacgactaactaccgaaagacgaccgtgtacgttcgttacggtttaccttagttccgttaggttccgaaccgttaacgggtaccgggtaaccgtaaccgggtttacccgtacccgttaccggtaaccgtacccggaaccggaacccccggtaacccggacccctaacccgttccggttaacgttacccctacgtttaacccccgg

SEQ ID NO: 132189 - DNA, 114 bp, Homo sapiens
  misc_feature: GYAE6OF02GB5B3.52.82.H05.1.454.CMB.1.raw
  modified_base (107)..(114): a, c, t, g, unknown or other
  misc_feature (107)..(114): n is a, c, g, or t
tcagcgcagtacgacacgaccggtgctcgatttagtcgagctctctcgcgggcacgaccggtgctcgatttagtcgagctctctcgcgggctggcaaggcgcatagnnnnnnnn

SEQ ID NO: 132190 - DNA, 787 bp, Homo sapiens
  misc_feature: GYAE6OF02IEG8I.52.82.H05.1.454.CMB.1.raw
  modified_base (261)..(261): a, c, t, g, unknown or other
  misc_feature (261)..(261): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
tcagcgcagtacgacacgaccggtgctcgatttagtcgagctctctcgcgggggtggtccaggaggcagaactctgggtgtctcaccatggcctggatccctctacttctcccctctcactctctgcacaggctctgaggcctcctagtgacgctcgacacagccacccgttcggtgtcacgttcgtccccagggacaggaccggcctaaggactcaccttggctcgtgggatagttcttcgtcgtacctaaaacggtttntggtacctttagttcggtaccacgacgaaggaacgaccggacggccgtaccgggtccccttggttcggttggtcgtaagttattaagttaacggacctagtaggacggtaaccggtcccttacggacgggtactcccgttaggaaccggtcgtaactttcgtacgtccggtcctacccgtaccgtcggaacggtacctacgttacgtaccgtaccgttacgaccctgtcgtaggttacggactaccggngaaaccgngggtaggacgcggtacgtaccgaacgtacctcggttacgaactactaacgaacgacgttaacggaacgtacgttacgggttccgttttacgttacgtttccgttacgttaccgtaaccggtaacgttacccgggaaccggttaaccggttcccggtaacggttaaccccggtaggttaacccggtaaccccggtaacccggaccccgggtttaaaccccaaccccggtttaacggtttacccggtacccgttacccggttttacccccg

SEQ ID NO: 132191 - DNA, 129 bp, Homo sapiens
  misc_feature: GYAE6OF01BEYUA.14.78.H01.1.454.CMB.1.raw
tcagcgtctagtaccacgaccggtgctcgatttagtgtgagtagtttgggtttgggcacagcggccctgggctgcctggtcaaggactacttccgtactagacgctgagcgggctggcaaggcgcatag

SEQ ID NO: 132192 - DNA, 130 bp, Homo sapiens
  misc_feature: GYAE6OF01A7C1G.14.78.H01.1.454.CMB.1.raw
  modified_base (130)..(130): a, c, t, g, unknown or other
  misc_feature (130)..(130): n is a, c, g, or t
tcagcgtctagtaccacgaccggtgctcgatttagtgtgagtagtttgggtttgggcacagcggccctgggctgcctggtcaaggactacttccgtactagacgctgagcgggctggcaaggcgcatagn

SEQ ID NO: 132193 - DNA, 131 bp, Homo sapiens
  misc_feature: GYAE6OF01BFJUA.14.78.H01.1.454.CMB.1.raw
  modified_base (130)..(131): a, c, t, g, unknown or other
  misc_feature (130)..(131): n is a, c, g, or t
tcagcgtctagtaccacgaccggtgctcgatttagtgtgagtagtttgggtttgggcacagcggccctgggctgcctggtcaaggactacttccgtactagacgctgagcgggctggcaaggcgcatagnn

SEQ ID NO: 132194 - DNA, 501 bp, Homo sapiens
  misc_feature: GYAE6OF01DUEDE.14.78.H01.1.454.CMB.1.raw
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtctgggggagcttggtcaagcctggagggtccctgagactctcctgtgcagcctctggattcaccttcagtgactactacatgacctggatccgccaggcgccgagggagggctggaatggattgcatacattcactatagtgaaatgcagtgtcctagcagactctctgaaggccgattcaccgtctccagggacaacgccaaagaactcgctgtatctgacaaatcgacggcctgagagtcgagacacgcatgtatacngtncgagngtgtgtggtcngtgtttaag

SEQ ID NO: 132195 - DNA, 861 bp, Homo sapiens
  misc_feature: GYAE6OF01DIGSN.14.78.H01.1.454.CMB.1.raw
  modified_base (820)..(820): a, c, t, g, unknown or other
  misc_feature (820)..(820): n is a, c, g, or t
tcagcgtctagtaccacgaccggtgctcgatttagtgtgagtagtttgggtttggggaggctctgggagaagagccccagccccagagttcccaggagtttccattcggtgatcagcactgaacacgagaggacctcaccatggacgtttcgggctgagcgtgggtcttccgttggttcgcgtaacttaagtaaaggtgtccagtgtcaagtgcagttggtggagtcggtgggggacgcgttggtacgaagcccgttgggacgggttccccttggacggtaccgttccgtccgtaggtcgaccgtaacggtcccttagttaggtaactttcctaaccgtttccgtaaaggttcgtaacttaacctaacgtacttaccggaacgttcgggaaacctccccggaccgaacgggccggacccgggaagggggtaacgggggccttaaggggtaaaacgttgggacgtttaccggaccgtaagttaaccgtacttttacccgaaagtttaaaccgttaggttaaacgggtaaaattccgggtaactacgggttacgttaccccgtaaacggccgtaaaccgtaccgtttacccgtccggttaacgggtaacccgggtacccgttaactttacccgggaccccggtttaccgggtaacccgtaacgggggtaaccccgaaacggtacccggtaaaaccggaccgttacgaccgtttacgtaacgttctacggacctaacggtaccggaccgggtaccgtagaacggtacggtacggaacggtaccgaccggactaacgttggtacgttacggtggtcggtacggngtaacgggtgttacggttacgttcgtagtttggttaacggg

SEQ ID NO: 132196 - DNA, 546 bp, Homo sapiens
  misc_feature: GYAE6OF01CSISL.14.78.H01.1.454.CMB.1.raw
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccattcaccgtctccagggacaacgccaagaactcgctgtatctgcaaatcgaacggcctgagagtcgaggacacggccatgtattactgtgcgagagtgtggttcggtcatgttttagaagtttggggctttttggacctactggggccagggaaccctggtcaccgtctcttcagcctccaccaagggcccagtccggtcttccccgtggccaccctcctccaagacgcacctcgtcggggcacacgcggcccgtgggctcgcctcggtcaaggctacttccgtactacgacgcgtcgagcgggctggcgaacgg

SEQ ID NO: 132197 - DNA, 590 bp, Homo sapiens
  misc_feature: GYAE6OF01D3SQA.14.78.H01.1.454.CMB.1.raw
  modified_base (516)..(516): a, c, t, g, unknown or other
  misc_feature (516)..(516): n is a, c, g, or t
  modified_base (562)..(562): a, c, t, g, unknown or other
  misc_feature (562)..(562): n is a, c, g, or t
  modified_base (567)..(567): a, c, t, g, unknown or other
  misc_feature (567)..(567): n is a, c, g, or t
  modified_base (570)..(570): a, c, t, g, unknown or other
  misc_feature (570)..(570): n is a, c, g, or t
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccgaggggaaggggctggaatggattgcatacattcactatagtggaaatgcagtgtcctacgcagactctctggaagggccgattccaccgtctccagggacaacgccaagaactcgctgtatctgcaaatcgacgcctgagagtcgaggacacggccagtgtatcgtgtgcgagtaggtggttggttcgtctagtttggtttagaggtttggggttctttacggaccgtacggtcggggaccgtacggggtaaccctggtacctaccgttctcttcacgcctaccgacccgaacggcccagttcccggtcccttccccgtcgccctaccctcctacgaagcgcctaccgtcggtcgggaccncgacggccgtcgcggcgtcgcgtcggacgacgtcttacgtcgtacncgacncgnggacggcggcgcggcgacgg

SEQ ID NO: 132198 - DNA, 739 bp, Homo sapiens
  misc_feature: GYAE6OF01A6GH1.14.78.H01.1.454.CMB.1.raw
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagcgtgggtcttccttgttgctattaataaaggtgtccagtgtcaagtgcagttggtggagtcgtgggggagcttggtcaagccgtgggacgggtccctgacgactctcctgtcgcagcctcgtaggtacttccacctttcagtcgtactactacatcgacctggactccgcgaggcgccgagggagggcaggaagtggattgctagtacattacgactatacggtaggaaattgactagttccgtacctacgactacgtaccttcgtacgtagggaaccgggtcctaactttcccgaaccccgtttccgacccgggaaacggggtaacccgtaaaccccggaccctaaaacgggtaacccgttaccggtacctttacgggtttaactcccggttaagaaccttaaaaccggtcccgggtaccggtaccgttaggaaccgggtaagggtacccgaacgggtacccgaacccggggtacctaggttacgttaaaccggtttcggacgggttacgaccgggtaaggtacggtttcggggttaaccgggttttcggtaaccttagggtttttagggttttaaaaccgggg

SEQ ID NO: 132199 - DNA, 572 bp, Homo sapiens
  misc_feature: GYAE6OF01CX54G.14.78.H01.1.454.CMB.1.raw
  modified_base (242)..(242): a, c, t, g, unknown or other
  misc_feature (242)..(242): n is a, c, g, or t
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggatcccgccaggcgccagggaaggggctggaatggattgcatacattcactatagtggaaatgcagtgtcctacgcagactctctgaaggccattcaccgtcnccgaggacaacgccaagactcgctgtatctgcaaatcgacgctgagagtcgagacacgccatgtatacgngtgcgagagtgtggttcgtnattgtttagagttgggtctttgacagtgggccaggacctggcacgtctctcacgcctccgacgaacggcctacgtccgtccttcccctcggccctacccctcctacccgaacgacgtaccgtacccgtccggtcgggacctaccgacgcccggacccgtcgggcctcgccgtcggtacgaacggtcctaccgttcccgtacgacggaccgcgtacggacggccgggcgtcggcgaacggg

SEQ ID NO: 132200 - DNA, 174 bp, Homo sapiens
  misc_feature: GYAE6OF01DUY29.14.78.H01.1.454.CMB.1.raw
  modified_base (172)..(174): a, c, t, g, unknown or other
  misc_feature (172)..(174): n is a, c, g, or t
tcagcgtctagtaccacgaccggtgctcgatttagtgtgagtagtttgggtttgggggaagaggaagactgacggtcccccaggagttcaggtgctgggcacagcggccctgggctgcctggtcaaggactacttccgtactagacgcgagcgggctggcaaggcgcatagnnn

SEQ ID NO: 132201 - DNA, 666 bp, Homo sapiens
  misc_feature: GYAE6OF01EN2WO.14.78.H01.1.454.CMB.1.raw
  modified_base (645)..(645): a, c, t, g, unknown or other
  misc_feature (645)..(645): n is a, c, g, or t
tcagcgtctagtaccacgaccggtgctcgatttagtgtgagtagtttgggtttggggagctctgggagaagagccccagccccagagttcccaggagtttccattcggtgatcagcactgaacacagaggactcaccatggagttgggctgagctggtcttcttgtgctattataaaggtgtccagtgtcaagtgcaggttggtggagtcgtgggggagtcttggtcaagccgtgggacgggtccctgacgactctcctgtcgcacgcctcgtggtacttccaccttcagtcgactactacatcgactggactccgcgaggccgacgaggggacgggctaggaatgggtattgactatactacttacaactataggtagaaatgactagttcgtacctacgctaacgtaccttcgtcgtaacggaacgggtcctacgtttccgaaccccggttccgacccggaaacggggtaacccaacccggaaccgtaaacggtaaccgttccggacttagttaacctcgtacgaaccgtaaacggtccggaaacggtccgttaggaacggtaggtaccgggaagacccgacggtcctaaggttacggttacttacggtgtacgacggtatacgggttggtacggtttcggtnttaggttggttttaaacgggg

SEQ ID NO: 132202 - DNA, 966 bp, Homo sapiens
  misc_feature: GYAE6OF01CGHI8.14.78.H01.1.454.CMB.1.raw
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctggtcttctgttgctatataaagtgtccagtgtcaagtgcagttggtggagtcgtgggggagtcgttggtcaacggccgtagggacgggttcccctaggacggtaccttccgtcccgtggtcgaccgtaacgtcccgttacgtcgggtactttacccgtaaccccgtttcgaacggttcggaaaccctttaaccgttaccaaggttccggaacccgtttggggtaaaccttccccgggacccggtaacggggtcccggaaccccgggtaaagggggggtaacggggtccgttaaggggtaaacgttcgggtactttacgggacttaacgttaaccgtacgtttacctaaaccgtttaggtaacggttacgggaaaactttcgggaaccgtttaacggttccggtaaccctaacggtccgtaaacgttacccgttccgttaaccggtacggggtaaaccggggttcccttaaccgtttaccccggaaccccggtttccgtaacccgggtaaacgggtaaacccgtaaacccgggtaaccccggtaaaggtaaccccgtttcccgggagttttaccggttaaaccgttccggtaacggttaacccgtaaaacggttcccggggtaacccggttacggttaacggaaacgggttcccggtaaacgggaaccgggtaaccgtacccgggttaccgttaaacggttacgtttaaccggttacggttaccgggtacggtacccgggtaaagggttcggtttacggggtttcccgggtttaaccgttcgttaagggtttttcggttttaaaacggggg

SEQ ID NO: 132203 - DNA, 643 bp, Homo sapiens
  misc_feature: GYAE6OF01D6AJC.14.78.H01.1.454.CMB.1.raw
  modified_base (354)..(354): a, c, t, g, unknown or other
  misc_feature (354)..(354): n is a, c, g, or t
  modified_base (636)..(636): a, c, t, g, unknown or other
  misc_feature (636)..(636): n is a, c, g, or t
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggatcccgccaggcgccgaggggaaggggctggaatggattgcatacattcactatagtggaaatgcagtgtcctacgcagactctctaggaacgggccattccaccgtctaccgagggaccaacgccaagaactcgctgtactctagacaaatcgacggcctgagagtcggaggacacggcctatgtattactggtgcgagaggtgtggttcgtnagttgtttagaggtttgggtctttagaccgtacgtcggggaccacgggtaccctggtaccaccgttccgtctcacgtcccctacccgaccggaccggcccctacgttcccggttcccttcccccgtcggcccctacccctccctaccgaacgtccgcccgtaacccgtcggtacggggacctacggaccggcccggcccgtcgggctccggtccgtccggtacgtaccggtaccttaccgttaccggtacgacgacgtcgtacggacggtccgggcggtggngaccggg

SEQ ID NO: 132204 - DNA, 731 bp, Homo sapiens
  misc_feature: GYAE6OF01DB3AP.14.78.H01.1.454.CMB.1.raw
tcagcgtctagtaccacgaccggtgctcgatttagtgtgagtagtttggggtttgggggaggcttggtcaagcctggagggtccctgagactctcctgtgcagcctctggattcaccttcagtgactactacatgacctggatcccgccaggcgccgaggggagggggctggaatggattgcatacattcactatagtggaaatgcagtgtccctacgcagacctctcgtggaagggccattcaccgtctccgagggacacgccaagaactcgctgtatctgacaaatcgacggcctgagagtcgaggacacggccatgtattactgtgcgagagtgtggttcggtctagttgttttaaggaaggtttcggggtcttttggacctacggtggggcccgaaggggtaacccgtggtccaccgttcttccttcacgtcctaccacccgaacgggccctacgtcccggttacccttcccccgtcgggcccctaccccttaccccgtacccgaaacggacgtacccgtacccgttccgggtacggggggtacccaccggaaccgggtcccccgggtccccgggttcggggtcccgttccgggtaccccgggttacggggttacccggaaaccggggtaccctttaaccccgtttaccccggttaaaccgttaacggacccggtccggttacgggacccgggtaccggggtccgtacgggaccggtaaacccgggg

SEQ ID NO: 132205 - DNA, 577 bp, Homo sapiens
  misc_feature: GYAE6OF01DH12K.14.78.H01.1.454.CMB.1.raw
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaagggctggaatggattgcatacattcactatagtggaaatgcagtgtcctagcagactctctgaagggccattcacgtctccagggacaacgcaagaactcgctgtatctgcaaatcgacggcctgagagtcgaggacacggccatgtatactgtgcgagagtgtggttcgtctatgtttagagttgggtctttgactacgtgggcagggaacctggtcaccgtctctcacgcctaccacgacggccacgtccggtccttccccgtggcccaccctcctaccgaacgacgccacctcggtcggggtaccacgacgccggtcccgtgggtcctacggtccgtggtaccgaaacgggtaccttaccgttcccggttacgtacggaccgacgtcggaacggccgggcgtgggcgaaacggg

SEQ ID NO: 132206 - DNA, 758 bp, Homo sapiens
  misc_feature: GYAE6OF01BP5U0.14.78.H01.1.454.CMB.1.raw
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggactccgccaggcgccgaggggaagggctggaatggattgcatacattcactatagtggaaatgcagtgtcctacgcagactctctggaacgggccgtattccaccgtctaccgagggacaacgccaagaactcgactgtatctgacaaatcgacggcctgagagtcgagacgacggcagtgtaattactgtgcgagtagtggtcggttcggtactagttggttttaaggaaggtttcggggttactttttcggaccgtacggttcgggggaccctaacggggtaaccccgttgggtacccgtacccgttccgttaccgttccgtaaccgtcccctaacccgaacccggtaaaccggggtccccctaaggttccccgggttccccgtttaccccccgtccgggtcccctaaccccctccccgtaacccgaacgtaccgtacccgtaacccgtccgggttaccgggggacctaccggtaccggccccgggtacccggtccggggcctccgggtacccgttacgggtaaccggtaaccggtacccgtttacccgttacccggttaccgtaacggtacccgtacggttacggacgggtccgggaccgtggaccggtaacggg

SEQ ID NO: 132207 - DNA, 837 bp, Homo sapiens
  misc_feature: GYAE6OF01CEKVU.14.78.H01.1.454.CMB.1.raw
  modified_base (763)..(763): a, c, t, g, unknown or other
  misc_feature (763)..(763): n is a, c, g, or t
tcagcgtctagtaccacgaccggtgctcgatttagtgtgagtagtttgggtttggggagctctgggagaagacgccccagccccagacgttcccaggtagtttccattcggtgatcagcactgaacacagaggactcacagtggagtttgggctgagcgtgggttcttccttgttgctattaataaaaggtgtccagtgtacaagtgctaggttgggtggaggtcggtggggggaggtcgttgggtacaacggtccgtgggacgggtccctaggacgtaccttcctccgtggtgccgagccttcgtggtacttccaccttgagtctaactactactagtcgaccgtggactcccgacgaggccgaccggaggggaggctaggagtggtatagactaataccgtattcaacttaaggtaacgtaggaaatcgacgtacggttacgttacccgacgtaccgtaagtaccgttaccgttacggtaaggggaacccggggtacctttaccgttaacccggtaccccgtcccggtttaaccccggaaacgggggttaaacccccaaaccccgggttaaccgaaaaaccggtaacccgtttaacccgggtcgtttaaacgggtttacctttaaccggtaacgggtaaacccgaaaacccgggttccccgggtaaacccgggtaccgtaagggtaacgggaacccggttaacggaacccgggaacggtacccgggacctttaaagggttaccgtttaaagtttaccgggnggtacccgtaaggggtaagtccgggtttagggttacggttacccggttagtttaggtttagggttttaacgggg

SEQ ID NO: 132208 - DNA, 933 bp, Homo sapiens
  misc_feature: GYAE6OF01CMSEK.14.78.H01.1.454.CMB.1.raw
tcagcgtctagtaccacgaccggtgctcgatttagtgtgagtagtttgggtttggggagctcgtgggagaagacgccccagccccagagttcccaggagtttccattcggtgatcagcactgaacacagaggactcaccagtggagtttgggctgagcgtgggttcttcttgtgcttatagtaaagtgtcagtgtcaagtgcgtaggttggtgggacggttcggtaggggggtacggtcgtttcggtaccgaaacggtccgttagggaccgggttccctagacgtacccttccgtccgtggtcgaccgtaggtcccttcggtacggttaacctttcccttaaccccgttttgtaacgggttaaccgttaaccttaaacccgttaaactacgttacccggtaaccccggtttaaggggaaacccgttcccccgggacccggaacgggggaccccggttaacccggggaaagggggggtaaacgggggtccgttaaggggtaaacggttagggtaacttttcgggaacttaaactaacgttactttacgaaacttaaggtaaacggttaaggtaaagttcggacgttaacggttcgtaacccgtaggactaacgtacttccgtacgtacggtaacgggccctaagttacccgaccgttccgaaccggaaacgggtaccctaacggaccctaaacgttacccgcgttacgttaacggacttacgtacggaacctaaacggttcccgggaaccggttccgtagggtaaacggtacgggttaccggaaacggtacccggtacccggtaaaccgtggtttaacccggttaacggtttacgttcggggtaaaggttaccggtaagggtttaccgggtttcgggtttaacgggttccggtttaaacgtttaaggggtttttacgggttttaaaaccggggg

SEQ ID NO: 132209 - DNA, 646 bp, Homo sapiens
  misc_feature: GYAE6OF01BFI6A.14.78.H01.1.454.CMB.1.raw
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggatccgcaggccgccaggggaaggggctggaatggattgcatacattcactatagtaggaaatgcagtcgtccctacgcagaccttctcgtaggaacgggtccaatttccacccggttctaccgagggaccaaccgccaaagaacctcgcttagtatctagactaaacgtccggaccggcctaggagtacggtacggacggaccgaccgggacctagttacgttatttacgtggtggacgtaggtggttaggttcggttacggtctagtttggtttaaggtaggtttggggtctttcgaccgtacggtcgggaccgacgggtaaccctggtaccaccgttcttctcacgcctaccgaccgacggcctacgtcgtccctccccgngcccnccctccgtacacgccgccaccgtcggcgggcacgcgcccggccgtcgggtactcggccgtggtaccgaacggtctaccgttcgactacgacgtcgaggacggtcggcgtggcgtacgg

SEQ ID NO: 132210 - DNA, 854 bp, Homo sapiens
  misc_feature: GYAE6OF01ARMJL.14.78.H01.1.454.CMB.1.raw
  modified_base (785)..(785): a, c, t, g, unknown or other
  misc_feature (785)..(785): n is a, c, g, or t
  modified_base (804)..(804): a, c, t, g, unknown or other
  misc_feature (804)..(804): n is a, c, g, or t
  modified_base (816)..(816): a, c, t, g, unknown or other
  misc_feature (816)..(816): n is a, c, g, or t
  modified_base (840)..(840): a, c, t, g, unknown or other
  misc_feature (840)..(840): n is a, c, g, or t
tcagcgtctagtaccacgaccggtgctcgatttagtgtgagtagtttgggtttggggagctctgggagaagagccccagccccagagttcccaggagtttccattcggtgatcagcactgaacacagacggactcacctagtggtaggtttcgggctgagtcgttcggggttcctttcccgtttggttctacttatttaagttaaaaggttcgtaccgtaaggttgtactaagttggacgtagggtttgggttggtaacggttcgggtagggggggaggttccgtttagggttaccaacggtccggtacggggtaacgggggtttcccctaggtaaccggtccttcccgttaccgtcggttaccgtaccgtaccggtccttacggttacggttaacctttaccctacccgtttacacggttaacgtaaccctttaacgtaccgtaccgttaccggtaccgtcgggtaaccgtcccggacccggacgggcccgggtaacccggggaaggggggtaaccggggtacggtttaagggtaacggttgggtacttacggacctaagtaccttacgttaacgtacgttagtacggtagtaacgttcgtaactcggtacgttaccaccggtacgtaacgtcccgttagtaacgggacggaaccgggttacctacgttaccgtacccgtttcgaccggtaaaccggaacctaaccgaaccgtaacgttaccgtcgttactacggttactcgaacgtacaacggtccgacgtcgaggtacgcgacgacgaccgnacgtagttatacgttacgngtacggacggtnttagggtctacggttattacggtnttacgggtttacgg

SEQ ID NO: 132211 - DNA, 873 bp, Homo sapiens
  misc_feature: GYAE6OF01AHLT3.14.78.H01.1.454.CMB.1.raw
  modified_base (140)..(140): a, c, t, g, unknown or other
  misc_feature (140)..(140): n is a, c, g, or t
  modified_base (538)..(538): a, c, t, g, unknown or other
  misc_feature (538)..(538): n is a, c, g, or t
tcagcgtctagtaccacgaccggtgctcgatttagtgtgagtagtttggggtttggggggaggcttggtcaagccctgggaggggtccctgagacctctcctgtgcagcctctggattccaccttcagtcgactactacntcgacctggactccgccgaggccgaccgagggggacggggctgggaatgggaattcgctatacctattcacttagtaggtaggaaatcggcgtacgttcggtacctacggactacggtaaccttcgtaccggtagggtaaccggggcccttaagttaccccaccccgggtttaccgaccgggaaacggggaacctaaaccggaaccgtaaaacggtaacccgtccggttacgttacggtaaccgttcgtacgaaacgtaacccggttcgggaccggtcgtaggtacggacggtaccgggaacgaccgtaccggtacgtattacggttaattccgtgtacgggacgtaggttacgggttcggttacggttcggtactttaggtttaacgggttttaggnggggtttcggtttcgtttacggacgttcgggacgggaccgtacggtacccgtagtccgtacgttcttacgtcctaccgtccgtaccgaaccggtacggtacccttacggttcccggtcccttacccggtaccgtaccccgtaccctccgtaacccgtaccggacccgtccgtacggtcccgggtaccgggactacccgggccgggtacccggtccggtacgggtccgttaccggtccggtaccggtaaccggttaacgtcccgtttaaccggtaccggtcgtaccggggtactacgggtaacgggcgggtaccggtcgtaccgggtacggaacgg

SEQ ID NO: 132212 - DNA, 173 bp, Homo sapiens
  misc_feature: GYAE6OF02ICG2T.14.78.H01.1.454.CMB.1.raw
  modified_base (173)..(173): a, c, t, g, unknown or other
  misc_feature (173)..(173): n is a, c, g, or t
tcagcgtctagtaccacgaccggtgctcgatttagtgtgagtagtttgggtttgggggaagaggaagactgacggtcccccaggagttcaggtgctgggcacagcggccctgggctgcctggtcaaggactacttccgtactagacgctgagcgggctggcaaggcgcatagn

SEQ ID NO: 132213 - DNA, 549 bp, Homo sapiens
  misc_feature: GYAE6OF02HGPWH.14.78.H01.1.454.CMB.1.raw
  modified_base (371)..(371): a, c, t, g, unknown or other
  misc_feature (371)..(371): n is a, c, g, or t
  modified_base (511)..(511): a, c, t, g, unknown or other
  misc_feature (511)..(511): n is a, c, g, or t
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtcgtgggggaggcttggtcaagcctgggagggtccctgagactctcctgtgcagcctctggattcaccttcagtgactactacatgacctggactcccgccaggcgccgaggggaacgggctggaatggattgcatacattcactatagtggaaatganagtgtcctacgcagactctctgaagggccgtattcaccgtctccgaggaccaacgccaagacctcgctgtactctagacaaagtccgaacggtcctagacgacgtcggaacggaccacggccaagttcgtattacgtggngcgtagtaggttggtggttcggtctagttgtttaaggg

SEQ ID NO: 132214 - DNA, 609 bp, Homo sapiens
  misc_feature: GYAE6OF02HW22X.14.78.H01.1.454.CMB.1.raw
  modified_base (280)..(280): a, c, t, g, unknown or other
  misc_feature (280)..(280): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
  modified_base (540)..(540): a, c, t, g, unknown or other
  misc_feature (540)..(540): n is a, c, g, or t
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagcgtgggtcttccttgtgctattataaaggtgtcagtgtcaagtgcagttggtggagtcgtgggggagctttggcaagcctgggacggtcctgagctctcctgtgcagcctctggtattctaccttnagtgtactactacatgacctggactcccgcaggcgccgagggagggctggaatggattgcatacattcaactataggtagaaagtnacgtagtcgtaccttacggntaacgtccttctcgtacggaacgggtccgatttccgaccgttccgtaccgaacgggacgaaccgaccgaaacgtaaccgtcgtaccgtagtactcgttagacctaaacgttccgaccgaccgtggaacgtacggtcgaacggaccgcggaccgngttacgtattacgttggagtcggagtaggttcggttcgggtttacgggtctacggtttagtttaacggg

SEQ ID NO: 132215 - DNA, 542 bp, Homo sapiens
  misc_feature: GYAE6OF02IFDOD.14.78.H01.1.454.CMB.1.raw
  modified_base (282)..(282): a, c, t, g, unknown or other
  misc_feature (282)..(282): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtctggggggagcttggtcaagcctgggagggtccctgagactctcctgtgcagcctctggattcaccttnagtgactactacatgacctggactccgccaggccgccgaggggaagggctggaatggattgcatacattcactatagtgaaattgacngtntcctagcagactctcgtgaacgggccattccaccgtcgaccgagggaccaaccgaccaaagaactcgctgtanctgactaancgacggctagagtgacgagacacggccagttagtacttacgtgtcgacgaggtaggtggttggttcggtacttagttgttttaaggg

SEQ ID NO: 132216 - DNA, 584 bp, Homo sapiens
  misc_feature: GYAE6OF02IPD9N.14.78.H01.1.454.CMB.1.raw
  modified_base (440)..(440): a, c, t, g, unknown or other
  misc_feature (440)..(440): n is a, c, g, or t
tcagcgtctagtaccacgaccggtgctcgatttagtgtgagtagtttgggtttgggggaggcttggtcaaacctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcattgtttagaagttggggtcttttgacctacgtgggccagggaaccctggtcaccgtctcttcagcctccaccaacggcccatcggtcctccccctggccnccctccctccaacgacgccacctcgtcgggggccacgacgccggccctggggcctcggcccgtggtacgaaggtaccttaacgttcccgtaacgtacggaccgtcgtacggacggtccggggcgtcgggaccgaagggtcccgg

SEQ ID NO: 132217 - DNA, 608 bp, Homo sapiens
  misc_feature: GYAE6OF02I641L.14.78.H01.1.454.CMB.1.raw
  modified_base (315)..(315): a, c, t, g, unknown or other
  misc_feature (315)..(315): n is a, c, g, or t
  modified_base (350)..(350): a, c, t, g, unknown or other
  misc_feature (350)..(350): n is a, c, g, or t
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtctgggggaggcgtggtccagcctgggaggtccctgagactctcctgtgcagcctcgtggtacttccaccttcacgtacctatgctatgcacgtcgggtcccncgaggcctccgaggcggaggggctgggaggtgggnggcgtattatatcactagtgagtaggaaactaagtacgacgtctagtcgcccgtacgtccggtaggaacggggtcctaattccacctactccaccgagacgaactaacttaccgaaagaaccacgacgtatactcgtacgactaaagtcgaaacgacgtacccgtagaacgagtcgtaggacggaccgtacgggtcttaggttagttaacgttacgttagggtagggagtacggtaggtacggggtacggtactaagg

SEQ ID NO: 132218 - DNA, 563 bp, Homo sapiens
  misc_feature: GYAE6OF02ISNOV.14.78.H01.1.454.CMB.1.raw
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
  modified_base (514)..(514): a, c, t, g, unknown or other
  misc_feature (514)..(514): n is a, c, g, or t
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtcgtgggggaggctttgggtcaagcctggagggtccctgagactctcctgtgcagcctctggattccaccttcagtcgactactacatgacctggatccgcaggcgcagggaggctgatggatgcatacatcactatagtggaaatgcagtcgtcctagcgagacttctctggaaacgggccgaattccgaccgttctccgagggaccaaccgccaaagacctcgacngttactctanacaaagttccgacggtcctggagtagtaccggaaggaccgacggccaggttagtatttaaccgnggttcgcgtaggaggttcggttggttccggtagttagttagtttaacgg

SEQ ID NO: 132219 - DNA, 734 bp, Homo sapiens
  misc_feature: GYAE6OF02J1XZT.14.78.H01.1.454.CMB.1.raw
  modified_base (185)..(185): a, c, t, g, unknown or other
  misc_feature (185)..(185): n is a, c, g, or t
tcagcgtctagtaccacgaccggtgctcgatttagtgtgagtagtttgggtttgggagctctgggagaagagccccagccccagagttcccaggagtttccattcggtgatcagcactgaacacagaggactcaccatggagtttgggctgagctgggtcttccttgttgctattataaaaggtntccagtgtcaagtgcagttggtgagtcgtgggggagcttggtcaagcctggaggtccctgagactctcctgtgcagcctctggactttccactttcaggtgtactactacatcggacctgggactcccgaccagggccgtcccgaagggggacgggtctagggaactgggaacttggcctaattaccatttccgaacttagtacgtaaggaaattggctagggtcgtcccttacggcaagtccttacgtccgtagaaccgggtcctaacgttccaccggttacctaccggtaacgggacctaaccggaccctaaacggtaaccccttacgggtaccttaacgggttcttaccggttacgaaccgtaaacgtcccggtaacccgggtacctagggaacggtacggtaccggtaacgggacccgtaccggggtaccgtagtttacggtaacctttaaccggtcggttaacggtccccggtaaagggttacggtttacgggttacggggttttacccggtttacgttacggttttacgggtttttaacgggg

SEQ ID NO: 132220 - DNA, 606 bp, Homo sapiens
  misc_feature: GYAE6OF02I5E5C.14.78.H01.1.454.CMB.1.raw
  modified_base (294)..(294): a, c, t, g, unknown or other
  misc_feature (294)..(294): n is a, c, g, or t
  modified_base (555)..(555): a, c, t, g, unknown or other
  misc_feature (555)..(555): n is a, c, g, or t
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttcctgttgctattataaaaggtgtccagtgtcaagtgcagttggtggagtctgggggagtcttggtcaagcctgggaggtccctgagactctcctgtgcagcctctggattccaccttcagtcgactactanatgacctggactccgccaggcgccgagggagggctaggaatggatgcaatacattcaactagtagtaggaaatgactagtcgtacctacggactacggtactcgttacgtacggaaacgggccttaagttccgacccgtcgtacccgagggtaaccaaccggaccaaaggtacctcgacgttacgtattccagtaccaaagttccggacgtccgtagacgagtaccggaaggaccaccggaccgtatacggttacttacgnggtacgcggtaaggtcgttggttgggttaccgtagtagttggttttaacgg

SEQ ID NO: 132221 - DNA, 653 bp, Homo sapiens
  misc_feature: GYAE6OF02GBI26.14.78.H01.1.454.CMB.1.raw
tcagcgtctagtaccacgaccggtgctcgatttagtgtgagtagtttgggtttgggggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtcgtgggggaggcttggtcaagccgtgggagggtcccctggagactctcctgtgcacgcctctggattcaccttcagtgacctactacatcaccgtggactccgccagggccgccggaggggaagggctagggaatggattgcatactattcatataggtaggaaatgactaggtcgtacctacggacacgtactactcgtagggaacgggtccgtacgttccgacccgttctaccggacgggaaccaaccgacgaaacgactcgacttcgtacttcgtacgactaaacgtccggtaccggtaccgtagaacggtacggtacggaacgggaccgaccgggtaccgagttacggttaacgtttacgttggtacggtacggtaaggtacgggtttcgggttcggtttacgggttacgttaggttttagggtttttaaacggg

SEQ ID NO: 132222 - DNA, 589 bp, Homo sapiens
  misc_feature: GYAE6OF02GUW4X.14.78.H01.1.454.CMB.1.raw
  modified_base (462)..(462): a, c, t, g, unknown or other
  misc_feature (462)..(462): n is a, c, g, or t
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattccaccgtctccgagggacaacgccaagaactcgctgtatctgcaaatcgacggcctgagagtcggaggacacggccatgtattactgtgcgagagtgtggttcggtctattgttttaagaggttggggttctttcgaccgtacgtcggggccaacgggacccgtggtccgaccgtctccgttcacgccctccgaccgaacgggcccagttcccggtcccttccccgnggtccctccccgtcccaccaacgcgcctaccgtcggtcgggccacgcgccggccgtcggctcgccgtggacgaacggtcctacgttccgtaagtacgtccggcgtcggcggccggcgtggacgacgg

SEQ ID NO: 132223 - DNA, 569 bp, Homo sapiens
  misc_feature: GYAE6OF02G6UKZ.14.78.H01.1.454.CMB.1.raw
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccaggacaacgccaagaactcgctgtatctgcaaatcgacggcctgagagtcgaggacacggccatgtattactgtgcgagagtgtggttcggtcagtgttttagaagttgggtcttttgacctagtggggccagggaccctggtaccnccgtctcttcngcctccaccgaagggcccagtccggtcctcccctggccctaccctccctccaacgacgccaccgtccgtcggggccacgcgccgcccgtgggcctcggccgtggtaccgaacggtactaccttccggtaactacgacgcgtcggacggcgggtctcggctaacggg

SEQ ID NO: 132224 - DNA, 570 bp, Homo sapiens
  misc_feature: GYAE6OF02HM1GC.14.78.H01.1.454.CMB.1.raw
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (459)..(459): a, c, t, g, unknown or other
  misc_feature (459)..(459): n is a, c, g, or t
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccaggggaagggggctgggaatggattgcatacattcactatagtggaaatgcagtgtcctacgcagactctctgaagggccgattccaccgtctccagggacaacgccaagaactcgctgtatctnacaaatcgacggcctgagagtcgaggacacggccatgtatactgtgcgagngtgtggttggtcatgttttagagttgggtctttgacctgtgggccagggaccctggtcaccgtctctcgacgcctccaccgaacggcccagtccggtccttccccgtgtcccaccctcctaccacgacnccaccgtcggtcggggacacgacgccgccgtgggcctcgccgtgtacgaacggtcctaccgttacgtaccgtacgaccgtcgtggacggcgggtcgtcgggacgtaacggg

SEQ ID NO: 132225 - DNA, 648 bp, Homo sapiens
  misc_feature: GYAE6OF02I80XQ.14.78.H01.1.454.CMB.1.raw
  modified_base (281)..(281): a, c, t, g, unknown or other
  misc_feature (281)..(281): n is a, c, g, or t
  modified_base (560)..(560): a, c, t, g, unknown or other
  misc_feature (560)..(560): n is a, c, g, or t
tcagcgtctagtaccacgaccggtgctcgatttagtgtgagtagtttgggtttggggagctctgggagaagagccccagccccagagtcccaggagtttccattcggtgatcagcactgaacacagaggactcaccatggagtttgggctgagctgggtcttccttgttgctattataaaaggtgtccagtgtcaagtgcagttggtggagtcgtggggggaggtcttgggtcaagccgtgggacgggtccctggacgactcctcctgtgcagcctctggnttccaccttcagtgactactacatcgacctggactccgccgaggccgccgagggggaacgggctaggagtggagttgctaatctacttcaacttagacggtaggtaaatcgacgtaagttcgttacctacgtcgaagtaccgttctcgtagggaacgggtccgtaacgttcgtacccgtcgtaccggaagggaccaaccgaccgaaaggtaaccctgcctagtactcgtaagaccaaagtccgaacggtcctaggaacgacggtaccggacgggaaccncggtaccagttacgtaacgtttacgcgggtaggtaccgaggttacgggttggtaccgggttcgacggttactttagggttttaacggg

SEQ ID NO: 132226 - DNA, 911 bp, Homo sapiens
  misc_feature: GYAE6OF02IAKM4.14.78.H01.1.454.CMB.1.raw
  modified_base (246)..(246): a, c, t, g, unknown or other
  misc_feature (246)..(246): n is a, c, g, or t
tcagcgtctagtaccacgaccggtgctcgatttagtgtgagtagtttgggtttgggggaggcttggtcaagcctggagggtccctgagactctcctgtgcagcctctggattcaccttcagtgactactacatgacctggatcccgccaggcgccagggagggctggaatggattgcatacattcactatagtggaaatcgcagtgtcctacgcagactctctaggagggccgtattccaccgtcnccgaggacaacgccaagaactcgctgtatctgacaaatcgacggtcctagagaggtcgaggaacgaccggccaatgtatttacgtagtcggcgtagaggttggttgggtttccggtctaggtttagtttttaggaaacgggttttcggggtccgtttttaggaaccctacgggttcggggacccgtaaccgggggtaaaccccttcggggtttaccccgtaaccccggttacggtttacccctttacccggtaacccgtaccccgtttcccccgaaaacccggtaaaccggggtacccccggtaaaccgtttccccggggtttacccccgttttccccccccggttacggggtccccccggttaacccccttacccccgtttaacccccgaaaacgggtaaacccggtcccgtaaacccccggttcccggggttaccgggggggaacccttaaaccccgggaaccggggtacccccggggtacccccggggtccggggtaaccgtttccgggaccccgtttaccgggggttacccgaaaaccgggttaaccgttttaaaccccggtttaccccggttaaaccgtttaaccgggtacccggtacccggtttacgggaaacccggggtcccggggtcccggttaacggggtacccggaaacccgggg

SEQ ID NO: 132227 - DNA, 641 bp, Homo sapiens
  misc_feature: GYAE6OF02HLPJ0.14.78.H01.1.454.CMB.1.raw
  modified_base (273)..(273): a, c, t, g, unknown or other
  misc_feature (273)..(273): n is a, c, g, or t
  modified_base (553)..(553): a, c, t, g, unknown or other
  misc_feature (553)..(553): n is a, c, g, or t
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttccttgttgctattataaaaggtgtccagtgtacaagtgctagttggtggagtcgtgggggagtcttggtcaagccgtgggacgggtccctgacgactctcctgtcgcacncctcgtaggtcttccaccttcagtcactactacatcgacctggactcccgacgacgggccgaccggagggggtaacgggcgtaggaacgtgggtatgacatacattacactaagtagaggtaaatcgagtacgtcgtacctacggacaggtacctcgtacgtaacgggacgggaccttaacgtccgaacccgtcgacccgagggaaacccaaccgaccgaaacgtccgtacgtcgtcgtaacgtcacgaactaagtcccggagtcccgtagacgtacggngaacgaccgaccggctagtttacgtacttacgtggacgacggtagtcggtttacggtgggttaaccctgttaggtttgtttaacgggg

SEQ ID NO: 132228 - DNA, 877 bp, Homo sapiens
  misc_feature: GYAE6OF02HBKI9.14.78.H01.1.454.CMB.1.raw
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttcttgtgctattataaaggtgtccagtgtacaagtgcagttggtggagtcgtgggggagtcttggacaaggccgtgggacgggtccctggacgtacctcctccgtgtcgctacggtcctcgtaggtacttcccaccgtttcacggtcgaaccttacctaactagtcggtaaccgttggtactaccccgacgtaagggccgacccggaagggggacggggctagggaaagtgggtaacttgacgtacttacgacttaccgaactagttaaggtaggtaaatcggtacgtaacggttccgttaacccgacgtacgtacgtaaccgttccgttacgtaacgggaaccggggtaccgtaacggtttacccgaacccggtttcccgtaaacccgggtaaccgggtaaaccggtaaaccccggtaaaccggaaaccggtaaaccccgttaccggttaccgttaacggttaaccggttacgttaacccggtaaacggtaaacccggttttacccgggaacccggttacccggtaaggtaacccggggtaaccgggttaaaccgggaaaccgggttaaccgacccgggttaacccgtacggtttaaccggtttaaccggttaaccggttcgggttaaccggacgggttaacggttacgggttacgggttttaccggggttacgggtttaacgtttaccgggtttagggtttttaaaaccgggg

SEQ ID NO: 132229 - DNA, 762 bp, Homo sapiens
  misc_feature: GYAE6OF02G1WSA.14.78.H01.1.454.CMB.1.raw
  modified_base (401)..(401): a, c, t, g, unknown or other
  misc_feature (401)..(401): n is a, c, g, or t
  modified_base (574)..(574): a, c, t, g, unknown or other
  misc_feature (574)..(574): n is a, c, g, or t
tcagcgtctagtaccacgaccggtgctcgatttagtgtgagtagtttgggtttggggggaggcgttggtcaagcctggagggtcccgtgagactctcctgtgcagcctctggattcaccttcagtgactactacatgacctggatccgccaggccgccgaagggggaacgggtctagggaatgggaattggcatactattaccactagtaagtggaaatgtcagtgtaccctagccagtactcctacgtggaacgggtccgtatccaccggtctccgaagggaccaaccgaccaacgactacgctgtactctacgacaagtcggacggctaggagtacgacggtaacgacgaccgtacgaatcgtaacttactgtcgacgaggtaggtgtcgggtacggtntacgttgggtttaaggtacggtttagggtcgttttacggaccgtagggtcggggtaccgaccgggttacccacgggtcctacccgtcttacgttaccgaccgttccccgaccgtaaccggaccggtcctacggtcccggtttccccttccccgggtccggtaccttaaccccncccgttaccgaacggtaccaccgtccggtaccgggtcgggacccgtacgacccggttccggcccggttacggcccgttccggacggttcgggtaacccgtaccggttaaccgttaacccgttacccgtaaccggttaaccgccggtaccggttcgggaccggttaccggacggttcgggaaccacggg

SEQ ID NO: 132230 - DNA, 623 bp, Homo sapiens
  misc_feature: GYAE6OF02HXH8L.14.78.H01.1.454.CMB.1.raw
  modified_base (250)..(250): a, c, t, g, unknown or other
  misc_feature (250)..(250): n is a, c, g, or t
tcagcgtctagtaccacgaccggtgctcgatttagtgtgagtagtttgggtttgggggaggcttggtcaagcctggagggtccctgagactctcctgtgcagcctctggattcaccctttcagtgacttactaacatgacctggatccgccaggcgcccgaggggaagggctggaatggattgcatacattcactatagtggaaatgcagtcgtcctacgctagactctctaggagggcattcacccgtntccgaagggaccaacgaccaaagaacctcgctgtactctgacaaattccgacggtacctagaacggaggtcgaacggacacggccagtagtaacttactagtgcgtacgagttgtggttcgtatagttcgttttaagagttgggttctttagaacacggtcgggacacgggaacctggtcaaccgtctctacacgtccctcaacgacggccagtccgttccttcccgcgccaccctaccacgtaacgacgtcaccgttcggacggggactaccgacgccgtccgtcggacctcgtcgtacggtaccgaaggtaaccttaccgttaccgtaacgttacgacgtcgtacggaccgtacgggcctaggtacaacgg

SEQ ID NO: 132231 - DNA, 614 bp, Homo sapiens
  misc_feature: GYAE6OF02FULG0.14.78.H01.1.454.CMB.1.raw
tcagcgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtcgtggggggaggtcgttggtcaagccgtgggagggtccctgacgactctcctgtgcacgcctctggattccaccttcagtgactactacatcgacctggactccgccgaggccgccgagggggaacggggctagggaagtggattgcacgtacattacaacttataggtagtaaagtgactagtcgtacctacgcagtactctcgtaggaacgggcctattacccaccgtactaccgacgggaaccaccggaccaaagacctcggtactagtactcgtagactaaacgccggacgtccgtagagtacgacggaagaccggacgccctaatagtaacttacgtcggtagtaccggagttacggtggtttacgggttcggtactttagtttaggtttaacggg

SEQ ID NO: 132232 - DNA, 777 bp, Homo sapiens
  misc_feature: GYAE6OF02HLBAP.14.78.H01.1.454.CMB.1.raw
  modified_base (327)..(327): a, c, t, g, unknown or other
  misc_feature (327)..(327): n is a, c, g, or t
  modified_base (404)..(404): a, c, t, g, unknown or other
  misc_feature (404)..(404): n is a, c, g, or t
  modified_base (685)..(685): a, c, t, g, unknown or other
  misc_feature (685)..(685): n is a, c, g, or t
tcagcgtctagtaccacgaccggtgctcgatttagtgtgagtagtttggggtttggggggaggcttggtcaagcctggagggtccctgagactctcctgtgcagcctctggattcaccttcagtgactactacatgacctggactccgccaggcgccgaggggaaggggctggaatggattgcatacattcactatagtaggaaatgcagtgtcctacgcgacgactctcgtggaagggccgtattccaccgtcctccgagggaccaacggacctaaacgaacgtcgactacgtatctgaactaaactcggaccggctaggaacggnggtacggaacggaccgacggcctaagttcgtaacttaggtcgtacggacggagtcggtgggtttcgggttaccggtntaagtttggggttttaaacggtaaggggtttcggggttacttttacggaacccggttacgggtacggggtaacccggtacggggtaaacccgtcggttaacgtcccgttacgttccgtcctacgtcccctaacccgaaccggaaccgggtccgtaccggttacccggtttcccctaccccgttcgggacccctcccgttaccctacccgtaaggccctacccggaccgtccggggttacggaccgtaccgacggtcccgggtcccgggacgtccggttacnccgggtttacggaccgttaacggacccttacggttacccgtaaccgttcgggacctacggtcggaggtcccgggtacggtcggacgtaccgg

SEQ ID NO: 132233 - DNA, 792 bp, Homo sapiens
  misc_feature: GYAE6OF02FG209.14.78.H01.1.454.CMB.1.raw
  modified_base (323)..(323): a, c, t, g, unknown or other
  misc_feature (323)..(323): n is a, c, g, or t
  modified_base (568)..(568): a, c, t, g, unknown or other
  misc_feature (568)..(568): n is a, c, g, or t
tcagcgtctagtaccacgaccggtgctcgatttagtgtgagtagtttgggtttggggaggctctgggagaagagccccagcccccagagttccccaggagtttccattcggtgatcagcactgaacacagaggactcacccatcggagtttggctgagctgggtctccttgttgctatataaacggtgtccagtgtcaagtgcaggttgtggagttcgtgggggagtcttggcaacgcctggacggtccctgacgactctcctggtcgcacgccctacgtggtacttaccgaccttcgtaacggtcgtaaccttaccgtaacncgttacaacccgttggaccttcccggcaacgggccgaccgaagggggtacgggtcctagggaacgtgggtacttacggactaacgtacctacgttaccgaaccttaagacgttaagggaaacttcgacgtaggtaccgtaccccgtaaccggcctaaagtcccgttactaccgttaggaaccgggtaccttaacttccggtacccgtacctcccggaaacgggtaccaaacccgggacgaaaccnccggtttaccggccttaggtacctaaccgtacgtaaccgtaaacgttcccgggaaccggtaccgttagggtaaccgggtaacgtcccgggttaaaggaccccttacccggggactaaccggttaggtaaacccgtttccggaaccggtttcggaaccggttaggtaccgggtttacgggttacccgggttactacggtttaacggttttacggtttaaacgggg

SEQ ID NO: 132234 - DNA, 795 bp, Homo sapiens
  misc_feature: GYAE6OF02F0VJQ.14.78.H01.1.454.CMB.1.raw
  modified_base (274)..(274): a, c, t, g, unknown or other
  misc_feature (274)..(274): n is a, c, g, or t
  modified_base (320)..(320): a, c, t, g, unknown or other
  misc_feature (320)..(320): n is a, c, g, or t
tcagcgtctagtaccacgaccggtgctcgattttagtgtgagtagtttgggtttggggaggctctgggagaagagccccagccccagagttcccaggagtttccattcggtgatcagcactgaacacagaggactcaccatggtagtttgggctgagcgtgggtcttcttgttgcttattaataaaacggtgtcctagtgtcaagtgctaggttggtggagtcgtgggggacgtcgtttggcaagcgtagggacggtcctgactactctctgcncacgccttgtaggtacttccgtacgtctaggtacaacctactaacncgttacgaccgtacggccgtccggccgacgggtcccgaccgggtaaggggggaacgggtcgttagggtaaacgtgggtaacgtttcgactaacgtacttaacgtcctaacgtttagtaggttaaggtaaattcggactaggtttaccacccgttaacgggctaaccggttccttacggttaccgaggggacccggttcgtaacccgttccggtaacccgtaccgtaaccggtaccgggaaccctaaacccggtaaccgaacgtaaccgtttccggaccgtttaagtccgttaccggacgttaccgttaaaccggcccggtaaccggtccgtacggtaacggtacgacgggtaaccgacgcccggtataaccgttaaggttaccgtttaccggtacggttgggaaccggtttacggcgggttttaccggttcgggtttacccggttacgtttagggtttacgtttttaaccggggg

SEQ ID NO: 132235 - DNA, 506 bp, Homo sapiens
  misc_feature: GYAE6OF01BO6MT.9.2.A02.1.454.CMB.1.raw
tcagtgatacgtctcacgaccggtgctcgatttagactcatctacaggggggtctcaggaggcagcgctctcgggacgtctccaccatggcctgggctctgctattcctcaccctcctcactcagtgtacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctgggtccctgatcgcttctctggctccaagtctggcaacacggcctccctgaccgtctctgggctccaggctgacgatgaggctgattatactgcagctcatatgcaggccacccacaattcgtcttcggaagtcgggaccacggtcaccgtcctaggcacgcccaaggcccaacccactgcactctccg

SEQ ID NO: 132236 - DNA, 520 bp, Homo sapiens
  misc_feature: GYAE6OF01BXCDO.9.2.A02.1.454.CMB.1.raw
  modified_base (402)..(402): a, c, t, g, unknown or other
  misc_feature (402)..(402): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaatcataatttatgatgtctttagacggccctcagggatttcttctcggttgtctggctccaagtctgggaacacggcctccctgaccatctctggacttcagcctgaggacgagggtnatttactctgcagttcagtattcagtaacttcccctggttgggtgttcggcggagggaccatgctgaccgtctgagtcagcccaggctcgcccctcggtcactctcgttcccgcctcc

SEQ ID NO: 132237 - DNA, 552 bp, Homo sapiens
  misc_feature: GYAE6OF01DVDWN.9.2.A02.1.454.CMB.1.raw
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (336)..(336): a, c, t, g, unknown or other
  misc_feature (336)..(336): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgacattggtggctctaatcatgtctcctggtactataacagtccaggcaaagcccccaaatcataatttangatgtctttagacggcctnagggtatttctctcggttntctggctccaagtctgggaacacggcctcctgaccatctctggacttcagcctgaggacgagggtgattacttctgtcagttcagtattcaagtaacctttcccgtggttgggtgttcgggcggtagggacctagtcgctggacccgtctggacgtcgacgcccgaaggcctccggccccctcgggtccacttcctccgttccccacccgttcccg

SEQ ID NO: 132238 - DNA, 703 bp, Homo sapiens
  misc_feature: GYAE6OF01C9BLI.9.2.A02.1.454.CMB.1.raw
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctccgtggacagtcgatcaccatctcgtgcactggaaacgatagcgacagttggtgctactaatcatgtctcctggtactataacagtccaggcaaacgccccaaatcaattaatttatgattgtactttagacgtccctgagggttactttcgtttctcggttcgtcttcggccttaccgaagttcgtacgggaaccaccggcccttcccgtagacctattccgtctggactttcagtcctggacggtacgtagggtaggtactttacgttacgtagtactacggtttacgacggtaattaccgtaaacttaaacccgtttaccccgttcgggtttcgggttacggtttccggggtaccgggtaacgggtaccgtacgttacggtccgttaccggtaacccggttccgtacggtacgttaccgaaccggtaccccgtaacgggtcccgttacccggtacccccccgttcgggttaccctacccgttcccgttcccggtttcccccgtccccgttaccccg

SEQ ID NO: 132239 - DNA, 763 bp, Homo sapiens
  misc_feature: GYAE6OF01CEBWE.9.2.A02.1.454.CMB.1.raw
  modified_base (303)..(303): a, c, t, g, unknown or other
  misc_feature (303)..(303): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgactagttgggtgctctaatcatgtctcctggtactataacagtccaggcaaacgcccccaaatcaataatttancgtatgttactttagacggtccctgagggtatttcttcgtcggttgtcgtggcctacgaaagttcgtagggaacctaccgggtcccttcccgtacggaaccctacgttccgtaccgttacgggtaccctttaccgacggttcccgtaggtaacggggtaacggtacggggttagttaactttaaccgtttccgtggtaccgtacgtttacgaaggttactttaccggaaacgttaaacccgttttccccgttaacgggttttccggggttcgggttacccggggtacggggtaacgggtaacccgtaaggttccggtaccgttaccgggtacccggttcccgtacggtaacgtaccggaaccgtacccggtaaaccgggttccccgttacccggtccccccggttacggttccctaacccgtttcccgttacccgtttccccctaccccggtttaccccg

SEQ ID NO: 132240 - DNA, 554 bp, Homo sapiens
  misc_feature: GYAE6OF01EQEJI.9.2.A02.1.454.CMB.1.raw
  modified_base (235)..(235): a, c, t, g, unknown or other
  misc_feature (235)..(235): n is a, c, g, or t
  modified_base (404)..(404): a, c, t, g, unknown or other
  misc_feature (404)..(404): n is a, c, g, or t
  modified_base (545)..(545): a, c, t, g, unknown or other
  misc_feature (545)..(545): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggnggctctaatcatgtctcctggtactataacagtccaggcaaagcccccaaatcataatttatgatgtctttagacggccctcagggtatttcttctcggttgtctggctccaagtctgggaacacggcctccctgaccatctctggacttcagcctgaggacgagggtntattacttctgctagttcagtattcaagtaaacctttcccgtgttcgggtggttcgggcgggacggtacctagtcgctcgaccgtccgtgacgtcgacgcccaaggcctcgcccccgtcggtcctacttcctcgttccccncccgtcccg

SEQ ID NO: 132241 - DNA, 720 bp, Homo sapiens
  misc_feature: GYAE6OF01EC3L1.9.2.A02.1.454.CMB.1.raw
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtcagggtctcctggacagtcgatcaccatctcgtgcactggaaacgaatagcgactagttggtgcttactaatcatgtctcctggtactataacagtcagacaaacgaccccaaactactaattaattatgtatgttactttagaccggtcctacgaggttatttcttcgttcggttgtcgtcggcctacgtaacgtcgtacgggaaccgtaccggtccctcccgtcgaccctacttccgttcgtacggtacctttcgacggtcccgtagggaacgggtacgggtagggttacgtaactttacgttcgtacggtcgttacgtttacgtaagttaactttaccgtaaaccgttaacccgtttccccggtttacgggttttacggggttccgggtttaccggggtacggggtaaccgggtaaccgttactacgggtccgtaccggtacccgtccgtacggtaccggtaccgaccgggacccgtaacggtcccgtacccggtcccccggttcgtccttacccgttccgttcccgttccccctaccccg

SEQ ID NO: 132242 - DNA, 528 bp, Homo sapiens
  misc_feature: GYAE6OF01BI7MC.9.2.A02.1.454.CMB.1.raw
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgatagcgacattggtggctctaatcatgtctcctggtactataacagtccaggcaaagcccccaaatcataatttatgatgtctttagacggccctcagggtatttcttctcggttgtctggctccaagtctggacacggcctcctgaccatctctggacttcagcctgaggacgagggtgattacttctgctagttcagtattcagtaaccttcccgtggttgggtgttcggcgggtagggaccagtgctcgaccgtctgacgtcgacgcccaggctcgccccctggtccactctcgttcccgcctcc

SEQ ID NO: 132243 - DNA, 704 bp, Homo sapiens
  misc_feature: GYAE6OF01AFRSD.9.2.A02.1.454.CMB.1.raw
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacaatagcgacagttggtgctctaatcatgtctctgtactataacagtcagcaacgccccaatcaataatttatgatgtcttagaccgtccctcgagggtatttcgttcgttcggttgtcgtcggtctccaaggttcgtacgggaacctaccggtcccttcccgtagaccctattccttcgtcggtacctttacgacgtccgtaggacgggacggtaggggttactaacgtttaccgttccgtaggtaccgttaacggtttaccgaacgttacgtttaacccgaaaccgtttaaccccgttttcccccgttagggttttcggggttaccgggtttaccggggaccggggtaccgggtaaccctaggttccggtaccgtacggtacccgttccgtaggtacgtaccggaccggtacccgtaacgggtccctccccggtcccccgttacggtccctaccgttcccgttcccgttcccctcccgtacccg

SEQ ID NO: 132244 - DNA, 636 bp, Homo sapiens
  misc_feature: GYAE6OF01BS2O3.9.2.A02.1.454.CMB.1.raw
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
  modified_base (433)..(433): a, c, t, g, unknown or other
  misc_feature (433)..(433): n is a, c, g, or t
  modified_base (458)..(458): a, c, t, g, unknown or other
  misc_feature (458)..(458): n is a, c, g, or t
tcagtgatacgtctcacgaccggtgctcgatttagactcatctacagggggggtctcaggaggcagcgctctcgggacgtctccaccatggcctgggctctgctattcctcaccctcctcactcagtgtacagggtcctgggcccagtctgccctgactcagcctccctccgcgtccgggtctcctggacagtcggtcaccatcctcctgcactggaaccagcagtgacattggtncttanaactntgtctctgtaccacagcaccaggacaaacgtccccaaaactcatacgtatttacgngaaggtacaaataacgccggtaccctcgtcggggtccctgactccgcttctcgtggcctaccgtaagtcgtggaccaaccgaccggtccctacccgtcgacccgtcctcgtcggcctccgaggtctgacgngtgacggtctagtatttaacttacngcagtctacatatcgcgtacggacccacctaactaacgttcgttaccgttagggaacggtcgggaacccgtacggttcccgtaacccgttaccgtacggtccgaaaccggtaccccgaaacccgggtacccccaaacccccgtacttaccgtaccctacccgtttcccgttacccccg

SEQ ID NO: 132245 - DNA, 807 bp, Homo sapiens
  misc_feature: GYAE6OF01DK0GR.9.2.A02.1.454.CMB.1.raw
  modified_base (303)..(303): a, c, t, g, unknown or other
  misc_feature (303)..(303): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctggcccagtccgccctgactcagcctgccgccgtgtccgggtctcctggacagtcgatcaccatctcgtgcacgtaggaaacgaatagcgactagttgggtgctctaatcatcgtctctaggtactataacagtccaggacaaacgccccaatcattaatttangtatgtcttagaccgtcctgaggtactttcttcgtcgttgtctggctacgaagtcgtagggacctacggccctccgttacgacctacgttcctcgttacgggtacctttccgaacgtccgtagggaacgggtaaccggtaagggggttattaacgtttaaccgtttcgtacggtaccgttacggtttaccgaagtttaacgttttaccgtaaaacccggtttaaacccgtttttcccccgggttacggggttttcgggggttttacggttacccggggggtaccgggggtaaaccggggtaacccttaggttaccgggtacccgttccggttaacccccgggttacgttaccgggaaccggtttaccccggaaccgggtacccccgggtaaaccgggttccccgtacccccggttaccccccccggttacccggggtttacccttaaccccggtttcccggttttacccccggtttcccccccggtacccccgtttacccccgg

SEQ ID NO: 132246 - DNA, 806 bp, Homo sapiens
  misc_feature: GYAE6OF01DH3WE.9.2.A02.1.454.CMB.1.raw
tcagtgatacgtctcacgaccggtgctcgatttagactcatctacgaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacgaatagcgactagttgggtcgcttctaaatcaattcgttcctcccgttaggttacctaataaacgagttccaagggaccaaaacgccccccaaaactccaattaaatttatggtattgttacttttacggaaccggtccctacgtagggtattttccgtttcgtcgggtttcgttccgttgggcctaccgtaaaggtccgttaggggaaacctaccgggtccctaccccgttaggaccctaacgtttcctacgttacggtacctttcgaacgtcccgttaggaacgggtaccggtaaggggttgtaaacttttaccgtttcgtaggtacctaggtttacctaaggttactttaccgtaaaccgttaaaacccgttttccccgtttaacggggtttgggtttaccgggttaccggggtccggggtaacggggtaaccgtacgttacgggtccgttacggtacccgttcccgtaggtaccggtaccgtaaccggaccccgtaaacgggtccccgttacccggtaccccccgttaccggtcccttaacccgttcccgttccggtttccccgtccccggttaccccccg

SEQ ID NO: 132247 - DNA, 570 bp, Homo sapiens
  misc_feature: GYAE6OF01A8NTP.9.2.A02.1.454.CMB.1.raw
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacaatagcgacattggtgctctaatcatgtctcctggtactataacagtccaggacaaacgcccccaaactcaattaatttatgatgtctttagacggcctanaggtatttcttctcgttgtctgctcaagtcgtggacncggcctcctgaccatctctggtacttcgagccgtaggacggacggtagggtgtactttacgttctcgctagttcagtacttaccaacgtaacctttccccgtggttcgggtcggttcgggacgggacgggtacacgtcgacgtcgtaccggtctgacgtcgacgacccaggcctaccgccccgtcgtcaccttcgtcccgttcccgccctccg

SEQ ID NO: 132248 - DNA, 754 bp, Homo sapiens
  misc_feature: GYAE6OF01EV3HM.9.2.A02.1.454.CMB.1.raw
  modified_base (378)..(378): a, c, t, g, unknown or other
  misc_feature (378)..(378): n is a, c, g, or t
tcagtgatacgtctcacgaccggtgctcgatttagactcatctacaggggggggtctcaggaggcagcgctctcgggacgtctccaccatggcctgggctctgatattcctcaccctcctcactcagtgtacagggccctgggcccagtccgccctgactcagcctgccgccgtgtccgggtctcctggacagtcgatcaccatctcgtgcactggaacgaatagcgacagttggtgctctaatcatgtctctgtactataacagtcaggacaaacgaccccaatctattaatttatgtattgtctttacggaccggtccctagtagggtacttttcttcgtcggttgtcctggtcctaccgaagtcgtacgggaacnccggtccctcccgtacgaccctattccgtccgtacgggtaccttccgacgtcccgtagggacgggtacgggtacggggttcgtaactttaccgttcgttcggaccgttaaggttaccgtaagtacgtttaaccgtaaaccgtttaaaccccgtttccccggtttacgggtttcggggttacgggttacccggggacggggtaaccgggtaacccgtacgtcggttacccgttacggtacccggttccgtacggtaaccgttaccgacccgggtaccccgaacgggttcccccgttacccgggtccccccgttaccggttccccgttaccctttaccccggtttcccccgttaccccccgtccccgtttaaccccgg

SEQ ID NO: 132249 - DNA, 683 bp, Homo sapiens
  misc_feature: GYAE6OF01C4BZV.9.2.A02.1.454.CMB.1.raw
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgcgtgtccgggtctcctggacagtcgatcaccatctcgtgcactggaaacgaatagcgactagttggtgctactaatcatcgtctctgtactataacagtccaggacaacgaccccaaactcaattaaatttatagtatcgttactttaacggaccgtacccttcgaagggttactttccgtttcgttcgggtttgttcgttcggtcttaccgtaaaggttcgtacgggaacctaccggtcccttaccgtacgaccctacttccttagtcgtaccttcgacgtccgtagaacgggtacggacgggttgtactttacttacgtcgacttcgttacgtagtacttacgtaacgtaaccctttcccgttacgggtttgggttacggttacgggtacgggtacggtacgcgttacgccgtacggtaccgttccgtagtacgtaccgaccggtaccacgggtccctccggtcccccgttcgtccctaccgttccgttacccttcccctcccgttacccg

SEQ ID NO: 132250 - DNA, 788 bp, Homo sapiens
  misc_feature: GYAE6OF01CZ9VC.9.2.A02.1.454.CMB.1.raw
  modified_base (236)..(236): a, c, t, g, unknown or other
  misc_feature (236)..(236): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactcagtgtacagggtcctgggcccagtccgccctgactcagcctgccgccgtgtccggtctccgtggacagtcgatcaccatctcgtgcactggaacatagacgatagttggngtctactaatctatgtctccgtggtactataacagtccaggaccaaacgcccccaaatctaattaatttactagtattgttactttacggacggtccctagtaggtactttcttcgtcggttgtcgtcgtctacgaacgttcgacgggaacaccggtccctaccgtacgtacctacgtcctacgtaggtacttacgacgtccgtaggacgggtacggtagggttacgtacgtttacgttcgtagtaccgtaggttacgtaacgttacgtttacccgtaacgttaaacccgtttccccgtttacgggtttcggggttaccgggtttaccggggtaccgggggtaaccgggttacccgtacgtttaccgggaccggttaccggtaaccccgggtttaccgttacgggttaaccgtacccggtaacccgggtacccccgggttaaacggttcccccgggttacccggttacccccccgggtttaccgggttacccccttaacccggtttccccgggttttcccgttaccccccgtttacccccggttacccccgg

SEQ ID NO: 132251 - DNA, 607 bp, Homo sapiens
  misc_feature: GYAE6OF01BZ0ZQ.9.2.A02.1.454.CMB.1.raw
  modified_base (239)..(239): a, c, t, g, unknown or other
  misc_feature (239)..(239): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcactggaaccagcagtgacgttggtgttcngactctgtctccgtggtaccaacaacacccacggacccaaacccccagcctcatgtatttatgatgtacaatcacgtccgtccctcgtacggggtttctgactccgtctttcctcgtcgtccttaccgaacggtccggaccaaccgcccggtaccctccgtcggtacccgtcgttcgtcggcctccgagtacgtcggacgacgaggtctagttatttacttctcgtccttcctatataactacggaacgggtcacgcctactctacgtactacggttcgggcggaacggtactaagcgtcggtaccgttaccggtcggtaccgaccggacccgtaacggtcctacccggtccccgtcgtccctacccg

SEQ ID NO: 132252 - DNA, 741 bp, Homo sapiens
  misc_feature: GYAE6OF01ALTMQ.9.2.A02.1.454.CMB.1.raw
  modified_base (267)..(267): a, c, t, g, unknown or other
  misc_feature (267)..(267): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacatagcactagttggtgctactaatccatgtctccgtggtactataacngtccaggacaacgcccccaaatcaattaatttatgtattgtacgttagaccgtccctacgagggtacttttccgttcgttcggtttgtccgtcggtccttaccgtaacgtcggtacgggaaaccgtcccggtccccttaccgtcgtaaccctacgttccgttccgttacgtacctttacccggacgtcccgttagggtaacggggacgggtacgggttacgtttaaacgtttaccgtttcggttacgtccgttaacggtttccgtaacggttactttacccgaaccggtttaaccccttccccgggttttacgggtttcggggttaccgggttcccggggtaacggggtaccgggttaaccgtaggttcggtaccgtcgggttaacccgtcgtccgagtccgaccgtacccggacggtcccgtcccgtccccgttaccgtccgtaccttcgtccccgttcccctcccgtacccg

SEQ ID NO: 132253 - DNA, 734 bp, Homo sapiens
  misc_feature: GYAE6OF01CYAS9.9.2.A02.1.454.CMB.1.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (326)..(326): a, c, t, g, unknown or other
  misc_feature (326)..(326): n is a, c, g, or t
  modified_base (430)..(430): a, c, t, g, unknown or other
  misc_feature (430)..(430): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctggcccagtccgccctgactcagcctgccgccgtgtccgggtctcctggacagtcggtcaccatcctcctgcactggaaccagcagtgactagttggtntcttaanaactatcgtcctaccgtcggtaaccaacacgccaacccgtacggaaccaaaccgtacccccaaaatccgatgtaattttangtaagtacaaagtaacggcccggtccttcggtttcgggtttacttagttccgttccttctcgtggtcctaccgaagtttcacgaactaacgccggccctcccgngaactacttcctcggtcggtcctacgaggtcgtaaggacggacgtaggtcttaagttaacttacgttacgcgtcgttacgaccttactaagtacgtgtaaccgtaaggtacgttacgggtacctaaccgttcccgggtttaccggtttaagggttccgggttaccggggaccgggtaaccgggtaaaccggttacgggtcccggttaacccggttacggtaccgggtaccgaacccggtacccggtaacggtcccccggttaaccccgtcccccgggttaccgtaccgttccccgtttaccccg

SEQ ID NO: 132254 - DNA, 790 bp, Homo sapiens
  misc_feature: GYAE6OF01DJJG1.9.2.A02.1.454.CMB.1.raw
  modified_base (193)..(193): a, c, t, g, unknown or other
  misc_feature (193)..(193): n is a, c, g, or t
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
  modified_base (434)..(434): a, c, t, g, unknown or other
  misc_feature (434)..(434): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgcgtgtccgggtctccgtggacngtcgatcaccatctcgtgcacgtggaacgaatagacgactagttgggtgctctaatcatgtctcctgtactataacagtccaggacaaacgaccccaaatctataatttanagtattagtctttaacgccgtccctgtaggtactttctcgtcggttntcgtggctacgagtcgaggaacacgcctcctgacctactctcgtcgtaacttcgagtccgtggaacgggtacgtacggggttntaacttttacgttcgtacgtaccgttaggttaccgaacgtacgtttaaccgaaacggtttaaacccccgttttcccccggtttagggggtttaccgggggtttacgggtttaccccgggggtaccgggggtaaacggggtaaccccttagttaacccgggtccgttaaccgggtaaccccccgggttacgttacggggttaccggttaaccccggaaaccgggtaacccccgtaaacggggttcccccgttaaccccccggggttccccccctttaacccgggtttacccgtaaaccccttttcccccgggtttaacccccggttcccccccccggtaccccctttaaccccgggg

SEQ ID NO: 132255 - DNA, 613 bp, Homo sapiens
  misc_feature: GYAE6OF01BMPGR.9.2.A02.1.454.CMB.1.raw
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccggtctcctggacagtcgatcaccatctcgtgcactggaaacgaatagcgaacattggtgctctaatcatgtctcctggtactataacagtccaggcaaacgccccaaatcataatttatgatntctttagatcgcctnaggtatttctctcggttntctgctcagtctggacacggcctcctagaccatctcgtgtactcgagtcctggaggacgtagggtcgtattacttcgtagtactagttcgtaagtacttacgaacgtaaaccctttccccgttcggtttcggggttacggttaccggggtcgggtaacgggtaccctaagtcgtccgttcggtacccgttccgaggtacgtccgtaacggaccccgaacgggtcccgtccggtccccccgttcgtacctacccgttccttacccggtcccctacccccg

SEQ ID NO: 132256 - DNA, 627 bp, Homo sapiens
  misc_feature: GYAE6OF01ETAGL.9.2.A02.1.454.CMB.1.raw
  modified_base (369)..(369): a, c, t, g, unknown or other
  misc_feature (369)..(369): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtcccgcctgactcagcctgccgccgtgtccgggtctcctggacagtcgatcaccatctcgtgcactggaaacaatagcgacattggtgctctaaatcatgtctcctggtactataacagtccaggcaaacgcccccaaaatcaattaatttatgtaatgttctttagaccggccctagaggtactttcttctcggttgtctggctccaagtcgtagggaanccgtaccgtccctccgtacgactactctcggtacgttacctacgtcgtaccgtaggacggtacgggtaggtgtaactttacgtcgtacgtacgtacgttacgtattactaacgtaaccttaacccgttcccgttgggttcggttcgggtcgggacggacgtaccgtgtacgcggtccgtccgttcgtacgtacgactaccgaccggacgtccgtcccgtacccgtcgaccttaccgtccgttcccgtcccgtaccccg

SEQ ID NO: 132257 - DNA, 729 bp, Homo sapiens
  misc_feature: GYAE6OF01A3BU1.9.2.A02.1.454.CMB.1.raw
tcagtgatacgtctcacgaccggtgctcgatttagactcatctacaggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgcactggaaccagcagtgatggttgggatttatgtaccttgtcctccgtaggtaccaacacgccacccgaggaccaaaccgaccccccaaactcactcctaatttagaggacggtacaacgtaacggcccggtacccgttacggtaggggttttcctagtttccgtctttcctcgtcggccttaccgtaagttcacgaaccaaccgacccgggtcccttaccgtacgaacctaacgttccgttccggtccgggtacccttacccggacgggtaccgttacgggaaacgggtaacccggtaacgggtacgttacggttaacttttaacgtttacgtcgtaccttcgtcttactaattgtacgtacgtaacggtaacgttcgggtacctaaccgtaccgttaccggttagggttacggttccggggaccggtaacggggaaccgtaacggggtaccgtacccggttccgtacggtacccgacggacccgaacgggtccctcccggtccccggtcggttaccc

SEQ ID NO: 132258 - DNA, 696 bp, Homo sapiens
  misc_feature: GYAE6OF01CBS7F.9.2.A02.1.454.CMB.1.raw
  modified_base (134)..(134): a, c, t, g, unknown or other
  misc_feature (134)..(134): n is a, c, g, or t
  modified_base (191)..(191): a, c, t, g, unknown or other
  misc_feature (191)..(191): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (350)..(350): a, c, t, g, unknown or other
  misc_feature (350)..(350): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactcagtgtacngggtcctggcccagtccgcctgactcagcctgccgccgtgtccgggtctcctggacngtcgatcaccatctcgtgcactaggaacagtgcgactagttggngctctaatcatgtctctgtactanactgtcagacaaacgccccaaatcaattaatttatgtattcgttctttacggaccgtccctaggtaggttactttccgttcgttcgggttntccgtcggtctaccgtaagtcgtacggacctaccggtccctccgtacgacctacgttctacgtcgtaccttcgacgtcccgtaggacgggtaacgtaggggttacgtaacgtttacgttaccgtgtacgttacgttacgaacgttacttacgtaaaccgtaccctttcccggtgggtttcgggtcggttacggggacgggtacggtacctagttcggtaccgtaccgtaccgttcgtacggtaccgtaccgtaacccggacccggtaaccggtcccctcccggttccccgtacgggttaccctcccggtttacccgttccccggttccccccgtcccgtaaccccg

SEQ ID NO: 132259 - DNA, 828 bp, Homo sapiens
  misc_feature: GYAE6OF01ENZIU.9.2.A02.1.454.CMB.1.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
tcagtgatacgtctcacgaccggtgctcgatttagactcatctacgagggggggggtctcaggaggcagcgctctcgggacgtctccaccatggcctgggctctgctattcctcaccctctcactcagtgtacagggtcctgggcccagtccgccctgactcagcctgccgccgtgtccgggtctccgtggacaggtcgtccaccatcctcctgcactcggaaccngcagtgaactagttgggtanctttaanaaacttgtcgtccttcctggtactacgaacaaaccaacccgagtaccgaaaaccgaccccctaaaacttcgttacgtatttagtagtaggtacgaggtaggacggccctacggacgggtccctgatcgtacttcctcgtcggtctaccgtaagtcgtacgacctaaccgaccggtccctcccgtacgtaccgttccgtcgttacggggcctttaccggacgggtccgttaaggacggtacggtcgggtaacgggtccgttaaggttaacgttttaaacgttttacgttcgggtaaccggtaacgtttaccgttaaccttaagtttaaccgttaaccgtaacgggtaaccgttaacggttaaaaccggtttacgggggggtttttaccggaaccgggggttaaaccgggaaccgtaaccggtaccgttaccggtaaccccggttaccggttaaccgggtaaccgtacccggacccggtaaacgggtcccccgttaccccgggtaccccccgttaccggttacccttaccccgttacccggtttccccggtttaccccccacccccggtttaacccc

SEQ ID NO: 132260 - DNA, 910 bp, Homo sapiens
  misc_feature: GYAE6OF01B3HWM.9.2.A02.1.454.CMB.1.raw
tcagtgatacgtctcacgaccggtgctcgatttagactcatctacaggggggggtctcaggaggcagcgctctcgggacgtctccaccatggcctgggctctgctattcctccaccctcctcactcagtgtacagggtcctgggcccagtccgccctgactcagcctgccgccgtgtccgggtctccgtggacagtcgatcaccatctcgtgcacgtaggaacgaagtacgacgactagttggtggcttactaatcaattcgttcctccgtaggttaactaactaacgtacgtaccgaacggaaccaaaaccgacccccctaaactactaactttaaatttatagtattcgttacttacggaccggtcccgtagtacgggttacttttcgtttccgttcggtttgtcgtcggtacctaccgtaacggttcggtaacgggaaccgtacccggtaccccttcccgtacgtaaccctacgttccgttaccgttacggttaccttaccgtaccggtacccggttagggaacggggtaacgggttacggggttacttaacgtttttaacccgttcggttacgtaccgttaacggtttaccgaagtttacctttaacccgtaaccgtttaaacccccgttttccccggggtttacgggtttacgggggtttaccgggttacccgggggaacccgggggttaccgggtttaaaacccgttggttcccgggttaccgttacccgggttaaccccggttaccgttacgggaaacccgttcccggaaacccgggttaccccgggtaacccgggttcccccggtcccccgggttaccccccgggtttaccggtacccccgtttacccgtttacccccggttttcccccgtttaacccccccgtccccgtttaaacccccgg

SEQ ID NO: 132261 - DNA, 724 bp, Homo sapiens
  misc_feature: GYAE6OF01EWYS4.9.2.A02.1.454.CMB.1.raw
  modified_base (192)..(192): a, c, t, g, unknown or other
  misc_feature (192)..(192): n is a, c, g, or t
  modified_base (240)..(240): a, c, t, g, unknown or other
  misc_feature (240)..(240): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtcccgccctgactcagcctgccgcgtgtccgggtctcctggacngtcgatccaccatctcgtgcacgtaggaacaatagcgactagttgggngctactaatcatcgtctctaggtactaataacagtccaggacaaacgacccccaaatctaattaatttatgtattcgttactttaacggaccgtccctagtacgggttacttttcttacgttcggttgttcgtggtacctaccgtaagtcgtacgggaaccgaccggtcccttcccgtagtaccctattcctcgtacggtaccttcgacgtccgtaggacgggtacggtacgggtataacgtttacgttcgtacgacgtagttacgaagttacttaccgtaaacgtttaaaccccgtttcccggttacgggtttacgggttacgggttccgggaccggggtaacgggtaccgtagtccggtacgtaccggtaccgttccgtaggtaaccgtcggtaaccggacccgtaacggtcccgtaccccggtccccccgttcgtacccgttaccgttacccgttccccgttcccccgtcccgttaccccg

SEQ ID NO: 132262 - DNA, 679 bp, Homo sapiens
  misc_feature: GYAE6OF01AUYUR.9.2.A02.1.454.CMB.1.raw
  modified_base (238)..(238): a, c, t, g, unknown or other
  misc_feature (238)..(238): n is a, c, g, or t
  modified_base (456)..(456): a, c, t, g, unknown or other
  misc_feature (456)..(456): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacaatagcgaacagttgggnggctctaatcatgtctcctggtactataacagtccaggaccaaacgaccccccaaactcaattaatttactagatgttacctttagaccggtccctcgagggtattttcgttcttcgggtttgtcgtggtcctacccgtaagtccgtagggaaccacggtccctacccgtgaccctatctacgtcggaccttcgagtcctggacggacggtaggggtntactttacgttcgtagactagttacagtacgttccaagtaaccctttccccgttagggtttcgggttcggttaccgggcgggaacgggtaccctagttccggactacggaccccgtcgttacggaccgtacgtaccggacccgtaaacgggtccctacccggtccccccgttacgggttacccaaccgtttcccgttcccgttaccccccgtccccttacccg

SEQ ID NO: 132263 - DNA, 748 bp, Homo sapiens
  misc_feature: GYAE6OF01EJFMN.9.2.A02.1.454.CMB.1.raw
  modified_base (104)..(104): a, c, t, g, unknown or other
  misc_feature (104)..(104): n is a, c, g, or t
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (382)..(382): a, c, t, g, unknown or other
  misc_feature (382)..(382): n is a, c, g, or t
  modified_base (397)..(397): a, c, t, g, unknown or other
  misc_feature (397)..(397): n is a, c, g, or t
tcagtgatacgtctcacgaccggtgctcgatttagactcatctacgagggggggggtctcaggaggcagcgctctcgggacgtctccaccatggcctgggctcngctattcctcaccctcctcactcagtgtacgagggtcctgggcccagtcccgcctgactcacgcctcgccgcgtggtccggtctccgtggacagtcgatcaacctgtctcgtgcctacgtggaaacgatacgcaacgtgttgggtcgcttacgtaatcatcgtctcgtagtactataacncgtcagacaacgcccaatctattacttngtatgtcttagactcgcctgtaggttctttcgtgttcggttatcgtacgtctacgagttcgagggaaccnccggtccctccgtanaccacttccgtacggttacggtaccttcgtacggtccgtaagggaccggtacgggttagggttacttaacgtttccggttcgtacgtcgtaagtttaccgagtttaacccgttacgtaaccgtttaaccccgttttcccgggttcggggttttaggggttacccgggttacggggaccgggttaaaccggccttacggtacccgggtacgttccccgggtaccgttccggtaaggttaaccggtaccggtacccgggtaacccggttacggttccccgttacccccgggtacccgtttacgggtacccccttaccgtttcccgggtttacccccgttaccccggtcccccg

SEQ ID NO: 132264 - DNA, 787 bp, Homo sapiens
  misc_feature: GYAE6OF01AWTQY.9.2.A02.1.454.CMB.1.raw
  modified_base (310)..(310): a, c, t, g, unknown or other
  misc_feature (310)..(310): n is a, c, g, or t
  modified_base (355)..(355): a, c, t, g, unknown or other
  misc_feature (355)..(355): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtcccgccctgactcagcctgccgcgtgtccgggtctcctggacagtcgatccaccatctcgtgcacgtgggaaacgatagcgactagttgggtcgctacgtaatcattcgtctcctggtactataacagtccagacaaacgccccaaatccaataatttangatgtactttacgaccgcctagaggtactttcgttccgtcggttntacgtcggtctccgtaagtcgtaggggaacctaccgggtcccctccgtcgaaccctacgttccttacgtacggtaccgttcaccggtacccgtagggaacgggtacgggtaggggttacgtaacgttttaccggttcctagggtacctaacgggtttacaacggttacgttaacccgtaaaccgtttaaaccccgtttcccccggttttaacggggttcggggtttaccgggtttccggggtaacccggggtaacggggttaacctcggttaccggtaccgttccgggttaaccccggttcccgttaggggtaaccctaccgggtaacccggtacccggtaacggggtccccttaccccgggtccccccgttcggggttaccctaacccggtttcccgttaccccgtttccccccgtaccccgttaccccgg

SEQ ID NO: 132265 - DNA, 895 bp, Homo sapiens
  misc_feature: GYAE6OF01A0E9L.9.2.A02.1.454.CMB.1.raw
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgcccgccgtgtccgggtctcctggacagtcgatcaccatctcgtgcacgtaggaaaccgaatagaccgactagtttgggtcggcttactaaagttccaagttcgtccttcccgttagggttaaccttaacttaaaaccgtacgttacccgaacggggaaccaaaaaccggacccccccctaaaacctacctaacttaaactttttaacgtagtaacgtttcggtttaccgttttaacggacccgggtccccttacgtaacggggttactttttccgttttcgttccgggtttcgttccgttcggggtacctttaccccgtaaacggtttcccggttaacggggtaaacccgtaacccgggttcccgttacccccgttacggtaacccctacgtttacccgttccgttcgggtacccttttaccgaccgtaccgttacgggaacgggtaacgggtaacggggtttacgtacttttaaccgttcgtcgtaccgtaaggtttccaacgttacgttaccgtaaacgttaaaccccgtttcccgtttacgggtttcggggttaccggttaccggggacggggtacgggtaaccgtgttacggtccgttacggtcccgttccgtagtaccggttaccgaccggtacccggaaccgggttccctcccggtaccccccggttaccggtacccgttaccgttacccgttccccgttaccccgtaccccgttaccccgg

SEQ ID NO: 132266 - DNA, 839 bp, Homo sapiens
  misc_feature: GYAE6OF01BNEK0.9.2.A02.1.454.CMB.1.raw
tcagtgatacgtctcacgaccggtgctcgatttagactcatctacagggggggggtctcaggaggcagcgctctcgggacgtctccaccatggcctgggctctgctattcctccaccctcctcactcagtgtacgagggtcctcgggccctagtcccgcctgactcagcctgccgccgtcggtccggtctccgtaggactacgtcgatccgacctatctcgtgccgtacgtaggaaacgtaagtacgaccgtaactaggtttcgggtcgtaccttacgttaaatccgtaattcgtccttaccggtacggttaactaacgtaaaccgacgtaccgaacggacctaaaacccgaccccctaaattaacctaagtttaaatttagtagtacgtttcgtttaccgtttaacggacccggtcccgtaggtaagggtttaccttttcggttccgttccggttagttccgtacggtaccttacgtaacggttcggtaacggaaccgtccggtacccgttccctaacgaccgtacttacgtcggtacttacgtaccgtacgtaccgtgggtaacgggtagggtaacggttatacgttacgttcgtaggtcgttaactacgtaacttaacgttacctaacccgtttaaccgtttccgggtttcggttacggggttccgggtacgggaccgggttaacggtacctacgggttctaaccggtcccggttaccgtacgtccggaccgtccgtaaaccggtcccaaccgggtccccgtacccgggttacccgtacccgggttacccgtaccctttaccccgtttaccccgttccccgtaaccccggtaaccg

SEQ ID NO: 132267 - DNA, 678 bp, Homo sapiens
  misc_feature: GYAE6OF01A0O6G.9.2.A02.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (327)..(327): a, c, t, g, unknown or other
  misc_feature (327)..(327): n is a, c, g, or t
tcagtgatacgtctcacgaccggtgctcgatttagactcatctacgaggggggggtctcaggaggcagcgctctcgggacgtctccaccatggcctgggctctgctattcctcaccctcctcactcagtgtacgagggtccctgggcccagtcccgccctgacctcagcctgccgtcgtggtccggtctccnggacngtcatcaaccntcgtcgtgacacgtagggaaaccatcgcgtacgtgttgggcgctactaagtcagttcgtcctcgtggtactatacgngtccaggaccaaaccgccccctaaaatctaattaaagtttangtaacgttcgttacgttacggaccggtcccttacgagggttactttcgttcgtacggttgtcgtcgtctacgtaagtcgtaaggaacctccggtcctccgtacgacctcttccgtacgtcggtcctacgctaccgtggacggaacggtggggtattaacgtttctacgtcgtcgtactcgtacgtactcgtaaaccgtacctttcccggttcggttacgggttcggtacgggacgggtacggcctaggtcgccgtcgtaccggtacgtcggaccgtcgaccggtacccgtaacggtcccgtcccggtccccgtcgtcctacccgtcctcccggttcccctcccgttacccg

SEQ ID NO: 132268 - DNA, 786 bp, Homo sapiens
  misc_feature: GYAE6OF01COVWL.9.2.A02.1.454.CMB.1.raw
tcagtgatacgtctcacgaccggtgctcgatttagactcatctacaggggggggtctcaggaggcagcgctctcgggacgtctccaccatggcctgggctctgctattcctccaccctcctcactcagtgtacagggtcctggcccagtcccgccctgctcgacgccgtcgccgtccggtcgtccggtctccgtggacagtcgactccacatctcgtgcacgtaggaacgtatacgcgactagttgggacgtacttactaagtctagttcggtccttaccgttaggttaaccttaacgtaaaccgtacggttacccgaacggaaccgtaaaacccggaaccccccctaaactctaacgttacttaacgttttacgtaggtaaccggtaactaaccgtaacgggtacccgggtacccttacggttacggggttttaacttccgttcgttccttctccggttcggtacccttaccgtaacgtaccttacgaaccgtaacccggtcccgtaaccccgttaccgtaccggtaaactacgtttccctaccgggttacggggtccctaaccggtacgggttaccgtacggggaaacgggtaaccggtaggttacgttaaaggttactttacgttactacggtctcgttactataacgttgagtaaccaggttaagtccgttacgaccgttccgttaccgttggacggttccgggacggtacgacggacggtccggtacctacggtacggtaccacggaccgtcgtaccgccccgtcccgtcgacctttccgg

SEQ ID NO: 132269 - DNA, 528 bp, Homo sapiens
  misc_feature: GYAE6OF02IUKWN.9.2.A02.1.454.CMB.1.raw
  modified_base (402)..(402): a, c, t, g, unknown or other
  misc_feature (402)..(402): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgatagcgacattggtggctctaatcatgtctcctggtactataacagtccaggcaaagccccaaactcataatttatgatgtctttaggacggccctcagggatttcttctcggttgtctggctccaagtctgggaacacggctccctgaccatctctggacttcagcctgaggacgagggtnattactctgcagttcagtatttcagtaaaccttccctgttgggtcgttcgggcggagggacctagtgctgaccgtctgagtcagcccaaggctcgcccctcggtcaccttctccgttcccacctcc

SEQ ID NO: 132270 - DNA, 623 bp, Homo sapiens
  misc_feature: GYAE6OF02JMY6J.9.2.A02.1.454.CMB.1.raw
  modified_base (235)..(235): a, c, t, g, unknown or other
  misc_feature (235)..(235): n is a, c, g, or t
  modified_base (319)..(319): a, c, t, g, unknown or other
  misc_feature (319)..(319): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggnggctctaatcatgtctcctggtactataacagtccaggcaaacgcccccaaactcaataatttatgatgtctttagacgccctnaggtatttctctcggttgtctggctcaagtctagggaacacggcctcctagaccatctctggacttcagcctgaggtacgagggtntattacttcngcagttcagacttcaagtaacccttccccgttaggttcgggttcggttaccggcgggaacggggtaccctagtccgcgttacggacccgttcgtacggacgttacccgaacggacccccgtaaagggtccccgttacccggtacccccccggttcgggttaccctaccgttacccgtttccccggtttacccccggccccctttcccg

SEQ ID NO: 132271 - DNA, 532 bp, Homo sapiens
  misc_feature: GYAE6OF02HDI0D.9.2.A02.1.454.CMB.1.raw
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaccagcagtgacattggtattaactatgtctcctggtaccaacaataccccggcaaacgcccccaaactcttgctttatgatgtcagttatcggccctcaggagtttctgatcgcttctctggctccagtctggcaccacggcctccctgacccatcctctgggctccaggctggaggacgaggctgattattctgcagtctacaaaaagagtacgcctcgtcggttggtttcgggcgggggaccagggtcgaccgtctaagtcacgccaggctcgcccctggtccactctcgttcccgcctcctcacgactac

SEQ ID NO: 132272 - DNA, 538 bp, Homo sapiens
  misc_feature: GYAE6OF02HM2ZE.9.2.A02.1.454.CMB.1.raw
  modified_base (235)..(235): a, c, t, g, unknown or other
  misc_feature (235)..(235): n is a, c, g, or t
  modified_base (403)..(403): a, c, t, g, unknown or other
  misc_feature (403)..(403): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggnggctctaatcatgtctcctggtactataacagtccaggcaaaagcccccaaatcataatttatgatgtctttagacggccctcagggatttcttctcggttgtctggctccaagtctgggaacacggcctcctgaccatctctggacttcagcctgaggacgagggtnatttactctgctagttcagattcagtaacttccctgttgggtgttcggcggaggacctagtcgctcgtaccgtcctagacgtcgacgcccgaaggcctcgcccctcggtccacctccgtcgttccccaccctccg

SEQ ID NO: 132273 - DNA, 577 bp, Homo sapiens
  misc_feature: GYAE6OF02I9R3R.9.2.A02.1.454.CMB.1.raw
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
  modified_base (408)..(408): a, c, t, g, unknown or other
  misc_feature (408)..(408): n is a, c, g, or t
tcagtgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacatagcgacattggtggctctaatcatgtctcctggtactataacagtccaggcaaagcccccaaatcataatttangatgtctttagacgccctnaggtatttcttctggttgtctggctccaagtctgggaacncggcctcctgaccatctctggacttcagcctgaggacggaggtgatttacttntgctagttcagtattcaataaacctttccccgttaggttcgggttcgtttcggggcggtacgggtacctagttcggccttaggacccgttcctggacgtcgacggacccaagggtccgtcccgtcccccgtcggtcctaaccgttcctccgtttccccaccccttcccg

SEQ ID NO: 132274 - DNA, 548 bp, Homo sapiens
  misc_feature: GYAE6OF02HPSXC.9.2.A02.1.454.CMB.1.raw
  modified_base (315)..(315): a, c, t, g, unknown or other
  misc_feature (315)..(315): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaatcataatttatgatgtcttagacgcctnaggtatttcttctcggttgtctggctccaagtctagggaacacggcctcctgaccatctctggacttcagcctgaggacgagggtgattacttctgctagttcagtattcaagtaaacctttccccgtaggtttcgggtgttcggcgggagggaccagtgctcgaccgtctgacgtcgagcccaaggcctccgccccgtcggtccaccgttccgtcgttccccgcccttcccg

SEQ ID NO: 132275 - DNA, 771 bp, Homo sapiens
  misc_feature: GYAE6OF02G4K05.9.2.A02.1.454.CMB.1.raw
  modified_base (200)..(200): a, c, t, g, unknown or other
  misc_feature (200)..(200): n is a, c, g, or t
tcagtgatacgtctcacgaccggtgctcgatttagactcatctactagggggggggttctcgaggaggcagcgctctcgggaccgtctccaccaagtcggtccctgggtctctgctattcctcgaccctcctcactcgacgtgtacagggtcctggggcccaggtccgccctggtactcagcctgtccgcgtgtccggtntccgtggactgtcgatcgaccattctcggtgcacgtggaaccaagtcgcgacagttcggtggctactaatccagttcgtctccgtggtactagtaactacgtccgtaaggtacctaaacgtcccccaaactcaattaactttagtacgtacttcggttacctttacggaccgggtccgtcgtagggtacttttcgttcgttcggttacgtacgtacggtacctaccgtaaggttacgtaacgggaaacctacggtcccttccgtacgtacctagttccgtacggtcgtacttccgacgtccgtacggaacggtacggtagggtacgtaacgttaccgttacgtacgtaccgtagttacgtaagttacgttacgaacgttaaaccctttcccgttaggttcgggttacggttacgggacgggtaacgggtaccgtagtacggtcgttaccggtaccgttaccgtagtacggtaccgtacggacccggtaaacgggtcccgttacccggtacccccggttacggttaccctacccgtttcccgttacccggtttacccccgtacccgttcccg

SEQ ID NO: 132276 - DNA, 538 bp, Homo sapiens
  misc_feature: GYAE6OF02GKJV7.9.2.A02.1.454.CMB.1.raw
  modified_base (237)..(237): a, c, t, g, unknown or other
  misc_feature (237)..(237): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtctgccctgactcagcctccctccgcgtccgggtctcctggacagtcggtcaccatctcctgcactggaaccagcagtgacattggtncttataactatgtctcctggtaccaacagcacccaggcaaagtccccaaactcatgattatgaggtcaataagcggcctcgtggggtccctgatcgcttctctgctcaagtctggcaacncggcctccngaccgtctctgggctccgagctgacgagtgaggtctgtattattactgcagctacatatgcacggcacccataactcgtacgtacggaagtcgggaccacggtaccgaccggtcctaggtccaacggacccaacggacccaaccccgtactcggtaccacctcttaccccgg

SEQ ID NO: 132277 - DNA, 557 bp, Homo sapiens
  misc_feature: GYAE6OF02IHM7N.9.2.A02.1.454.CMB.1.raw
  modified_base (237)..(237): a, c, t, g, unknown or other
  misc_feature (237)..(237): n is a, c, g, or t
  modified_base (446)..(446): a, c, t, g, unknown or other
  misc_feature (446)..(446): n is a, c, g, or t
tcagtgatacgtctcacgaccggtgctcgatttagactcatctacaggggggggggtctcaggaggcagcgctctcgggacgtctccaccatggcctgggctctgctattcctcaccctcctcactcagtgtacagggtcctgggcccagtccgccctgactcagcctgccgccgtgtcccgggtctcctggacagtcgatcaccatctcgtgcactggaacgatagcgacattggnggctctaatcatgtctcctggtactataacagtccaggcaaacgcccccaaatcataatttatgattgtctttagaccggtccctcgagggtattttcttctcggttgtctggctccaagttctagaccaacgacggcctcctagactaatctctcgggctccgaggtctggaggacgaggcgtagattacttatcgctcgcttcatancgcagtatggacgacaccgttccgtggtacttcgggacggtagggaccgagggtcgaaccgtcgtacggtcacgacccgaacggcctccggccccgtcggtcctacgttcc

SEQ ID NO: 132278 - DNA, 725 bp, Homo sapiens
  misc_feature: GYAE6OF02H9AI7.9.2.A02.1.454.CMB.1.raw
  modified_base (136)..(136): a, c, t, g, unknown or other
  misc_feature (136)..(136): n is a, c, g, or t
  modified_base (217)..(217): a, c, t, g, unknown or other
  misc_feature (217)..(217): n is a, c, g, or t
  modified_base (247)..(247): a, c, t, g, unknown or other
  misc_feature (247)..(247): n is a, c, g, or t
  modified_base (327)..(327): a, c, t, g, unknown or other
  misc_feature (327)..(327): n is a, c, g, or t
  modified_base (423)..(423): a, c, t, g, unknown or other
  misc_feature (423)..(423): n is a, c, g, or t
tcagtgatacgtctcacgaccggtgctcgatttagactcatctacgagggggggggtctcggaggaggcagcgctctcgggacgtctccaccatggcctgggcctcgtgctattcctcaccctcctcactcacgtntacagggtcctgggcccaggtcccgccgtgactcagcctgccgccgtgtccggtctccgtggacagtcgatcacatctcgngacactggaacatacgcgacgtagttgggnggtcttacgtaatcaattgtctccgtggtactataacacgtacccaggacaaacgacccccaaactacaataacttttanacgtagtgtactttaggaccggtccctacggtagggtaacttttccttcgttcggttcgttcgttggacctccgtaagtcgtacggggtaaacccnccggtccctacccgtcgtaacctcgttcctcgttacgtaccttcgacgtccgtacggacgggtacggtaggtacgtacgttacgttcgtgtacgtagttactagtactacctaacgttaaccttcccgttagggtttaccggggttacggaccgggtacggtaccgtacggttcggtacggtaccggtaccgttacgttacggtaccggtaccgtaccggtacccgtaccggtccgtaccccggtccccgtcggtaccctaccggttcccgttcccggttacccctacccgtaccgtacccg

SEQ ID NO: 132279 - DNA, 551 bp, Homo sapiens
  misc_feature: GYAE6OF02JAY34.9.2.A02.1.454.CMB.1.raw
  modified_base (241)..(241): a, c, t, g, unknown or other
  misc_feature (241)..(241): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtcccgccctgactcagcctgcccgccgtgtccgggtctcctggacagtcgatcaccatctcgtgcactggaaacgaatagcgactattgggngctctaatcatgtctcctggtactataacagtccaggcaaagccccccaaactcataatttatgatgttctttagacggccctcagggtatttcttctcggttgtctggctcaagtctgacaacncggcctccngacaatctcgtggctccaggctgaggacgaggctagattatactgctgctnatntgcagatggtagacctccgttccgtggtacgttcgggacggacgggtaccgagggtcgacccggttcctaacgggtcaccgacccgtaaggtcctccggcccccgtcggtcctacgttcccg

SEQ ID NO: 132280 - DNA, 633 bp, Homo sapiens
  misc_feature: GYAE6OF02HVPOH.9.2.A02.1.454.CMB.1.raw
  modified_base (236)..(236): a, c, t, g, unknown or other
  misc_feature (236)..(236): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggngctctaatcatgtctctggtactataacagtccaggcaaacgccccccaaactcaattaatttatgattgtctttagaccggccctcgagggtattttcttctcggttgtctggctccaagtcgtagggaaccacggtcctcccgtgaccctatcctcgtggactttcacgtcccgtggacgggacggtaggggtgtaactttactctgctagttcagtattcaacgtaaacctttcccgtggtttgggtacggttcggcgggacgggtaccagttcgtccgtcgtacccgtccgtaggtacgtaccgacggaccccgtaagggtcccttcccggtccccccgttcgggttaccctaccgttcccggttacccggtttccccccggtcccttccccg

SEQ ID NO: 132281 - DNA, 639 bp, Homo sapiens
  misc_feature: GYAE6OF02GTJWL.9.2.A02.1.454.CMB.1.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (350)..(350): a, c, t, g, unknown or other
  misc_feature (350)..(350): n is a, c, g, or t
  modified_base (612)..(612): a, c, t, g, unknown or other
  misc_feature (612)..(612): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttcngactctgtctctacggtaccaacaaccacccgacggaccccaaaccccccaagcctacactagtatttagtgactgtacaactcacgtccgtccctggtacgggtttcngtactctacttctctcggcctaccgaacgtccggacaaccgacccgtccctcccgtcgtacccgttcgtcgtcgggcctccgaagtacgtacggaccggacgtacggtctagttatttacttcgtcgtccttcctactataacgtaacggtacgggacctacgacctacgttaccgttacgttaacgttacggtccgggaccgtacggaccgtacggccgtacggtacccgttcggtcggtaccaccggaccgacggtcccnccccggtccccgttcggtacctacccg

SEQ ID NO: 132282 - DNA, 683 bp, Homo sapiens
  misc_feature: GYAE6OF02GBGCB.9.2.A02.1.454.CMB.1.raw
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtcccgggtctcctggacagtcgatccaccatctcgtgcacgtggaaacgaatacgcgactagttgggtcggcttactaatcattcgtcttcctggtactataacagtccaggcaaacgccccccaaactcaattaatttatagattgttacgtttacggaccggtcccctacgtagggtacttttccttcgttcggttgttcgttggtcctaccgtaagttcgtacgggaacaccggtccctcccgtacgaccctatcctcgtcggtacttcgacgtccgtggacgggtacggagggtagtacgtttacttcgtcgtacgtacgttacaacgtacttacgaaccgttaaccctttccccgttacgggttttcgggtacggtttcggggtacggggtaaccgggtaccgtaggtcgtccggtacggtcccgtacgtcggacgtaccgcggtacccgaggtccgtccgccccgttcgcctaccgtccttcccgtccccgtccctacccg

SEQ ID NO: 132283 - DNA, 638 bp, Homo sapiens
  misc_feature: GYAE6OF02JENR5.9.2.A02.1.454.CMB.1.raw
  modified_base (236)..(236): a, c, t, g, unknown or other
  misc_feature (236)..(236): n is a, c, g, or t
  modified_base (451)..(451): a, c, t, g, unknown or other
  misc_feature (451)..(451): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgatacgcgacattggnggctctaatcatgtctctggtactataacagtccaggacaaacgcccccaaactcaattaatttatgagttgtactttagacggtccctacgtagggtactttcttcgttacggttgtcgtggcctaccgtaagtctacgggaaccacggtccctacccgtgtacctacttccgtcgtcggtactttcgacgtcctaggagggtacggtagggtntattacttcgcgtctaggttcagtacttacaacgtaaccgttcccgttgttcgggttcgttacgggacgggaggtacctagtcgtcgttacggacccgttcgtcgtacgtcgaccgacccgtaaggtccttacccgtacccccgtcggttcctaaccgttccgtacccgttccccgtaccgttcccg

SEQ ID NO: 132284 - DNA, 666 bp, Homo sapiens
  misc_feature: GYAE6OF02HD96F.9.2.A02.1.454.CMB.1.raw
  modified_base (342)..(342): a, c, t, g, unknown or other
  misc_feature (342)..(342): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacaatagcgacagttggtggctctaatcatcgtctcctggtactataacagtcaggcaaacgcccccaaactcaataattatgatgtctttagaccggcctacgaggtatttcttcgtcggttntctgtcctcctaagtcgtagggaaccaccggtcctcccgtagaccctatccgttcgtcgggtacttccgacgcctggaacgggacggtagggttacgtacgtttacgttcgtagtcgtacgttacacgtacgttacaaacgttaacccttcccggttacggtttggggtacggtttccgggacggggtaaccggtaccgtacgtcggtccttacggtacccgttcgtacgggacgttcccgaacggacccgtaacggtccgtccccggtaccccgttcggtacctacccgttcccgttacccgttccccctaccccgttacccg

SEQ ID NO: 132285 - DNA, 704 bp, Homo sapiens
  misc_feature: GYAE6OF02JAMG4.9.2.A02.1.454.CMB.1.raw
  modified_base (241)..(241): a, c, t, g, unknown or other
  misc_feature (241)..(241): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgccgccgtgtccgggtctccgtggacagtcgatcaccatctcgtgcactggaacgaatagcgaactagttgggngcttactaatcatcgtctccgtgtactataacagtccagcaaacgccccaaatcaattaattatgatgtactttacgaccggtcctgaggtacttttcttcgttcggttgtcgtgtactaccaagtcgtacggaacgacggcctcccgagacctactcttacgtcggtacttcgacggcccttaggaggtaccggaggggttataacgtttaccgttacgttggacttacggtttacaggttaaccttacgaaaccgttaaacccgtttccccgtttacgggttggggtttaccggttacccggggtacggggaacggggtaccctagggttccggtcggttaccggtacccgttccgtaggtaaccgtccggtaaccggtaccggtaaccggtccgttaccccgacccccggtttcgtcccgtacccgttaccgttccccggttcccccgtccccttacccg

SEQ ID NO: 132286 - DNA, 681 bp, Homo sapiens
  misc_feature: GYAE6OF02IJ1E4.9.2.A02.1.454.CMB.1.raw
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (611)..(611): a, c, t, g, unknown or other
  misc_feature (611)..(611): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacagggtcctgggcccagtccgccctgactcagcctgcccgccgtgtccgggtctcctggacagtcgatccacctatctcgtgcaacgtggaacaatacgcacagttggngctataancatcgtcctctggtactaataacngtccaggacaaccgaccccctaaactctaacttaatttagtacgtacttacggttactttagacgttccggcccttaggtaaggttcttttccgttcgttcggttcgtcgtcggtacctaccgtaacgtcgtaacgggaaccgtcccggtcctaccccgtagtaccctagttccgtcgtacggtaaccttccgacgtccgtagggacgggtaacggtggttactacgttcttcgtcgacttacgtacacgttacttaccgtaacgtaacccgttcccggttagggttcgggttaccgttcgggacgggtaccggacctagtcgcgtacgtccgtccgnggtaccgcgtacgaccgacggtccctcccggtcccgtcggtacctaccgtccgttccccgtccctacccg

SEQ ID NO: 132287 - DNA, 767 bp, Homo sapiens
  misc_feature: GYAE6OF02G8IWO.9.2.A02.1.454.CMB.1.raw
  modified_base (303)..(303): a, c, t, g, unknown or other
  misc_feature (303)..(303): n is a, c, g, or t
tcagtgatacgtctcacgaccggtgctcgatttagactcatctacaggggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaaacatagcactagttggtgctataatcatcgtctctgtactataacagtccaggacaaaccgacccccaaatctaattaatttnagtatgttacttacggaccgccctagtacgggtactttcgttcgtcggttgtcgtcggtcctaccgtaagtcgtacgggaactccggtacctccgtacgacctactccgtcgtcggtactcgacgtcgtaggacggtacggtagggtctactttaccgttcgtaacgtcgttacgttacgtaagttactttacgtaaacgtttaaccccgtttcccggtttacgggtttaggggttccgggtttaccggggaaccggggtaacggggttacccgttaacggttccgggtacccgtttacccgggtaacccggtttccggtagggttacccgtaacccgggtacccggtaaccccgggtacgggtaccccgttacccccgggttcccccggtttaccggggttcccttaaccccggtttaccccggtttaccccggtttaccccccctaccccgtttaccccggg

SEQ ID NO: 132288 - DNA, 754 bp, Homo sapiens
  misc_feature: GYAE6OF02G9FZB.9.2.A02.1.454.CMB.1.raw
  modified_base (241)..(241): a, c, t, g, unknown or other
  misc_feature (241)..(241): n is a, c, g, or t
tcagtgatacgtctcacgaccggtgctcgatttagactcatctacgagggggggggtctcaggaggcagcgctctcgggacgtctccaccatggcctgggctctgctattcctcaccctcctcactcagtgtacagggtcctggacccagtccgccctgactcagcctgccgccgtgtccgggtctccgtggacagtcgatcaccatctcgtgcactggaaacgaatagcgacagttgggnggctctaatcatcgtctctggtactatacagtccaggacaacgcccccaaatcaattaattatgatgtacttaggaccggtacctcgagggtactttcttcgttcggttcgtcgtggtcttccgaaacgtcgtacggggaaccaccgggtcccttcccgtacggaaccctagttcccgtcgttacgggtaccttcgacgtcccgtaggaacggggtaacggtaggggttcgtaacgtttaaccttcggtacggtccgttacgttacgacgttattaccgtaacgttaaaccctttccccggtagggtttcgggttcgggtttacccggggaccggggtaacgggtaacccgtacggttcggtacccgtttacgggtaacccgttccgtcggtacggttaccggaaccgggtaccctaaacggggtccccgtaccccgggttaccccccttccgggttacccgttacccgtttacccggttccccggtttacccccggtcccccgttaccccgg

SEQ ID NO: 132289 - DNA, 772 bp, Homo sapiens
  misc_feature: GYAE6OF02IPG68.9.2.A02.1.454.CMB.1.raw
tcagtgatacgtctcacgaccggtgctcgatttagactcatctacaggggggggggtctcaggaggcagcgctctcgggacgtctccacatggcctgggctctgctattcctcaccctcctcactcagtgtacagggtcctcgggcccacgtccgccctgactcagcctcgccgccgtgtccggtctcctgacagtcgatcacctatctcgtgcacgtaggaaacgaatagcgaactagttcgggtcgacttactaatcagttcgtcttaccgtggttaactaataaacagtaccgaagggacaaacgacccccaaactacgtaattaattatagtatgttacgtttacgaccggtccctacgtacgggttaattttccttacgttcggtttcgttcgtcggtctaccgtaacgttacggtacgggtaaccgtaccggcccgttacccgtacggaaccgtaccttaccgtccgttttttaggaccctttcgtacggtcccgtagggacgggtaacgggtagggttaggttactttacgttccgtacggtcctaacggtttcgtaacgtactttaccgttaaacgttaacctttccccgttacgggtttcgggtttacggtaccgggtacggggaaccgggtaacgttgttacggtccggtacgtacggttacctaggtactaccggtaacgaccggtaaccgtcccggtacccgtccccgttacgtacccggttcccttaccggttccccggttccccgtccgttacccccg

SEQ ID NO: 132290 - DNA, 759 bp, Homo sapiens
  misc_feature: GYAE6OF02JJWV2.9.2.A02.1.454.CMB.1.raw
  modified_base (134)..(134): a, c, t, g, unknown or other
  misc_feature (134)..(134): n is a, c, g, or t
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
  modified_base (345)..(345): a, c, t, g, unknown or other
  misc_feature (345)..(345): n is a, c, g, or t
  modified_base (725)..(725): a, c, t, g, unknown or other
  misc_feature (725)..(725): n is a, c, g, or t
tcagtgatacgtctcacgaccggtgctcgatttagactcatctacagggggggggtctcaggaggcagcgctctcgggacgtctccaccatggcctgggctctgctattcctcaccctcctcactcagtgtacngggtcctgggcccagtccgccctgactcagcctgccgccgtgtccgggtctcctggacagtcgatcaccatctcgtcganacgttaggaacgaatacggccgtactagttgggtggtcctactaagtctnttcgtcctcgttacggtaactaataacacgtaccagggacctaaaccgacccccctaaaataccgtaaactttaagtttanacgtagttacggttaccgtttaacggaccccggtccttaccggaggttacctttccgtttcgttacgggttcgttcgtcggccgttaaccgtaggttccggtaaggtaaccgaccccggtccttacccgtacgaccgttactcgttccgtacgggtcttacggaccgtcgtaaggtacggacggtagggttacttacgttaccgtcgtcggtactacgttaacgtagttccttaacgtaacccgtaaccggtttcccggtttacgggttcgggtttccgggtaaccgggccgggttaacgggaccttcgttaaccgtcgtaccgggccgttacgtcgttacggacctaacgggacctacgggtcccgtcccgtccccgtncccgtacgttcccgtccggtcccctacgtacccg

SEQ ID NO: 132291 - DNA, 778 bp, Homo sapiens
  misc_feature: GYAE6OF02F8GK6.9.2.A02.1.454.CMB.1.raw
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
tcagtgatacgtctcacgaccggtgctcgatttagactcatctacaggggggggggtctcagggaggcagcgctctcgggacgtctccaccatggcctgggctctgctattcctccaccctcctcactcagtgtacagggtcctgggcccagtcccgcctgactcagcctgccgcgtgtccgggtctcgtggacagtcgactcacctntctcgtncacgtaggaacatacgcgtactagttggcggtctacgttaactcgtagtcgtccgtccgttacggttaactaactaacgtacgtaccgaaggaaccaaaccgaacccccctaaacttacctaaattaacttttanacgtnttacggttacgtttaccggacccggttcccgtacgtaagggttacttttccgtttaccggtttcggttcggttcgtcggttactaccgtaacggtccgtaacgggtaacccaccgggtccccttaccgtacgtaaccctacgtccgttacggttacgtaccttcgacggtccgtagggaacgggtaccggtagggtaccttacttttacgtcgtcgtacgttaacgttcgacgttaattaccgaaccgttacctttacccggttggtttcggggttacggttaccggggacgggtaaccggtcctaagttccggtacgttaccgtaccgttccggttacgacggtccgaacccggtaaccgaccggtcgaccccgttcgttccggccttaccgtccgttacccgtttaccccacccgttaccg

SEQ ID NO: 132292 - DNA, 826 bp, Homo sapiens
  misc_feature: GYAE6OF02IPUCZ.9.2.A02.1.454.CMB.1.raw
  modified_base (76)..(76): a, c, t, g, unknown or other
  misc_feature (76)..(76): n is a, c, g, or t
  modified_base (138)..(138): a, c, t, g, unknown or other
  misc_feature (138)..(138): n is a, c, g, or t
  modified_base (201)..(201): a, c, t, g, unknown or other
  misc_feature (201)..(201): n is a, c, g, or t
tcagtgatacgtctcacgaccggtgctcgatttagactcatctacgagggggggggtcgtcaggaggcagcgctcncgggacgtctcaccatggcctagggctctgctattcctcaccctcctcactcagtcgtacgngggtcctcgggacccagtccgcctgactcagcctagccgcgtcgtccgggtcctccgtggacngtcgtatcacctatctcgtgcacgtaggtaaccgaatagccgaacgtaagtttggacggtacttacgtaaactcgtaattcggttacttccgtaggttacctaagttaaaccgaacgtaccgaaggaccgaaaccgaccccctaaaataccgtaacttaaagtttacgtacggtattacggttacgtttaacggacggtaccctacggtaacggttacttttcttacgttcggttcggttacgtcgtaccgtacgtaacgttcgtacgggtaacctacggtccgttaccctacgtacctactctcgtacgtacgttacacggtcctaggacgacgggtagtacgtacgtttaccgtacgtacgtacgttacgttacgtaaagttaaccgttaacggaaccgtttaaaccctttcccgggttaggtttccggggttacgtttacccggggcggttaaacccggggactaaccgttaccgggacggttaacccgtaccggggtaccttaggaaccgtaaccggttaaccgaaccccgggtaaacggtcccgtacccggttaccccttaccgggacccttttaacccgtacccgggttaaccctttccccccgtaaaccggtttcccc

SEQ ID NO: 132293 - DNA, 707 bp, Homo sapiens
  misc_feature: GYAE6OF02F8I6I.9.2.A02.1.454.CMB.1.raw
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
tcagtgatacgtctcacgaccggtgctcgatttagactcatctacaggggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatccaccatctcgtgcactggaacgaatagcgacattggtgctctaatcatgtctcctggtactataacngtccaggcaaagcccccaaactcataattangatgtctttagacgtcctgaggtatttcgttctcggttgtctggctcaagtctacgggaacacggcctccctagtaccattcctcgtacgggactttccgacgtccgtggaacggggtacggtacggggttacgttacgtttaccgtttcgtcggacgttaacggtttacccgaaggttaacttaccgaacggttaaaaccccgttttccccggttacgggtttcggggtttcgggttttaccggggacgggggtaacgggtaccgtagttcggtaccgttcggtaacccggttccgtaggaccggttacgaaccgggtaccccgtaacggggtccctaccgggttccccccgttaggggttcccctaacgttttcccggtccccgtttaccccgaccctttacccgg

SEQ ID NO: 132294 - DNA, 817 bp, Homo sapiens
  misc_feature: GYAE6OF02JZ6KQ.9.2.A02.1.454.CMB.1.raw
  modified_base (701)..(701): a, c, t, g, unknown or other
  misc_feature (701)..(701): n is a, c, g, or t
tcagtgatacgtctcacgaccggtgctcgatttagactcatctacgagggggggggtctcaggaggcgagcgctctcgggacgtctccacatggcctgggctctgctattcctcaccctcgtcactcagtgtacagggtcctgggacccagtcccgtccgtggactcagcctgcccggtcgtcggttccgggtctccgtggacacgtcgaactcccacctatccgtcgtgacctacgtacggaaacgtaactaaggccgtagtagttcgggtgaccttacgtaatccaagttcgtacgttaccgtaggttaactactaaccgtacgtaccgaacgggaaccaaacccggtaacccccgtaaacgttccctaaagttaacgtttacgaccggttagttacgtttaacggttaaccgggtaaccggtacccgtttaccggtaaggggtttccttttaaccgtttcggttacggtttccggttacctacggggtaccttaccgggtaaaacgttcggtaaccggaaccgtacccggtctacccgtaagggtacctacgttaccgttacggtacgtaaccgttcgaacgttccgaaggtaccggtaggtcgtaagttacgttctacggtcggtatagtaccgtataataccgtaaccgttaccgtacggtcgttacgggtacgtaccgggtagaaccgttacgtntaccgggacccctttagacggttaccaggccctacgggaaacctaccggtacggttcccgaaccggttcccgttagttacccggacgtttccccgtaaccctccccgttccgtaac

SEQ ID NO: 132295 - DNA, 877 bp, Homo sapiens
  misc_feature: GYAE6OF02JFM2U.9.2.A02.1.454.CMB.1.raw
  modified_base (864)..(864): a, c, t, g, unknown or other
  misc_feature (864)..(864): n is a, c, g, or t
tcagtgatacgtctcacgaccggtgctcgatttagactcatctacaggggggggggtctcaggaggcagcgctctcgggacgtctccaccatggcctgggctctgctattcctcaccctcctcactcagtgtacagggtccgtgggcccagtcccgccctgactcagcctgccgcgtgtccggtctcgtggacacgtcgactcaccattccgtcggtgccacgtaggaaacgaaatacgcgaactagtttgggtcgtctataatcgattcgtcctcgtcgtaactactaacgacgtcgaacgacaaaaccgtcccccctaaaacgtactaacgttaaattttactacgtagtttacggtttcgtttaccggacccgtaccgttacgtacgggttacttttacctttccggttttggtttcttacgttcgggttaccctaccgtaacgggttcggtaaccgggaaccgtaccccggttcctacccgtcgtaacccttattcccgggttccgttacgggtaccctttccgtaacggttacccgtcggggtaaacgggtaacgggtacggggttaacgttaccgttttacgtttaccggttaccgtaccgtttaacgggttaccgttaacgttaaccgggtttaaaccgaaaacgtttttaacccccggttttaccccgggtttcgggggtttaaccggggttccgggttaccggggtaacggggtacccgggtaacgtaccggtaggttcccgtaacccgggtttcctcgttacccgggtaacgggtacccggttaacggacccgttacggttacccgccccggtacccgttccgtacctaccgttccccggttccctttaccccncccgtttaacccg

SEQ ID NO: 132296 - DNA, 459 bp, Homo sapiens
  misc_feature: GYAE6OF01BM5YV.10.39.D06.1.454.CMB.1.raw
  modified_base (448)..(450): a, c, t, g, unknown or other
  misc_feature (448)..(450): n is a, c, g, or t
  modified_base (452)..(459): a, c, t, g, unknown or other
  misc_feature (452)..(459): n is a, c, g, or t
tcagcatagtagtgcacgaccggtgctcgatttagtgacatctcgcagttctttgggggagagactgaagaacccagcattgcagcagctccatcatggcctgggctcctctgctcctcaccctcctcagtctcctcacagggttgactcagccaccttctgcatcagcctccctgggagcctcggtcacactcacctgcaccctgaacagcgactacatcttgggctcaggcctcaatcggtgcctgaccaccaacaacatctacgaagagggtgagagtgtccctcactgtggggcagacaatggcagtgggagcaatttcgtgagagtgttcggcggagggaccaacgtgaccgtccttcctaggtcagcccaaggctgcccctggtcactctgttccccaccctcctccactactatgctgagcgggctggcaaggcgcatagnnngnnnnnnnn

SEQ ID NO: 132297 - DNA, 511 bp, Homo sapiens
  misc_feature: GYAE6OF01C7D8Z.10.39.D06.1.454.CMB.1.raw
  modified_base (359)..(359): a, c, t, g, unknown or other
  misc_feature (359)..(359): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcgagggactcccgtgagcgtattctctggctcaattcggcaacncggccacctcatcatcacgaggtcgaggcgggatggacggccgactactactgtcagggtgtgggtatttcactacgtgatcagtggtggggtctcggcggaggaccagcgtcgaccgtctagcagcccaaggcctcgcccctggtctaccg

SEQ ID NO: 132298 - DNA, 515 bp, Homo sapiens
  misc_feature: GYAE6OF01BBD34.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgagggccgggatggaggccgactactactgtcaggtgtgggtatttcgactactgatcagtggtggggtcttcgggcggaggaccaagcgtgaccgtcgtagtcgagcccgaggctgccccctggtctaccg

SEQ ID NO: 132299 - DNA, 451 bp, Homo sapiens
  misc_feature: GYAE6OF01AXFIY.10.39.D06.1.454.CMB.1.raw
  modified_base (441)..(441): a, c, t, g, unknown or other
  misc_feature (441)..(441): n is a, c, g, or t
  modified_base (446)..(451): a, c, t, g, unknown or other
  misc_feature (446)..(451): n is a, c, g, or t
tcagcatagtagtgcacgaccggtgctcgatttagtgacatctcgcagttctttgggggagagactgaagaacccagcattgcagcagctccaccatggcctgggctcctctgctcctcaccctcctcagtctcctcacagggttgactcagccaccttctgcatcagcctccctgggagcctcggtcacactcacctgcaccctgaacagcgactacatcttgggctcaggcctcaatcggtgcctgaccaccaacaacatctacgaagagggtgagagtgtccctcactgtggggcagacaatggcagtggagcaattcgtgagagtgttcggcggagggaccaacgtgaccgtccttctaggtcagccaaggctcgccccctggtcactctcgttcccaccctcctccactactatcgctgacgcggctggcaaggcncatgnnnnnn

SEQ ID NO: 132300 - DNA, 452 bp, Homo sapiens
  misc_feature: GYAE6OF01BKTYD.10.39.D06.1.454.CMB.1.raw
  modified_base (437)..(437): a, c, t, g, unknown or other
  misc_feature (437)..(437): n is a, c, g, or t
  modified_base (441)..(452): a, c, t, g, unknown or other
  misc_feature (441)..(452): n is a, c, g, or t
tcagcatagtagtgcacgaccggtgctcgatttagtgacatctcgcagttctttgggggagagactgaagaacccagcattgcagcagctccaccatggcctgggctcctctgctcctcaccctcctcagtctcctcacagggttgactcagccaccttctgcatcagcctccctgggagcctcggtcacactcacctgcaccctgaacagcgactacatcttgggctcaggcctcaatcggtgcctgaccaccaacaacatctacgaagagggtgagagtgtcctcactgtgggcagacaatggcaggtgggagcaatttcgtgagagtgttcggcggagggaccaacgtgaccgtcttctaggtcagccaaggctcgcccctggtcactctcgttcccacctcctccactactatcgctgagcggctggcaggcnatgnnnnnnnnnnnn

SEQ ID NO: 132301 - DNA, 520 bp, Homo sapiens
  misc_feature: GYAE6OF01AG378.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgcgtctataatgataacgaccggccctcagggatccctgagcgattctctggctccaattcgggcaacacggccaccctcatcatcaccagggtcgagggcccgggatggacggccgactactactgtcagggtgtgggatttcgactactgatcatggtggggtcttcgggcggagggtaccaagcgtgaccgtcctaagtcagcccaaggctcgccccctgggtcctaccg

SEQ ID NO: 132302 - DNA, 546 bp, Homo sapiens
  misc_feature: GYAE6OF01C4QJP.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggccctgtggttgtcgtctataatgataacgaccggccctcagggtactccctgagcgattctctggctccaagttcggcaacgcggccaccctcatcatcaccgagggtcgagggccgggatggacggcccgactactacgtgtcgaggtgtgggatttcactactgtatctagtggtggggtcttcggggcggtagggaccaaggtcgtacggtacccgtcgtaacgtcgacggaccccgaaggtcctaccggccccctggtcctacccg

SEQ ID NO: 132303 - DNA, 561 bp, Homo sapiens
  misc_feature: GYAE6OF01DN09Z.10.39.D06.1.454.CMB.1.raw
  modified_base (293)..(293): a, c, t, g, unknown or other
  misc_feature (293)..(293): n is a, c, g, or t
  modified_base (433)..(433): a, c, t, g, unknown or other
  misc_feature (433)..(433): n is a, c, g, or t
tcagcatagtagtgcacgaccggtgctcgatttagtgacatctcgcgagttctttggggctgggcctaaggaagcagcactggtggtgcctcagccatggcctggaccgttctcctcctcggcctcctctctcactgcacagactctgtgacctcctatgcgctgactcagccaccctcggtgtcaggtggccccaggacagacggccacgctgacctgtgggggatacacaattggaagtaatcgtgtgcactggtaccagcagaggccaggccaggccctgtgttgtcgtntataatgatacgaccggccctgagggatccctgagcgattctcgtggctcaattccgggacaacgtacggccaccctcaactcacttaccaccgaacggggtcgacgggcccggggatcggaggccgactactactgtcnggtgtgggtattcgactctagtactcgtagtggtcggggtacgttcgggacgggacgggaccaaggcgtacggaccgttccgtaacggtacacggacccaaggacctcgcccccgtggttcctacccg

SEQ ID NO: 132304 - DNA, 569 bp, Homo sapiens
  misc_feature: GYAE6OF01DYYNY.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccaggcccctgtggtgtcgtctataatgataacgaccggccctcgagggactccctgacgcgattctctggctccaagttcggcaacacggccaccctcactcactcaccgagggtcgagggccgggatggacggccgactactacgtgtcgaggtgtgggtatttcacgtactgatctagttggtacggggtcttacgggcgggtacgggaccgaaggccgtacggacccgttaccgtaacggtccgaacggaccccgtaacgggcctaccggtcccccccgtggtcccgtacccg

SEQ ID NO: 132305 - DNA, 513 bp, Homo sapiens
  misc_feature: GYAE6OF01C7E8V.10.39.D06.1.454.CMB.1.raw
  modified_base (293)..(293): a, c, t, g, unknown or other
  misc_feature (293)..(293): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtntataatgataacgaccggccctcagggatccctgagcgattctctggctccaattcgggacacacggccacctcatcatcacagggtcgacgggcgggatggaggccgactactactgtcgaggtgtgggatttcactactgatcgatggtggggtctcggcggaggacaagcgtgaccgtctaagtcgacgcccaaggcctgcccccgtcggtctaccg

SEQ ID NO: 132306 - DNA, 552 bp, Homo sapiens
  misc_feature: GYAE6OF01CNZQP.10.39.D06.1.454.CMB.1.raw
  modified_base (370)..(370): a, c, t, g, unknown or other
  misc_feature (370)..(370): n is a, c, g, or t
  modified_base (473)..(473): a, c, t, g, unknown or other
  misc_feature (473)..(473): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacggcacgctgacctgtgggggatacacaattggaagtaatcgtgtgcactggtaccagcagaggcaggccaggcccctgtggttgtcgtctataatgataacgaccgcctcagggatcccgtgacgcgtattctcgtggctaccgaagttcgggacaacacggccacctnatcatcacagggtcgaggccgggatggacgccgactactacgtgtacgaggttcgtagggtatttcgactacgtgaactcagtcgggttcggggtcttcgggngggacgggaccaaggtcgtacgaccgtacgtaacgtccgacgccccgaagggtcctaccggccccttcgggtctacccg

SEQ ID NO: 132307 - DNA, 615 bp, Homo sapiens
  misc_feature: GYAE6OF01DU43M.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggccctgtggtgtcgtctataatgataacgaccggccctcgagggatcccgtgacgcgattctctggctccaagttcgggcaacgacggccacctcatcatccaccgagggtcgacgggcccgggatcggacggccgactactacgtgtcgaggttgtgggtactttcgaacgttacgtcgaatccgtagttcgggttgggggttccgtttacggggaccgggtaacggggtacccgaagggtcccgttacggtaaccccggttacccgttaaaggtacccgtacggaccccgtaaacgggtcccttacccggtcccccccgtcgggtcccgtaaccccgg

SEQ ID NO: 132308 - DNA, 527 bp, Homo sapiens
  misc_feature: GYAE6OF01CLAT3.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcattggtaccagcagaggccaggccaggcccctgtggttgtcgtctataatgataacgaccggccctcgagggatccctgagcgattctctggctccaattcgggcaacgacggccaccctcatcatcaccagggtcgagggccgggatggacggccgactacgtactgtcgagggtgtgggatttcgactacgtgatcatggtggggtcttcgggcggagggaccaggcgtggaccgtctaagtcacgacccgaggcctcgcccccgtcggtctaccg

SEQ ID NO: 132309 - DNA, 508 bp, Homo sapiens
  misc_feature: GYAE6OF01A2JE6.10.39.D06.1.454.CMB.1.raw
tcagcatagtagtgcacgaccggtgctcgatttagtgacatctcgcagttctttggggctgggcctaaggaagcagcactggttggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccgggatggaggccgactactactgtcaggtgtgggatttcactactgatcatgtggggtcttcggcggaggaccagcgtgaccgtctaagcagcccaaggctgccccctggtcctaccg

SEQ ID NO: 132310 - DNA, 522 bp, Homo sapiens
  misc_feature: GYAE6OF01DV374.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtggggatacacaattggaagtaatcgtgtgcactggtaccagcagaggccaggccaggcccctgtggttgtcgtctataatgataacgaccggccctcagggactccctgagcgattctctggctccaattcggacaacacggccaccctcatcatcaccgagggtcgagggccgggatgaggccgactactaactgtcagggtgtgggtatttcgactacgtgatcagtggtggggtcttcgggcggagggaccaaggcgtcgaccgtcctaagcagcccgaaggcctgccccctggtctaccg

SEQ ID NO: 132311 - DNA, 817 bp, Homo sapiens
  misc_feature: GYAE6OF01CLCX5.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccaggcccctgtggtgtcgtctataatgataacgaccggccctcgacgggactcccgtgacgcgtattctcgtcggctaccgaagttccgggactaaaccgaccgggccctaacccctacgacttaccaacgttacccgaaacccgtacggggggttacccggaaccgggggtaccccggggggtaacgttacggggaaccggggtaccccggtaacccgtttaaaccccggttaaccggttacgggttaccggtaacgggggtttcgggtttacgggggttaaaccgtttttttccgaaacccgttttaaccggttacggttaaacgttcccgtaaagggtttcgggggtttaccgggggggttacccgtttaccggggggtaacccgggggtaaccgggggtaaacccgtaaacgggtcccggttaaccgggtaaccccggttacccggttaaacggttacccggaacggtaaccccccgggtaaacggggtccccgttacccgggtaccccccccggttccgggttacccgttaacccccgg

SEQ ID NO: 132312 - DNA, 605 bp, Homo sapiens
  misc_feature: GYAE6OF01DF7C6.10.39.D06.1.454.CMB.1.raw
  modified_base (353)..(353): a, c, t, g, unknown or other
  misc_feature (353)..(353): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggccctgtggtgtcgtctataatgataacgaccggccctcagggatcccgtgagcgattctctggctcaagtcggcacncggccacctcatcatcaccagggtcgagggccggggatggaggcccgactactacgtgtacagggttgtggggtatttcgaacttacgtggtatccgtaagttgggttacggggggttctttcggggccggggtaaggggacccgtaaagggccgttacgggtacccggttacccgtaaaacgggttccaaaccgggtaccccgaaacgggtcccgttccggtacccccccggtcgggttcccgtaaccccg

SEQ ID NO: 132313 - DNA, 541 bp, Homo sapiens
  misc_feature: GYAE6OF01BLME6.10.39.D06.1.454.CMB.1.raw
  modified_base (317)..(317): a, c, t, g, unknown or other
  misc_feature (317)..(317): n is a, c, g, or t
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacgacaattggaagtaatcgtgtgcactggtaccagcagaggccaggccaggcccctgtggttgtcgtctataatgataacgaccggccctnagggatccctgagcgatctntggctccaattcgggcaacnccggccaccctcatcatcaccagggtccgagggccggggatggacggccgactactacgtgtcgaggtggtggatttcgactactgatcgagtggtggggtcttcgggcggtaacgggccaaggcgtcggacccggtcctaaaggtccaggccctaagggcctacggccccctggtcctacccg

SEQ ID NO: 132314 - DNA, 525 bp, Homo sapiens
  misc_feature: GYAE6OF01D2HN0.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatagtgtgcactggtaccagcagaggccaggccaggcccctgtggttgtcgtctataatgataacgaccggccctcgagggatccctgagcgattctctggctccaattcgggcaacacggccaccctcatcatcaccagggtcgagggccgggatggaggccgactactacgtgtcgaggtgtgggtatttcacttactgatcatggtggggtcttcgggcggagggaccgagcgtgtacccgtacgtagtcacgcccgaaggcctcgccccctggtctacccg

SEQ ID NO: 132315 - DNA, 513 bp, Homo sapiens
  misc_feature: GYAE6OF01BICM8.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatcccgtgagcgattctctggctcaattcgggcaacacggccacctcatcatcaccagggtcgaggccgggatgaggccgactactactgtcaggtgtggatttcgactactgatcagtggtggggtcttcggcggagggaccaaggctggaccgtcctaagtcagcccaaggcctgccccctggtcctaccg

SEQ ID NO: 132316 - DNA, 567 bp, Homo sapiens
  misc_feature: GYAE6OF01A15BU.10.39.D06.1.454.CMB.1.raw
  modified_base (370)..(370): a, c, t, g, unknown or other
  misc_feature (370)..(370): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgccggccctcagggactccctgacgcgattctctggctccaagttcggacaacacggccaccctnactcatcaccgagggtccgagggccgggatcggacggccgactacgtacgtgtcgaggtgtgggtactttcaagtactgactcagttggtcggggtcgttcgggacgggtacgggccaaggtccgtacggacccgttaccgtaaaggtccaacggccccgtaaagggcccttacggccccccgttggtcctacccgg

SEQ ID NO: 132317 - DNA, 578 bp, Homo sapiens
  misc_feature: GYAE6OF01BDNW0.10.39.D06.1.454.CMB.1.raw
  modified_base (316)..(316): a, c, t, g, unknown or other
  misc_feature (316)..(316): n is a, c, g, or t
  modified_base (359)..(359): a, c, t, g, unknown or other
  misc_feature (359)..(359): n is a, c, g, or t
tcagcatagtagtgcacgaccggtgctcgatttagtgacatctcgcgagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctatatgataacgaccggccctnagggactccctgagcgattctctggctccaagttcgggcaacncggccaccctcatcatcaccagggtcgaggccgggatgacggccgactactacgtgtcgaggtgtgggtatttcacttacgtgatcgtagttggtggggttaccttcggggcgggaggggacccaaaggtccgtacggacccggttaccgttaaacggttccgaaccggaccccgtaaacgggtccctaccggtcccccccgttcgggtccctaacccg

SEQ ID NO: 132318 - DNA, 555 bp, Homo sapiens
  misc_feature: GYAE6OF01BQAEW.10.39.D06.1.454.CMB.1.raw
  modified_base (314)..(314): a, c, t, g, unknown or other
  misc_feature (314)..(314): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgacgccctnagggatccctgagcgtattctctggctccaagttcgggcaacaccggccaccctcatcactccaccgagggtcgacgggccgggatggacggccgactacctacgtcgtcgaggtgtgggatttcgaactactgatcgattgggtcggggtcttcgggcgggacgggaccgaaggcgtacggacccgtacgtaaacgtacggacccgaaggtcctcggcccccgtcggtccacgttccccg

SEQ ID NO: 132319 - DNA, 598 bp, Homo sapiens
  misc_feature: GYAE6OF01BHL3N.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacgacaagttggaagtaatcgtgtgcactggtaccagcaggaggccaggccaggcccctggtggttgtcgtctatatgataacgaccgccctcgagggactccctagacgcgattctctggcctcaagttcgggcaacgaccggcccaccctcactcactacaccgaggggtcgacgggaccgggatcggacgggacccgactacgtaccgtggtccgtagggtcggtgggtaactttcgacttacgtgtactcgtagttgggtcggggttcgtcgggacgggacgggaccgaaggtccgtacggacccggtaccgtaacgtccgaaccgacccgtaacgggcctccgggcccccgttcggtccctacccg

SEQ ID NO: 132320 - DNA, 584 bp, Homo sapiens
  misc_feature: GYAE6OF01D35IG.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccaggcccctggtggttgtcgtctataatgataacgaccggccctcgagggactcccgtgacgcgattctcgtggcctccaagttccgggacaacgaccggcccaccctcactcactccaccgaggggtcgacgggccggggatcggacggcccgactacgtacgtgtcgagggtgtgggtatttcgacttactgatcgtagtgggttcggggtcttcgggcgggagggaccaaggtccgtacggacccgttacgtaacggtccgaacggaccccgaagggtccctaccggtcccccgttcggtcctacccg

SEQ ID NO: 132321 - DNA, 752 bp, Homo sapiens
  misc_feature: GYAE6OF01C0858.10.39.D06.1.454.CMB.1.raw
  modified_base (300)..(300): a, c, t, g, unknown or other
  misc_feature (300)..(300): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtggggatacacaattggaagtaatcgtgtgcactggtaccagcagaggccaggccaggcccctgtggttgtcgtctataangataacgaccggccctgagggatcccgtgacgcgtattctcgtggtcctaccgtaattcggggacaaacgtaccgggccctaacccctcactaccgactccaaccgtacggggtaccggaacggggacccggggagtacgggaaccggggtacccgtaaccgtaaccgttaaccgtcggttaccgtaggggttacggttagggggtaacttttacgtaacgttaaccgttacggtacgttacgtacggttaggggtttacggggggggtttccgtttccggggggtaccgggggtaacggggggtacccgtaaacggggtccgttaaccgggtaacccccgggtttacccggttaaaacggtacccggtaaacccgggtacccccggtaaaaccggggtcccgttacccgggtaccccccccccggttccgggttaacccgttaacccccgg

SEQ ID NO: 132322 - DNA, 526 bp, Homo sapiens
  misc_feature: GYAE6OF01DAORD.10.39.D06.1.454.CMB.1.raw
  modified_base (314)..(314): a, c, t, g, unknown or other
  misc_feature (314)..(314): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtgttgcgtctataatgataacgaccggccctnagggactccctgagcgtattctctggctccaattcgggacaacgacgccacctcatcatcaccagggtcgagggccgggatggagccggactactactgcaggtgtgggtatttcaacttactgagtcagtggttggggtcttcgggcggagggaccaaggcgtggacccgtctaaggccaaggccctaagggctcgccccctggtcctacg

SEQ ID NO: 132323 - DNA, 562 bp, Homo sapiens
  misc_feature: GYAE6OF01EJT77.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggtgtcgtctataatgataaccgaccggccctgagggactccctgagcgattctctggctcaagttcggcaacgcggccaccctcatcatccaccgagggtcgacgggccgggatggacggccgactactacgtgtcaggtgtgggtattcactactgatctagtggtaggggtcgttcgggacgggacgggaccgaaggtccgtcggtaacccggttccgtaaacggtccgacgaccccgtaacgggtcctaccggccccccgtcgggtccctacccg

SEQ ID NO: 132324 - DNA, 631 bp, Homo sapiens
  misc_feature: GYAE6OF01ECTLH.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtggggatacacaagttggaagtaatcgtgtgcactggtaccagcagaggccaggccaggcccctggtggttgtcgtctataatgactaacgaccggccctcgagggactcccgtgagcgattctcgtggctaccgtaagttccgggcaaacgaccggcccaccctcactcactccgaccgagggtccggaacggggcccggggagtaggaccgggtaccgaaccgttacgtacgttcggtaccgtagggttcggttgggtatttccgacgttacgtagacgttacgtaggttgggtcgggggttcgttcgggacggggtacgggaccgaaggtccgtcggtacccgttacgtaacgtccgaacggaccccgaagggtccctaccggtccccccgttcggtcccgtaacccgg

SEQ ID NO: 132325 - DNA, 652 bp, Homo sapiens
  misc_feature: GYAE6OF01CXWG2.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacggccacgctgacctgtgggggatacacaattggaagtaatcgtgtgcactggtaccagcagaggccaggccaggcccctggtggttgtcgtctataatgactaacgaccggccctcgaggactcccgtgacgcgtattctctcggctaccaagttcggactaacaccggccaccctcactccatcccacgtacggggtccgacggggccgggatacggacggaccgacttacgtacgtcggtaccgagggttcgtaggggtatttccgaacgttacgtcggtaactccgtaaggttcgggttacgggggttccgttcggggaacggggtacggggtaaccccgaagggtccgtaccgggtaaccccggttaccgttaaacgggtcccgaaccgggtaccccgtaaacgggtcccgtaccccgggtccccccgttcgggtcccttaccccg

SEQ ID NO: 132326 - DNA, 560 bp, Homo sapiens
  misc_feature: GYAE6OF01CU7TY.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacggccacgctgacctgtggggatacacaattggaagtaatcgtgtgcactggtaccagcagaggcaggccaggccctggtgttgtcgtctataatgataacgaccggtccctcagggactcccgtgacgcgtattctcgtggctcctaagttcgggcaacgacggcccaccctcatccatcaccgaggtcggacgggcccgggatcggacggccgactacgtacgtgtcgtaggtggtggtattcgacttactgatcgtagttggtggggtcgttcgggcgggacgggaccgaggccgtcggtaccgtaccgtaacgtccgacgtcccgaaacggccgtacgcccccgtggtcctacccg

SEQ ID NO: 132327 - DNA, 648 bp, Homo sapiens
  misc_feature: GYAE6OF01ALDVO.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctgtgggggatacacaattggaagtaatcgtgtgcactggtaccagcaggaggccaggccacggcccctggtggttgtcgtctatatgataacgaccggccctcgagggactcccgtgacgcgtattccgtcgtggcctcctaacgttcgggacaaccgaccggcccaccctcactccactccaccgaggggtaccgacgggcccggggatcggacgggcccgacgtaccgttacgtggtcgagggtggtcgggtactttcgaacgttacgtggtatcgtaggttcgggttcggggggttccttccgggggaccgggtacggggaacccgtaaggtcccgtacgggtacccggttaccggtaacggttccgaaccggaccccgtaaacgggcccttaccccgggtcccccccgttcggggtccttacccccgg

SEQ ID NO: 132328 - DNA, 532 bp, Homo sapiens
  misc_feature: GYAE6OF01C1QU9.10.39.D06.1.454.CMB.1.raw
  modified_base (298)..(298): a, c, t, g, unknown or other
  misc_feature (298)..(298): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcacgtggtaccagcagaggccaggccaggccctgtggtgtcgtctataangaataacgaccggccctcgagggatccctgacgcgattctctggctcaagttcggcaacgacggcccaccctcactcactcaccagggtcgagggccgggatggacggccgactactacgtgtcgaggtgtggtatttcgactacgtgatcagtcggtgggtcgtcggcggagggaccagcgtcgaccgtaccgtaagtcgacgcccgaacggctacgcccccgtggtctaccg

SEQ ID NO: 132329 - DNA, 543 bp, Homo sapiens
  misc_feature: GYAE6OF01CJV3F.10.39.D06.1.454.CMB.1.raw
  modified_base (336)..(336): a, c, t, g, unknown or other
  misc_feature (336)..(336): n is a, c, g, or t
  modified_base (366)..(366): a, c, t, g, unknown or other
  misc_feature (366)..(366): n is a, c, g, or t
  modified_base (397)..(397): a, c, t, g, unknown or other
  misc_feature (397)..(397): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaagtaggaagtaatcgtgtgcactggtaccagcagaggccaggccacggcccctgtggttgtcgtctataatgataacgaccgcctcgaggatcctgagcgattcnctgctcaagtcggcaacacggccacccgtnactcatcaccgagggtccgagggccgggtancggacggccgacgtactacgtgcgtaggtgtagggtattcgactactgatcgtagtggtaggggtcttcggggcggacgggaccgaaggcgtcggaccggtacgtaagtcgacgacccgtaggacctcggccccctggtcctaccg

SEQ ID NO: 132330 - DNA, 533 bp, Homo sapiens
  misc_feature: GYAE6OF01EFW9Q.10.39.D06.1.454.CMB.1.raw
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
tcagcatagtagtgcacgaccggtgctcgatttagtgacatctcgcagttctttgggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccaggcccctgtggtgtcgtctataatgataacgaccggccctnagggatccctgagcgattctctggctccaagttcggcaacncggccaccctcatcatcaccgagggtcgacgggcgggatggacggccgactactactgtcaggtgtgggtattcgactactgatcagttggtggggtcttcgggcggagggaccaaggcgtcggtaccgtacgtagtcgacgacccgtaaggctaccgccccgtcggtcctaccg

SEQ ID NO: 132331 - DNA, 513 bp, Homo sapiens
  misc_feature: GYAE6OF01AEZQN.10.39.D06.1.454.CMB.1.raw
  modified_base (499)..(499): a, c, t, g, unknown or other
  misc_feature (499)..(499): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggccccctgtggttgtcgtctataatgataacgaccggccctcagggatccctgagcgattctctggctccaattcggggcaacacggccaccctcatcatcaccagggtcgaggccggggatgaggccgactactactgtcaggtgtgggatttcactactgatcatgtgggggtcttcgggcggagggaccgaagcgtgaccgtctaagtcagcccaaaggcngccccctggtcacc

SEQ ID NO: 132332 - DNA, 531 bp, Homo sapiens
  misc_feature: GYAE6OF01BYK9D.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggactccctgacgcgattctctggctccaattcggcaacacggccaccctcatcatcaccagggtcgaggccggggatggaggcccgactactacgtgtcaggtgtgggtatttcgacttactgatcgagttggtggggtcttcgggcgggagggaccaaggcgtacggaccgtcgtagtcacgacccaaggcctcggccccctgtcctaccg

SEQ ID NO: 132333 - DNA, 533 bp, Homo sapiens
  misc_feature: GYAE6OF01A802F.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgcttacctgtggggatacacaattggaagtaatcgtgtgcactggtaccagcagaggccaggccaggcccctgtggaacttgtatataaggacactgacgaggcccccagggactcccgtgagcgattctctggctccagctcgagggacaacagtgacgttgaccatcgaggcggacgcccgggcaggaggacgaggctagactatactgtcatcaacaagactattactggttacttagttgggtgttcggcggtagggtccaaggtcgtcggtaccgtccgtacggtcacgacccgaaggcctccgcccccgtggtcctccg

SEQ ID NO: 132334 - DNA, 542 bp, Homo sapiens
  misc_feature: GYAE6OF01CS6Y5.10.39.D06.1.454.CMB.1.raw
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
tcagcatagtagtgcacgaccggtgctcgatttagtgacatctcgcagttctttggggctgggcctaaggaagcagcactggtggtgcctcagccatggcctggaccgttctccctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctggtggttgtcgtctataatgataacgaccgccctnagggatccctgagcgattctctggctccattcggcaacncggccaccctcatcatcaccagggtcgagggccgggatggaggccgactactactgtcaggtgtgggtatttcgaacttactgatcgagttggtcgggggttcttcgggacggtacgggaccaaggctacggacccgtactaaggtccgaacgcccgaaggacctccgaccccctggtcctacccg

SEQ ID NO: 132335 - DNA, 662 bp, Homo sapiens
  misc_feature: GYAE6OF01DC11T.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacggccacgctgacctggtgggggatacacaagttaggaagtaatcgtgtgcacgtggtaccagcagaggccaggccacggccctggtggttgtcgtctataatgataacgaccgcctcgagggactcccgtgacgcgtacttctcgtcggcttaccgtaaagttccggggaccaaaccgaccgggaccctaacccgtcaactccaactccgacccggaggggtaccggacggggaccggggagtacgggacggcccgtaacgtacgtacgtggtcgtagggttgtacggggtactttcgaacgttacgtagtaacgttcgtaaggttcgggggttacgggggttccgttaccggggaccgggtaaggggacccgtaagggtccgtacgggtacccgttaccgtaaacgtaccgaccggacccggtaacggccgtcccggtcccccgtcgggtccctacccg

SEQ ID NO: 132336 - DNA, 609 bp, Homo sapiens
  misc_feature: GYAE6OF01C1F3B.10.39.D06.1.454.CMB.1.raw
  modified_base (333)..(333): a, c, t, g, unknown or other
  misc_feature (333)..(333): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggcccaggacagacggccacgctgacctggtgggggatacacaattggaagtaatcgtgtgacacgtggtaccagcagaggccaggccacggccctggtgttgcgtctataatgactaacgaccggtcctcgagggactcccgngacgcgtattctcgtggcctacgaacgttcggacaaccgtaccggcctaccctcactcaactccgaccgagggtcggacgggcccggggatcggacggcccgtactacgtacctggacgtaagggtgtacgggtatttccgaacgttacgttagacttgtaaggttcgggttcgggggtcgttcgggacggggaaccggactacgggcgtacggtacccgtacggttaacgccgtaacgcccgaaggtcctacccggccccgtcggttcctacccg

SEQ ID NO: 132337 - DNA, 654 bp, Homo sapiens
  misc_feature: GYAE6OF01ALDP9.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaagttggaagtaatcgtgtgcacgtggtaccagcagacggccaggccgaggcccctggtcggttgtcgtctatatgactaacgaccggcctcgaggactcccgtgacgcgtattctcgtggctactagttcggacaacgaccggcccaccctcactacactccgaccggtaggggtccggacggggcccggggatcgggacggaccgacgttacgtacgtcgtacgagggttcggtagggtactttcgaacgtacgtagacttcgtagttcggggttcgggggttaccgttcggggaccgggtacgggtaacccgaaggtccgtaccgggtaccccggttaccgttaaacgggtacccgaaccgggtaccccggtaaacgggtcccgttaccccgggccccccgttcgggtcccttaccccgg

SEQ ID NO: 132338 - DNA, 759 bp, Homo sapiens
  misc_feature: GYAE6OF01BTR2C.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcagcccaccctcggtgtcagtcggcccaggacaggacggccacgctgaccgtggtgggggatacacaagttggaagtaatcgtgtgacacgtggtaccagcagacggccaggccaggcccctgtggttgtcgtctataatgaactaacgaccgccctacgacgggactcccgtagacggcgtacttcgtcgtcggtcctaccgtaacgttccgggaccaaaccgtaccggacccctacccgttacacctaccgtacgtacccgaaccggtacggggtaccggaacggggtacccggggtaacgtacgggaaccgggtaccccggtaaccgttaaccggttaaccggttacggttaccgggtaacggggtttacgggttaacgggggtttaacttttaacccggtaaccgtttaaccgttacggtaacttaccggttaaggtttcgggggttacgggggttaccggttcgggggaacgggttaacgggaaccgtaacggtccggttaccggtacccggttaccgtaacggtaccgaacccggacccgtaacgggtcccgtacccggtcccccgtcggtacccgttaccccgg

SEQ ID NO: 132339 - DNA, 770 bp, Homo sapiens
  misc_feature: GYAE6OF01CWHTO.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccacccgtcggtgtcagtcggcccaggacacggacggccacgctgaccgtggtggggatacacgaagttggaagtaatcgtgtgcacgtggtaccagcgaggacggccacggccacgggcccctggtcggttcgtccgtactaataagtcgaacgtaaccggacccggtccctacgagggtactcccgtagacgcgtacttccgtcgtcggtacctaccgtaacggttccgggaaccaaaccgacccgggtacccctaacccctctaaccttaccgaacgttacccgaaccgggtacggggtaccgggaacgggggtacccgggggtaacgtacgggaaccgggtacccgtaaccgttaacccgttacggttacggtacggtacggggtttcggtacggggttactttaccgtaacgttaacgtacggtacttaccgtaaggttcggggttacgggggttccggtttacggggaccggggtaacgggaacccgtaacggacccggttaccgggtaacccgttaccggttaacggtacccgacggtaccccggtaacggtcccgtaccccgggtcccccgttcgggtacccttacccgg

SEQ ID NO: 132340 - DNA, 585 bp, Homo sapiens
  misc_feature: GYAE6OF01DOC7K.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagtagaggccaggccaggcccctgtggttgtcgtctatatgataacgaccggccctcgagggactccctgacgcgattctcgtggcctcctaagttcgggacaaccgaccggcccacccgtcatcactaccaccgacgggtcgacgggccggggatcggacggccgacgtactacgtgtcgagggtggtgggtactttcgactactgatcgtagttgggttgggggttcgttcgggacgggacgggaccgacgtcgtcggtaccgtaccgtaaggtcgacgacccgaacggtcctacccggcccccgttcggtccgtccgttcccg

SEQ ID NO: 132341 - DNA, 547 bp, Homo sapiens
  misc_feature: GYAE6OF01A2GP8.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcgagggactccctgagcgattctctggcctccaacttcggggacaaaccgaccggcccacccgtcatcatccaccgagggtcgagggcccggggatggacggcccgactactacgtgtcgaggtgtgggtactttcactactgatcgatggtcggggtcttcgggcggagggaccaaggccgtggacccgtcgtaagtccacgcccaaggcctcggccccctggtcctaccg

SEQ ID NO: 132342 - DNA, 678 bp, Homo sapiens
  misc_feature: GYAE6OF01ES2XN.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccacccgtcggtgtcaggtcggccccaggacaggaccggccacgctgacctggtggggatacactagttggaagtagtcgtgtgcacgtggtaccagcgagacggccacggccgacggcccctggtcggttcgtcgtactataagtgataaccgccggccctcgaggactccgtggacgcgattctcgtcggtcctacctaacgttccgggacctaaccgaccgggacccacccgtccagtccagtacccgaaccgaggggtacgacggggcccggggtaagtcgggaacggcccgtaacgtaccgtacgtcggtaccgtaagggtcggttacgggtactttacgaacgttacgtaggtacttacgtagttggggttagggggttccttacggggcggggaacgggtaccgaaacggttcgtaccggtaacccgttaccgtaaacggtccgaaaccggacccgtaaacgggtcccgtacccggtcccccgtcgggtccctaccgg

SEQ ID NO: 132343 - DNA, 756 bp, Homo sapiens
  misc_feature: GYAE6OF01DRBFK.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtggggatacacaagttggaagtaagtcgtgtgcactggtaccagcagacggccaggccaggcccctggtggtgtcgtctataatgactaacgccggcctcgaggctcccgtgacgcgtacttctcgtggtcctccgaagttccggggaccaaacgacccgggtaccccaaccccgttacactacctaacgtcccgaacccggtacgggggttaccggaacgggggtaccccgggggaacgttacgggaccgggtacccggtaaccgttaaccgttaaccgttcggttaccggtaaggggttcgggttacggggtacttttaccgaaccgttaacgtacggtacgttacgtaaggttcggggttcgggggttaccgttaccgggggacggggtaaccggggtaacccgtaaacgggttcccggttacgggtaaccccggttacccgttaaacgggttcccggtaaacccggtacccccggtaaacgggtccccgttaccccggaccccccccggttcgggttaccccttaacccccgg

SEQ ID NO: 132344 - DNA, 798 bp, Homo sapiens
  misc_feature: GYAE6OF01CRKW8.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcagcccacccgtcggtgtcagtcggcccaggacaggaccgccacgctgaccgtggtaggggatacgacgaagttaggaaagttaagtcgtagtcgactacgtacggtaccagcaaggacggccgacgggccgacggtccccgttggttcggttacgttccgtacttaataagtacgaacgtaaccggacccggccctacgaacgggtcctcccgtaggacgcgtacttcgtcgttacggtacctaaacggttccgggacctaaccggtaccgaccctaccccgtctaacgtccgaactacccgaaccggtacggggtccggaacggggtcccgggggaagtcggaaccgggtacccgtaacgttaccgttacggtcggttaccggtacggggttcggttacgggttactttaccgtaacgttactacgggtacttacggtacggttcgggggttacgggggttaccgtttccgggggaacgggaaccggggaaccggttaacgggtccggttaaccgggtacccggttaaccggttaacggtaccggaaccccgggtacccggtaaacccgggtcccggtaccccggttacccccggtacccgggttccgtaccccggttttcccccggg

SEQ ID NO: 132345 - DNA, 511 bp, Homo sapiens
  misc_feature: GYAE6OF01DPBLC.10.39.D06.1.454.CMB.1.raw
  modified_base (365)..(365): a, c, t, g, unknown or other
  misc_feature (365)..(365): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagagccaggccaggccctgtggttgtcgtctataatgataacgaccggccctcgaggactccctgagcgattctctggctcaattcggcaacacggccaccctnatcatcacagggtcgaggccgggatgaggccgactactactgtcaggtgtgggtatttcactactgatcgagtgtggggtcttcgggcggaggaccagcgtgaccgtcgtaagtcgagcccgaaggctcgccccctggtcctaccg

SEQ ID NO: 132346 - DNA, 758 bp, Homo sapiens
  misc_feature: GYAE6OF01DJCI5.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtggggatacacaagttggaagtaatcgtgtgcacgtggtaccagcagaggccaggccaggcccctggtggttgtcgtctataatgatacgaccgccctcgaggactcccgtgacgcgacttctcgtcggtcctaccgtaaacgttccggggaccaaaccgacccgggacccctaccccgttacacttaccgaacgttacccgaacccggtaacgggggtcccgggaacgggggaccccggggggtaagttacggggaaccgggaccccggtaaccgttaaccgttaacccggttcggttaccgtaacggggtttcgggttacggggttaacttttccgaaaccgttacgttacggtacgttccgtaaggtttcggggttcggggggttaccgtttccgggggaccggggtaacggggtaaccccgtaaaggcccggtttacgggtaaccccggttacccggttaaacggtcccggaaccggaccccggtaaacgggtccccgttacccgggcccccccgttacgggtccctaaccccgg

SEQ ID NO: 132347 - DNA, 557 bp, Homo sapiens
  misc_feature: GYAE6OF01DU370.10.39.D06.1.454.CMB.1.raw
  modified_base (371)..(371): a, c, t, g, unknown or other
  misc_feature (371)..(371): n is a, c, g, or t
  modified_base (549)..(549): a, c, t, g, unknown or other
  misc_feature (549)..(549): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccgggacagacgccacgctgacctgtggggatacacaattggaagtaatcgtgtgcactggtaccagcagagccaggccaggcccctgtggttgtcgtctataatgataacgaccggccctcgacgggatccctgagcgattctctggcctcaaagttcgggcaacgacggcccaccctnatcatccacgagggtcgagggccggggatggacggccgactacgtacgtgtcgaggtggtgggtactttcgaacgttacgtacgattcgagttgggttcggggttacttcgggacggaggggaccaggcgtcggaccgttcaaggtcacgtccgaacggtcctacgccccgtcggccncgttcccg

SEQ ID NO: 132348 - DNA, 736 bp, Homo sapiens
  misc_feature: GYAE6OF01DF0YC.10.39.D06.1.454.CMB.1.raw
tcagcatagtagtgcacgaccggtgctcgatttagtgacatctcgcagttctttggggctgggcctaaggaagcagcacgtggtggtgcctcagccatggcctggaccgttctcctcctcggcctcctctctcacgtgcacagactctgtgacctcctatgcgctgactcacgccacctcggtgtcacgtcggccccaggacagacggccacgctgaccgtggtggggatacgactaattggaagtaatcgtgtgcacgtggtaccagcaggagccaggccacggccctggtgttgcgtcataatgataacgaccggccctacgaggactcccgtagagcgtatttccgtctaggcctaccgtaaaggttccgggacaaaccgaccgggacccctacccttcaacgtaccacgttacccaacccggtaacggggtaccgggaacggggtaccccggggaagttacggggaaacgggtcccggtaacgttaaccgttaacccggttgttaacccggtaaggggtttcggttacgggggttaacttttaccggaaccgtttaaccgttacgggtaacttacgttacgggttaggggtttcgggggggttccgtttaccgggggaaccgggtaaggggaacccgtaaggcccgttacgggaacccgtttacgtaaacggtaccgaacggacccgaaacggttcccgtacccggtaccccccgtgggttccctaacccgg

SEQ ID NO: 132349 - DNA, 578 bp, Homo sapiens
  misc_feature: GYAE6OF01D9ZBL.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccacggcccctgtggttgtcgtctataatgataacgaccggccctcgagggactcccgtgacgcgtattctcgtcggcttaccaaagttccgggaccaaaccgaccgggcccaacccgtcaactccataccgaccgaggggtcgagggcccggggatcggaggcccgactactacgtgtcgaggtgtgggatttcgactactagatcgagtcggtggggtcgttcgggcggacgggtacaaggtcgtacggaccgttcgtaacgtccgacgacccgtaaggcctaccggcccccgtggtcctaccg

SEQ ID NO: 132350 - DNA, 586 bp, Homo sapiens
  misc_feature: GYAE6OF01ANY38.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgcttacctgtggggatacacaattggaagtaatcgtgtgcactggtaccagcagaggccaggccaggcccctggtggttgtcgtctataatgataacgaccggccctcagggactccctgacgcgattctctggctcaagttcgggcaacgaccgccaccctcatcactccaccgacgggtcgacgggccggggatcggacggccgactactacgtgtacgaggtcgtgggtatttacgacttacgtgactcgtagttgggttggggttccgttcgggcgggagggaccgaaggccgtacggtacccggttaccgtaaaggtccaacggtcccgaaacggtccgtaccggccccccgtcggtccctaccgttcccgg

SEQ ID NO: 132351 - DNA, 578 bp, Homo sapiens
  misc_feature: GYAE6OF01CGKPC.10.39.D06.1.454.CMB.1.raw
  modified_base (326)..(326): a, c, t, g, unknown or other
  misc_feature (326)..(326): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaattggaagtaatcgtgtgcactggtaccagcagaggccaggccaggcccctgtggttgtcgtctatatgataacgaccgcctgaggactcccgngacgcgtacttctcgtggcctaccgaagttcgggacaaccgaccggcccaccctcactcactccaccgacgggtcgacgggccggggatcggacggccgaactactacgtgtacgagggtggtaggtactttcacttactgacttcgagttggtcggggtcgttcgggacgggtacgggaccgaaggtccgtacggacccgtacgtaacggtaccacgacccgaacggcctccggccccctggtcctacccg

SEQ ID NO: 132352 - DNA, 521 bp, Homo sapiens
  misc_feature: GYAE6OF01A7I82.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctatatgataacgaccggcctcagggatccctgagcgattctctggctccaattcgggcaacgacggccaccctcactcatcaccgagggtcgaggcccggggatcggacggccgactacgtacgtgtcaggtgtggatttcactactgatcgagtggtacggggtcttcgggcggagggaccagcgtgaccgtctaagtcacgccaaggcacgcccctggtcctaccg

SEQ ID NO: 132353 - DNA, 675 bp, Homo sapiens
  misc_feature: GYAE6OF01EL6QZ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaattggaagtaatcgtgtgcactggtaccagcagaggccaggccaggcccctgtggttgtcgtctatatgataacgacccggccctgagggtactccctgagcgtaattctcgtggacctccgtaaagttccgggacaaaccgacggccccaacccgtcactccactccacccgaggggtccgacggggcccggggatacgggacggcccgtaacttaccgtaacgtcggtacgtagggttggtcggggtactttacgaaccgttacgtaggtaataccgtaggttcggggttacggggggttaccgtttcgggggaccggggaacggggtaacccgaagggtccgtacgggtaaccccggttaccggtaaacggttccgaaaccgggacccccgtaacgggtacccgttaccccggcccccccgttgggtcccttaaccccgg

SEQ ID NO: 132354 - DNA, 793 bp, Homo sapiens
  misc_feature: GYAE6OF01D7M4Z.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgccaccctcggtgtcagtcggcccaggacaggaccggccacgctcgaccgtgggtgggggactacacgtaagttaggaagtaatcggtgtcgctacgtcggtaaccagcgaggacggaccgacgggaccgacggtccccgttggttcgggttcgttccggttactaagttaacgtacggtaaacgttaacccggaccccggtacccctacggtacggggtaccttccccgtaggaacggtccgtaacgtttccgtaccgttcggtaccttacccgtaacggtttccgggaacctaaaccggaccccgggtacccctaaccccgtactaacgttaccgaaccgttacccggaacccgggtaaccgggggtacccggggaaccggggtacccgggggtaacgttacggggaaccgggtaccccgtaaccgttaaccggttaccgttcggtaccgtaggggttcggttacgggttactttaccgtacgttacgtgacgttcgtaggttgggttacggggtacgttcgggacgggtaacggtaccgaacggtcgtaccggtaccgtaccgtacgacccggacgacccgtaacggcccttcccggtcccccttgggcccttacccgg

SEQ ID NO: 132355 - DNA, 682 bp, Homo sapiens
  misc_feature: GYAE6OF01CWOQH.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgccctacccgtcggtgtcagtcggcccaggacacggaccggccacgctcgaccgtggtaggggatacacaagttaggaagttaatcgtgtgactacgtcggtaaccagacgaaggacggaccgacggccgacggtccccttggttcggttcgtccgttactaatagtagaactaaccggcccgtccctagacgggtacctccgtaggacgtcgtacttctcgtcggacctaccgtacgtccggacaacgaccggacccacctcgactacactaccgaaccggtacggggtaccggacggggtcccgggagtacgggacggaccgtactaccgttacgtcgtacgtagggtggtagggttacttacgtactacgtcgtactcgtaggttgggttcggggttcgttacgggacgggtacggaccgtacgtccgtaccggtaaccgttaccggtaaacgtccgaaccggtacccgtacggtcccgtaccccgtcccggttcggtcccttacccg

SEQ ID NO: 132356 - DNA, 522 bp, Homo sapiens
  misc_feature: GYAE6OF01ALLRN.10.39.D06.1.454.CMB.1.raw
  modified_base (357)..(357): a, c, t, g, unknown or other
  misc_feature (357)..(357): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacncggccaccctcatcatcaccacggggtcgaggcccggggatcggacggccgactactactgtcaggtgtgggtatttcactactgatcatggtggggtcttcggcggagggaccaggcgtggacccgtctagtcagcccgaaggcctacgccccctggtctaccg

SEQ ID NO: 132357 - DNA, 677 bp, Homo sapiens
  misc_feature: GYAE6OF01DO1EZ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccacccgtcggtgtcagtcggccccaggacagacgccacgctgacctggtggggatacacaagttggaagtaatcgtgtgcacgtggtaccagcaggacggccacggccacggccctggtggttcgtcgtactaatatagaataaccggaccgccctcgaacggactcccgtgacgcgtattcgtcgtggtcctaccgtaaggttccgggaacctaaaccgacccggaccctaaccctactaactaccaactcccgaaccggtacggggtaccggacggggaccggggtagtacggacggaccgaacgtaacctacgtcgtacgtagggtagtagggtacttacgaaccttacgtgtactacgtacggttcggggttacggggtcggttacgggacgggtacgggaaccctaaggtccgtacggtaacccggttaccgtaacggtaccgaaccggaccccgtaacgggtccccgtacccggtacccccgttcggtcccgtaacccg

SEQ ID NO: 132358 - DNA, 515 bp, Homo sapiens
  misc_feature: GYAE6OF01CF08M.10.39.D06.1.454.CMB.1.raw
  modified_base (415)..(415): a, c, t, g, unknown or other
  misc_feature (415)..(415): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcaggggtttctaatcgcttctctggctccaagtctggcaacacggcctccctgaccatctctgggctccaggctggaggacgaggctgattattactgcngctcatataacaaccagcagactacttctgtagttcgggcggagggaccgaagctacgcccgtccgtaggctacgacccaaggccctcgccccccgtcgg

SEQ ID NO: 132359 - DNA, 702 bp, Homo sapiens
  misc_feature: GYAE6OF01CMHNJ.10.39.D06.1.454.CMB.1.raw
  modified_base (648)..(648): a, c, t, g, unknown or other
  misc_feature (648)..(648): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccacccgtcggtgtcaggtcggcccgaggacaggaccggccacgctcgaccgtgggtaggggatacacgtaagttaggaagtaagtcgtgtgctacgtggtacagacaggacggacgacggccacggccctggttgttcgtcgtactaatataggaacgtaacgacccggcctacggaggacctcccgtagacgcgtacttctcgtgcctacgtaacgtccggactaaccgccggccctacctacgactacgtaactcccgaacgggtcggggacggaccggggaccgggtagtacgggaaccgggtaccctaacgttaccgtaccggttcggaaccgtggggtttacggtttacgggtaaccttttacgaccgttaactggttaacctacggtagggtttcggggttccggggttaccggttccgggacgggtaccgggtacgaacgggttccgtaccggtaccgtacccggtnaaccggtacccgaccggtacgtcccgccccggtaccccgtggtccctaccccgg

SEQ ID NO: 132360 - DNA, 504 bp, Homo sapiens
  misc_feature: GYAE6OF01CKO2T.10.39.D06.1.454.CMB.1.raw
  modified_base (329)..(329): a, c, t, g, unknown or other
  misc_feature (329)..(329): n is a, c, g, or t
  modified_base (490)..(504): a, c, t, g, unknown or other
  misc_feature (490)..(504): n is a, c, g, or t
tcagcatagtagtgcacgaccggtgctcgatttagtgacatctcgcagttctttgggggagagactgaagaacccagcattgcagcagctccaccatggcctgggctcctctgctcctcaccctcctcagtctcctcacagggttgactcagccaccttctgcatcagcctccctgggagcctcggtcacactcacctgcaccctgaacagcgactacatcttgggctcaggcctcaatcggtgcctgaccaccaacaacatctacgaagagggtgagagtgtccctcactggtgggcagacaagtggcaggtgggagctaagtttcgnggagtagtgttcgggcggagggaccaaccgtcgaccgtccttccgtaggtcacgcccgaagggcctccggccccccgtcggtccactcgttccgtccccgtccctccctcccaccttactactcgctcggacgcgggctcgggccgaaggccgcagtacgnnnnnnnnnnnnnnn

SEQ ID NO: 132361 - DNA, 717 bp, Homo sapiens
  misc_feature: GYAE6OF01CXUDT.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacggccacgctgacctggtggggatacacaagttaggaagtaatcgtgtgctacgtggtaccagcagacggccgaggccacggcccctggtcggttgtcgtctaataagtgaagtaccgaccggccctagacgggactccctaggacgcgtattcgtcgtcgtctaccgaagttccgggaccaaccgtaccggccctacccgtacacttacactaccgaccggtacgggtaccggacggggtacccggggaagtagggaaccgggcccgtaaccgttacgttaaccggttggtaccggaagggtttcggtacgggttactttacgtaaccttacggttaggacgtttacgaggttcggggtttacgggggttcgtaccggggaccgggtaaacgggaacccgtaagggtccggttaccgggtaacccggttaccgttaaacggtcccgtaaacccggcccggtaaacccggacccccgttaacccccggttacggtccccgtacggtttacccccgg

SEQ ID NO: 132362 - DNA, 805 bp, Homo sapiens
  misc_feature: GYAE6OF01EP6ZB.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccacccgtcggtgtcgaggtccggcccgaggacacggaccggccacgcgtcgaccgtgggtaggggactacaactaagttaggaaagtagtcggtgtgacctacgtcggtaccagacgaggacggaccgacggccgaccgggtccccgtgggttcgggttcgttcgttactaagttaagtagtaacgtaacccggacccggtcccgtacggaacgggtacctcccgtaggacgtcgtacttcgtcgtcggtcctaccgtaacggttccgggaccaaaccgacccggaccctaccctacactaccactacccgaaccggtacggggtccggacgggggccgggagtcgggaccggacccgtaacgttaccgttacgtcggtacggtagggttcgggttacgggtttactttaccgaaccgtttaacgtacgtacgttacgttagggttcgggggttccgggggttccggttaccgggggaccggggtaaaccggggtaacccggtaaacgggttcccggttaaccgggttaaccccggtttaaccggtaaaccgggtacccgaacccggtaacccccggtacgggtccccgttacccccgggtccccccggttacgggtccccgttaccccgg

SEQ ID NO: 132363 - DNA, 705 bp, Homo sapiens
  misc_feature: GYAE6OF01CQS39.10.39.D06.1.454.CMB.1.raw
tcagcatagtagtgcacgaccggtgctcgatttagtgacatctcgcagttctttgggggctgggcctaaggaagcagcactggtggtgcctcagccatggcctggaccgttctcctcctcggcctcctctctcactgcacagactctgtgacctcctatgcgctgactcagccacccgtcggtgtcagtcggcccaggacagacgccacgctgactggtggggatacactaagtaggaagtaatcgtgtgacacgtggtaaccagcaggacggcaggccacggccctggtgttgtcgtactaataagtgaactaaccggaccggtccgtacgacgggactcccgtagacgcgtacttcgtcgtcggctaaccgtaagtccgggacaaccgtaccggccctacccgtacactacaactaccgaccggaggggtcggacggggaccggggtacgtacgggaaccgggtacccgtaacttaaccgtacgtaggtaccgtaggggttacggtagggttaacttttccgaaacgttacgttagtaacgttcgttaaggttcgggggtacggggtttccggtcggggaaccgggtaacgggaacccgtaagggtacccggtaacggttacccggtaaccgttaaacgggtacccgaccggtaaccccggaacggttaccctcccggacccccgttcgggtccttaaccccg

SEQ ID NO: 132364 - DNA, 759 bp, Homo sapiens
  misc_feature: GYAE6OF01CM6NN.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacacgacggccacgctcgaccgtggtggggactacgacaagttggaagtaactcgtgtgcacgtggtaccgagcaaggacggccgacggccgacggccccgttgggtgttcgtccgtactaataacgtgaactaacggacccggtcctacggagggtactcccgtgacgcgtaacttccgtacgtcggtacctacccgtaacgttacccggggacaaaccgacccgggacccctaccctaccgtactccaacgttacccgaaccggttacggggggtaccggacggggtacccggggtaatacggggtaaccggggacccgtaaccttaaccgttaccgtacgggtacccgttaaggggtttacgggtagggggttaacctttccggtaaaccttacggtagtaaccgtccgtaacggtttcgggggttacgggggtcccgtttacggggaccgggtaacgggaacccgtaacggtccggtaccggtaaccccggtacgtaacgtccgaaccggacccggtaacggtcccgtacccggtcccccgtcgggtacctaccccgg

SEQ ID NO: 132365 - DNA, 551 bp, Homo sapiens
  misc_feature: GYAE6OF01ATXNW.10.39.D06.1.454.CMB.1.raw
  modified_base (336)..(336): a, c, t, g, unknown or other
  misc_feature (336)..(336): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccgccctcagggatccctgagcgatctcnggctccaattcgggcaacacggccaccctcatcatcaccaggtcgaggccggggatgacgggccgacgtactactgtcaggtgtggatttcgaacgtactgatcgatggttcgggggtcttcgggcgggagggaccaaacggcgtacggacccgtaccgtaaaggttccgaacgtccccgaacgggccctcgccccccgttcggtccgtaccccg

SEQ ID NO: 132366 - DNA, 647 bp, Homo sapiens
  misc_feature: GYAE6OF01DG9HL.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacggccacgctgacctgtgggggatacacaattggaagtaatcgtagtgcactggtaccagcagaggccaggccacggccctggtggttgtcgtctataatgataacgaccggcctacgagggactcccgtgacgcgtattctctggcctacaagttcgggacacgaccggccaccctcactcactccacgaggggtcgacggggcccgggatacggacggcccgaactacgtaacgtggtcgtagggttcggtggggtactttcgaacttacgtaggtacttcgtaagttcggggttcggggggttccttacgggggaccgggtaacggggaacccgtaacgggtccgtaccgggtaacccggttaccgttaaacggtccgaaccggtaccccgtaaacgggtccccgttacccggtcccccccgttcgggttacccttaccccgg

SEQ ID NO: 132367 - DNA, 815 bp, Homo sapiens
  misc_feature: GYAE6OF01DC9AH.10.39.D06.1.454.CMB.1.raw
tcagcatagtagtgcacgaccggtgctcgatttagtgacatctcgcagttccttggggctgggcctaaggaagcagcactggtggtgcctcagccatggcctggaccgttctcctcctcggcctcctctctcactgcacagactctgtcgacctcctatgcgctgactcacgccaccctcggtgtcaggtcggcccaggacagacggccacgctgaccgtggtgggggatacacgtaattaggaagtaagtcggtgtgctacgtggtaccagacaggacggccgacggccgacgggccctggtggttcgtcgtctaataagtagaactaaccggacccggcctacgacgggactcccgtgacgcgtacttctcgtcggtctaccgtaacgttcgggactaaaccgaccggacccaccctactactacaactccgaaccggtacgggggtaccggaacgggggtccggggtaacgtacggggaacgggtacccggttaaacgttaacgttttacggtttacggtaccggttaaggggtttacgggttttagggttttaacgttttacggtaacgggttttaaacggtttacgttttacccggtaacggggggtttttaccccgggggggggtttttaccggggaaccggggtaacgggggaacccgtaaacgggttcccggtaaccgggtaacccgggttaccgggttaacgggttacccggaacccggtaccccgggtaaacgggtcccggtttccccggtaccccccggttcgggttaaccccaccggtttccccgtcccggttacccccccgg

SEQ ID NO: 132368 - DNA, 794 bp, Homo sapiens
  misc_feature: GYAE6OF01BI8UC.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacggcacgctgacctgtggggatacacaattggaagtaatcgtgtgcacgtcggtaaccagcaggaggaccgaggccgacggccccgtggttcgggttcgtcgtctaataagtgaactaaacggaccggccctacgacgggaccttcccgtaggacgacgtactttcgtcgtcggtacctaccgtaaagtttccggggacctaaacccgaccggggtacccctaaccccgttaccaaccgttaccgaaccgttacccgtaaaacccgggtaacgggggttacccgggaaacgggggtccccggggggtaaacgttaccggggaaaccgggggtaacccgaaccggttaaacccgttaaccggttacggttaccggtaacgggtttacgggttaggggttaaccgttttaccgtaaacgttaaccgttacggtaaacgttccgtaaaggttcggggtttcggggggttaccgttacggggacggggtaacggggtaaccgaacggtccggtaccgggtacccgttacccggttaaaggcccgtaaccggacccggtaacggtcccgtaccggtcccccctgggtacccctaaccgg

SEQ ID NO: 132369 - DNA, 718 bp, Homo sapiens
  misc_feature: GYAE6OF01DTT26.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaattggaagtaatcgtgtgcacgtcggtaccagacagacggccaggccacggccctgtggtgtcgtctataatgataaccgaccggccctacgacgggactcccgtagacgcgtacttctcgtggcctaccgtaaagttccggggaccaacgaccggacccaacccgtcactccaactcccgaaccgtacggggtcgacggggcccggggtatacgggacggtcccgtaactaccgtacgtggtaccgtagggttggttacgggtacttttaccgaaccgttacgtacggaacttcggtaaggttcgggggttccggggggttaccgtttacgggggaaccgggggtaacgggtaacccgtaaacgggtccggttaaccgggaaccccggtttaccggtaaacgggtacccgtaaccgggtacccccgtaaaggggttccccttaccccgggtacccccccggtttcgggtaccccgttaaccccgg

SEQ ID NO: 132370 - DNA, 634 bp, Homo sapiens
  misc_feature: GYAE6OF01DNPRU.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcactgactctgtgacctcctatgcgctgactcacgcccacccgtcggtgtcagtcggcccaggacacgacggccacgctcgaccgtggtaggggatacacaagtggaagtaatcggtgtgcacgtcggtacagcgagacggccaggccacggcccctggtggttcgtcgtactaatagtagactaaccggcccgccacgacgggactcccgtgacgcgtattctgtcgctcgaagttccgggacaacgaccggacctacccgtacacgtacacgtccaaccggcgggtccggaggggcccgggtagtcggaaccggcctaacgttaccgtacggtcgtacggtacggttaggtacgggttactttacgtacgtaacgtgtaactcgtaggttggggttacggggtccggtcgggaccggtaagggaccaagtccgtacggtacccgtacggtacgtccgacggaccctagggccctaccgccccgttcgtcgtacccg

SEQ ID NO: 132371 - DNA, 682 bp, Homo sapiens
  misc_feature: GYAE6OF01BXRNU.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgaccgtggtggggatacacaattggaagtaatcgtgtgcacgtggtaccagcagacggccaggccacggcccgtgtggttgtcgtctatatgaactacgaccgtcctcgaggactccgtagacgcgtacttcgtcgtcggctaccgtaagttccgggacaaccgaccggaccctacccgtcacgtacctaacgtccgaaccggtacggggtaccggacggggccggggacgtacgggacggacccgtaacgtacgtacgtcgtacggaggttcggtacgggttactttaccgacttacgtacgtacgttacgtacggttgggttaccgggggttcgttaccggggacggggtaacgggtaaccgtaacgggtcgtaccgggtaacccggttaccggttaaacggtacccgaaccggtaccccggtaacggcccgttaaccccggccccccgttcgggtcccttaccccgg

SEQ ID NO: 132372 - DNA, 575 bp, Homo sapiens
  misc_feature: GYAE6OF01AYRKN.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccaggcccctgtggttgtcgtctataatgataaccgaccggccctcgagggatcccgtgacgcgattctctggctccgaagttcgggacaacgacggcccaccctcactcactcaccgaggggtccgagggcccggggatcgggacggcccgactacgtacgtgtcgaggtggtgggtactttcaacttactggtatcagttgggtgggggttcttcgggcggacgggaccgtaagcgtacggacccgttcgtaacggtccaccggacccgtaaggcctaccggcccccgttcggtcctaccg

SEQ ID NO: 132373 - DNA, 725 bp, Homo sapiens
  misc_feature: GYAE6OF01C4KMD.10.39.D06.1.454.CMB.1.raw
  modified_base (232)..(232): a, c, t, g, unknown or other
  misc_feature (232)..(232): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgacctcacgcccacccgtggtgtcacggtccggcccaggacacggaccggccacgctcgaccgtgggnggggatacactaagttaggaagtaagtcggtgtgacgtacgtacggtaccagcgaaggacggaccgacgggcccgacggtccccgttgggtacggtaaccgtttagtacgtaagtaacggactacggtggaacggaccggtaccccgagggtactcccgtaggacgaccgttacttcgtcgtcggtaccctccgacggtcctacggaacgggaaccaacggtacgtacggtacggttaccgaccgtacgtccgacgggaccggaccggggaccccggagaacgggaacgggacggacggtcgtacgtaacgttaacgttacgttaggtacctaaacgtccaaacgtaacgtacgttaacgtttaccgttacggtttaacgtttagggtttcgggtacggttccgggtacgggtaccggtacgacggtcgtaccggtaccggtccggtacggtaccgacgcccgtaacgtcccgtaccgtccccgtcggtaccc

SEQ ID NO: 132374 - DNA, 619 bp, Homo sapiens
  misc_feature: GYAE6OF01DTT3K.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacaggacggccacgctgacctggtgggggatacacaagttggaagtaatcgtgtgcacgtggtaccagcaggaggccaggccacggccctggtcggttgtcgtctataatgaactaacggaccgccctacgaggactccctgagcgtattctcgtcggctaccgaagttccgggacaaccgaccggcccacccgtcactcaactccaaccggtacggggtccgaacggggcccggggtatacggacgggcccgtaactactaccgtgtacgtagggtggtagggtactttcgaacttacgtagacgtcgtaggttcgggtcgggggttcttcggggacggtacgggaccgaggtcgtacggtaccgttacgtaacggtccacggacccgtaaggtccctaccgtcccccgtggtcctacccg

SEQ ID NO: 132375 - DNA, 583 bp, Homo sapiens
  misc_feature: GYAE6OF01AYNP1.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtggggatacacaattggaagtaatcgtgtgcacgtggtaccagcagcggccaggccaggccctgtggttgtcgtctatatgatacgaccgcctcgaggatcctgagcgattctctggctcatcggacaacgcgcccacctcatcactcgaccgagggtccgacgggccgggatcggacggaccgactaacgtacgtgtacgtagggtgtagggtactttacaacgttacgtacgattcgagttcgggttcggggtccgttacgggcgggacgggtaacccgaaggccgtacggtacccggttaccgtaagtacccgacggacccgtaacgggtccgtacccggccccccgttcggtccgtacccg

SEQ ID NO: 132376 - DNA, 630 bp, Homo sapiens
  misc_feature: GYAE6OF01BRP2X.10.39.D06.1.454.CMB.1.raw
  modified_base (332)..(332): a, c, t, g, unknown or other
  misc_feature (332)..(332): n is a, c, g, or t
  modified_base (362)..(362): a, c, t, g, unknown or other
  misc_feature (362)..(362): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacggccacgctgacctggtgggggatacacaattggaagtaatcgtgtgcactggtaccagcagaggccaggccaggcccctggtcggttgtcgtctataatgataacgaccggccctcgagggatcccgtgngcgattctctggctccaagttcgggcaacnccggccaccctacatcatcaccgagggtcgagggcccggggatcggacggcccgactactacgtcgtcgacgggtggttcggggtatttcaccttaccgtgattcgtaaggttgggttggggggttaccgttcgggggaccggtacgggggaaacccgtaaagggtccgttacgggaaccccggttaccgttaacgggtacccgaaaccgggcccccgtaaacggggtccctacccgggtcccccccgttcgggtcccgtaaccccgg

SEQ ID NO: 132377 - DNA, 642 bp, Homo sapiens
  misc_feature: GYAE6OF01ESXST.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtggggatacacaattggaagtatcgtgtgcactggtaccagcagaggccaggccaggccccgtgtgggttgtcgtctataatgataacgacccgcctcagggactcccgtgagcgtattctcgtggcctccaaacgttcgggacaacgaccggcccaccctcactcactccaccgaggggtcgacggggccgggaatgggacggaccgactaacgtacgtcgtacgagggtggtagggtatttcaacgtacgttgacttacgagttcggggttcggggttacgttacggggcgggtaacggggaccgtaaacgggccggttaccggtaacccgggttaacccgttaacgggtacccgaaccggtaccccgggtaaaacgggccgttacccccggccccccgttccgggtccgttaacccccgg

SEQ ID NO: 132378 - DNA, 615 bp, Homo sapiens
  misc_feature: GYAE6OF01CUV7U.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaagttaggaagtaatcgtgtgcactggtaccagcagaggccaggccacggcccctggtggttgtcgtctataatgataacgacccggccctcgagggactcccgtgacgcgtacttctcgtcggctaccgtaacgttcgggacaacgaccggcccaccctcactcactaccaccgagggtcggacgggccgggatcggacggcccgactacgtacgtcgtcgtaggtcgtaggtactttcactacgtgtactcgtagttcgggttacggggttcgttcgggcgggtacgggaccgtaggtccgtacggtacccgttaccgtaacggttccgaaccggtaccccgaacgggtacccttccggccccccgtcgggtccctacccgg

SEQ ID NO: 132379 - DNA, 579 bp, Homo sapiens
  misc_feature: GYAE6OF01CVAMM.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtggggatacactaatggaagtatcgtgtgcacgtggtaccagcaaggaggccgaggcccgaggcccctggtggttcgtcgtctaataagtgaataaccggaccggccctcgacgggactcccgtgagcgattctctcgtctactaagtccggacaaccgacgcccaccctcactcactcaccgacgggtcgacggcgggatggacggccgactactacgtgtctaggtggtagtactttcgaacgttactagtactccgagttcgggtaggggtccgttcgggacgggacggaccgagcgtacgtaccgttaccgtaagctacggacccgtaggcctcccgaccccgtggtccgtacccg

SEQ ID NO: 132380 - DNA, 624 bp, Homo sapiens
  misc_feature: GYAE6OF01DKE5I.10.39.D06.1.454.CMB.1.raw
  modified_base (494)..(494): a, c, t, g, unknown or other
  misc_feature (494)..(494): n is a, c, g, or t
  modified_base (594)..(594): a, c, t, g, unknown or other
  misc_feature (594)..(594): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacggccacgctgacctggtggggatacacaattggaagtaatcgtgtgcactggtaccagcagaggccaggccacggccctgtggttgtcgtactataatgaactacggaccgtcctacgacgggactccctgagcgtattctctcggctaccgaagttcgggaccaacgaccggcctacccgtcacgtcacgtccaccgacggggtcgacggggcccgggtatacgggacggccgactaacgttacgtcgtcgtagggtggtacgggtactttcgaacgttactagtactacgnggttagggtcggggttcgttacgggacgggtagggaacccgtaaggccgtacggtacccgttaccggttaagacccggaacgtaccccggaaaggtcccnccccggtcccccgtgggttaccctaccccg

SEQ ID NO: 132381 - DNA, 529 bp, Homo sapiens
  misc_feature: GYAE6OF01E2OT4.10.39.D06.1.454.CMB.1.raw
  modified_base (337)..(337): a, c, t, g, unknown or other
  misc_feature (337)..(337): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatcccgtgagcgattcnctggctccaattcggcaacacggccaccctcatcatccaccgagggtcgacgggccggggatggacggccgactactacgtgtcaggtgtgggtatttcgactactgactcagtggtgggggtcttcgggcgggacgggaccaagcgtcggaccgtcctaagcacgcccaaggctcggccccctggcctccg

SEQ ID NO: 132382 - DNA, 800 bp, Homo sapiens
  misc_feature: GYAE6OF01C39CE.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgaccctcctatgcgctgactcacgcccaccctcggtgtcagtcggccccaggacacggaccggccacgctcgaccgtggtgggggataccactaagttagggaagttaagtcggtgtgactacgtacggtaccagcgaggacggaccgacggccacggtccccgttgggttacggttcgttccgtcttaagtaagtagtaacgtaaccggacccggcccgtacgacgggtacctcccgtggacgcgtacgttctcgtcggtcctaccgtacggttaccgggacctaaccgaccggtcccctacccgtctactcctaaccgtacccgaacccgggtaacgggtaccgggacgggggtaccggggtacgtacgggaccgggtaccccgtaacgttaaccgttaccgttaccggtaccggtaggggtttcggttacgggtacttttacccgtaacgttaccggttaggtaacgttaccgtagggttcggggtttcggggttaccggtcggggtaaccggggtaacgggacccgtaacgggtcccggttaccgggtaaccccgggttaacccgttaaacgggacccgtaacccgggtaccccgtaaccgggttccccgtccccggtaccccccgggtcgtttccccgttaccccgg

SEQ ID NO: 132383 - DNA, 738 bp, Homo sapiens
  misc_feature: GYAE6OF01A3GGZ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcgcccaggacagacggccacgctgacctggtgggggatacacaagttaggaagtaagtcgtgtgcacgtggtaccagacagacggccgacggccgacgggtcccctggtcggtttcgttccggtacttaagtaagtagaacgttaaaccggacccggtccctacggacgggtaacttccccgtaggaacggtccggtactttccgtcggttcgggtaccttacccgtaaacggtttccggggaaccaaaccggtacccggaccctaccccgtacaaccgttcctactacccgaaccgggtacggggtaccgggaacgggggtccggggaaggtacggacgggtaacccgtaccttaaccgtcgttacggtacgtaaggggttcgggtacggttactttaccgacttacgtgagttccgtagggttcgggttacggggtcgttaccggggacgggtacgggaacctaacgggtacgtcggtaacccggtacgttaaccgtccgaccgacccgtaacggtccgtacccggtcccccgtcggtccttaccccgg

SEQ ID NO: 132384 - DNA, 868 bp, Homo sapiens
  misc_feature: GYAE6OF01CCQHW.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctagtgcgctgactcacgcccacccgtcggtgtcgaggtccggaccccgaggacacggaccgccacggcctacggaccgtggggtagggggaactaaccgtaacgtaaaggttaggggtaaaagttaaacgttccggttaggtacggaccgtaacggttacgggtaaccacggacgaacggaccggaccggacgggacccgacgggtcccccgttgggttcgggtttacgttaccggttacttaaattaacggtacgtaaaccgtaaaccgggaccccggtaccccgttacggaacggggtaccttacccggtaggaaccggtacgtactttccgtccgtacggtacctaacccggttaacggttaccgggaaccaaacccggtacccgggaccccctaccctacaccgttaccaccgttaccgaacccggtacggggtacgggaccgggggacccggggaaggtaccgggaaccgggtaccctaaccgttaaccgttaacggttacggtaccggtaggggttcggttacgggttaaccttacgttaaccgtagtacggtaacttacgtagggttcggggtttacggggtaccggtacggggacggggtaacgggaaccggtaaggtccgtaccggtaacccgttaccggtaacgtacccgaccggacccgacgggtacccacccggttcccccgtcggtcccgttaccccgg

SEQ ID NO: 132385 - DNA, 563 bp, Homo sapiens
  misc_feature: GYAE6OF01C3KR5.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtggccccaggacagacggccacgctgacctggtgggggatacacaattggaagtaatcgtgtgcacgtggtaccagcagaggccaggccacggccctgtggttgtcgtctataatgataacgaccgccctcagggactcctgacgcgattctctggctaccgaattcggcaacgacggccacctcatcactcaccgagggtcgagggccgggatggacgccgactacgtactgtcaggtgtgggtactttcgactactgtactcagttgggtggggttcgttcggggcgggtaacgggaccgaaggccgtacggaccggtaccgttaaggtccgacgcccgtaaacggcctaccggccccccgtcggtccctaccg

SEQ ID NO: 132386 - DNA, 774 bp, Homo sapiens
  misc_feature: GYAE6OF01CSJS2.10.39.D06.1.454.CMB.1.raw
  modified_base (460)..(460): a, c, t, g, unknown or other
  misc_feature (460)..(460): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgccctacccgtcggtgtcgacggtcggcccaggacacggaccggccacgtctcgtacgtggtaggggactacaactaagtaggaagtaagtcgtgtagctagtacggtaaccagccgaaggacggccaacgggccgaacgggtccccgttgggtcggttcggttcgtactaatacgtacgaacgtaacccggaccgtccctagacgggtactcccgtagcgtacgtattccgtcgcgtactacgtaggtccggaactaaccgccggtacccaccttcgactaccgaacncgaccggtacgggacggacggggacccggtagacgggaaccgaccgtaaccgtacgtacggtacggtacgtaggggttacggtacgggttaacttacgtaaaccgtagttacgtacgtacggttaggttacggggttacggggttccgttacgggggaaccggttaaccggggaacccgttaacggtaccgggtaccgggttaaaccccggttacccggttaaacggtacccgggtaaacccgtaaccccgggtaaccggggtcccttaacccccgggtacccccccgggttggtaaccccgttttacccccgg

SEQ ID NO: 132387 - DNA, 728 bp, Homo sapiens
  misc_feature: GYAE6OF01BRROL.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggcccaggacagacggccacgctgaccgtggtgggggatacacaagttggaagtaatcgtagtgcacgtcggtaccagacaggacggccgaggccacggcccctggtggttgtcgtctaatatgaataaccgaccggcctcgaggactcccgtagacgcgtattcgtactcggtcctaccgtaacgtttccggggaaccaacgacccggtaccccaaccctacgactaccaactaccgaaccgaacgggggtaccggaacggggtcccggggaacgtacgggaacgggcccggtaacctaaccgttaaccggttacggtaccggtacggggttacggtacggggttaacgtttccgtaaccgttaacggtacgtacgttacgtacggttacgggttcgggggttaccggttccgggacggggtaacggggtaacccgaagggttaccgtaccggtaacccggttaccggttaacggtaccggaaccgaccccgaacggggtcccgtacccggtccccccggtcggtacccgttaccccg

SEQ ID NO: 132388 - DNA, 647 bp, Homo sapiens
  misc_feature: GYAE6OF01BUYM9.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccacccgtcggtgtcagtcggcccaggacagacgccacgctgaccgtggtggggactacaactaagttggaagtatgtgtgcacgtggtaccagcagacggaccgacggccgacggccccgtggtggttgtccgtctagtaagtagactaaccggacccggccctacggagggactcccgtggacgcgtacttctacgtcggtcctaccgtaacgttccgggaccaaacccgcccggacccgtacccctacgtactaccaactcccgaccggtacggggtaccggacgggggacccgggtagtcgggacggacccgtacgtaccgttacgtcgtacgtagggttggtaggtacttacgactacgtgacgtgtagttcgggtcggggtcgttcgggacgggacggtaccgaaggtcgtcggtaccgtacgtacgaccgacggacccgacggtccgacccgtcccgtccgtccgtccc

SEQ ID NO: 132389 - DNA, 573 bp, Homo sapiens
  misc_feature: GYAE6OF01B6JFD.10.39.D06.1.454.CMB.1.raw
  modified_base (444)..(444): a, c, t, g, unknown or other
  misc_feature (444)..(444): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcaggtcggccccaggaccaggacggccacgctgacctggtgggggatacacaagttaggaagtaatcgtgtgcacgtggtaccagcagaggccaggccacggccctggtggtgtcgtctataatgataacgaccggccctcgacgggactcccgtgacgtcgtattcgtcgtcggctaccgtaagttccgggacaaccgaccggcccaccctcactcactccacgacgggtcgagggcccgggatcggacggccactacncgtgcgaggtgtggtattcgactactgatcagttggtggggtctcgggcgggacggaccaaggcgtcggacccgtacgtaacgtcgacgcccgaacggtcccaccggtcccccgtggtcccttacccgg

SEQ ID NO: 132390 - DNA, 644 bp, Homo sapiens
  misc_feature: GYAE6OF01ASKEB.10.39.D06.1.454.CMB.1.raw
  modified_base (376)..(376): a, c, t, g, unknown or other
  misc_feature (376)..(376): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacagacggccacgctgacctggtgggggatacactaattggaagtaatcgtgtgcacgtggtaccagcagaggccgaggccacggccctgtggttgtcgtctatatgatacgaccgcctcgaggactcctgagcgtattctcgtgtctacagttcggactaacgacggaccctacctnactcactccaccgtagggtcgacggggcccgggatcggacgggacccgtacgtaccgtagttccggtacgacggggttacggtacgggttacgttttacgaacgttaccgttaggacttacgtagttgggttcgggggttctaccggggccgggtaaggggtacccgtaaggttcccgtacggtacccgttaccggttaacgtccgtaacggtaaccccggaacgggtccccgtacccgggtaccccccttgggtcccgtaaccccgg

SEQ ID NO: 132391 - DNA, 834 bp, Homo sapiens
  misc_feature: GYAE6OF01EDMT2.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgccaccctcggtgtcaggtcggcccaggacacgaccggccacgctcgacctggtaggggatacacaagttaggaagtaagtcgtgtgcacgtcggtaaccagacgagacggaccgacggccgacggtccccgtggttcggttcgtcgttactaagtaagtgtaacgtaaccggacccggtccctacggaggtacctccgtaggacggcgtattccgtcgtcggtctaccgtaacggttccggaactaaaccgtaccgggtacccctaaccccgttacgtaacctaccgtaacgtcccgaaacccgggttacggggttaccgggaacgggggtcccgggggaacgttaccggggaacggggtaaccgttaacgttttaaccgtttaacggtaccgggtaccgtaaccggttaacggttaccgggtaacccgtaacccgtaaaccggttacggtaaccgggtttcgggggtttacccggggttaccgggttttaccggggaaccggggtaacggggttaaccgtttaacggggttaccggtacccggttacccggttaaccggtaccggtaacccggtacccggtaaccggtacccggttccccgtacccccgttacgggttaccctacccggtttccgttaccccggttacccccgttaccccg

SEQ ID NO: 132392 - DNA, 607 bp, Homo sapiens
  misc_feature: GYAE6OF01BJBG0.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactcggtaccagcagaggccaggccaggcccctgtggtgtcgtctataatgataacgaccggcctcagggatccctgacgcgtattctctggttccaattcgggacaacaccggccaccctcatcactcgaccagggtcgacgggccggggatacggacggccgactaccgtacgtgtccgtagggtcgtggggtactttaccgacgttacctgaactcgtaaggttgggttggggggttcctttcggggaccgggtaggggacccgaaacggtccgtacggtaccccggtcggttacgggtccgaacggtcccgaacggtcccgtacggccccccgttcggtcctaccgtttccccg

SEQ ID NO: 132393 - DNA, 665 bp, Homo sapiens
  misc_feature: GYAE6OF01CGEVT.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggccccaggacagacggccacgctcgaccgtggtgggggatacacaattggaagtaatcgtgtgcacgtggtaccagcagacggccaggccgacggcccctggtcggttcgtcgtactataagtgaacgtaaccgaccggccctcgacggtactccgtggacgtcgtacttcgtacgttcggttacctaagttccggacaaccgaccggaccctaccccgtcacgtaccacgttacccgaccggtacggggtaccggacggggtcccgggggtaatacgggacgggtacccgtaaccgttaccgtacggttcggtaccgtagggtcggttagggtactttacgacttacgtagtactcgtagttgggtcgggttcgtacgggacgggtacgggacgtaacgccgttacggtacccgttactaacggtccgaccgcccgtacgtccgtccccggcccgttccggtccgtcttcccgg

SEQ ID NO: 132394 - DNA, 621 bp, Homo sapiens
  misc_feature: GYAE6OF01CU9E8.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggcccaggacagacggccacgctgaccgtggtgggggatacacaagttggaaagttaatcgtgtcgcacgtcggtaccagcaggacggccgacggccacggccctggtgttgtcgtctaataacgtgaactaaccggccgccctgagggactccctagacgacgtattctacgtcggtcctacctaaggttccgggaacaaaccgacccggacccaacccttcacgtcaactccgaaccggacggggtaccggaacggggcccggggatacgggaccggaccgtaactaacgttacgtcgggtacgagggttcggtgggtactttacgaataccgtggaactcgagttgggtcgggtctcgggagtacgggacaggcgtcggtaccgtactacgtccaccgtaccgacggtctcccgccccgtggctacccg

SEQ ID NO: 132395 - DNA, 561 bp, Homo sapiens
  misc_feature: GYAE6OF01DHYNC.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccccaggacagacggccacgctgacctgtgggggatacacaattggaataatcgtgtgcactggtacccagcagaggccaggccaggcccctgtggttgtcgtctataatgatacgaccggccctgagggactccctgagcgtattctctggctccaattcgggacaacacggcccacctcatccatccaccgacgggtcgagggcccggggatgggaggcccgactacgtactcgtcgaggtggtgggtatttcacttacgtgatcagttggtgggggtctcgggcgggagggacccgaaggcgtcggaacccgttccgtaaacgtccgtaagccccgtaaggcctacggccccccgtcggtccctaccg

SEQ ID NO: 132396 - DNA, 643 bp, Homo sapiens
  misc_feature: GYAE6OF01BF51P.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggccccaggacaggacggccacgctgacctggtggggatacacaagttaggaagtaagtcgtgtgcacgtggtaccagcagacggccaggccacggcccgtggtcggttcgtcgtctatatgaactacgaccgcctcgacgggactccgtagacgtcgtattcgtcgtacggctaccgtaagttccggactaaccgaccggccctacccgtcactacactaccgaaccggtacggggtaccggacggggtccggggatacgggaccggaccgtactaccgtacgtcggtacgtacgggtggtagggtactttaccgacgtacgtgtactcgtaggttcgggtacgggtcgttaccgggacggacgggtaccgaaggtccgtacgtacccgtacgtacgtccggaaccgtacccggtaacggtcccgttaccgcccccgttcggtccctacccgg

SEQ ID NO: 132397 - DNA, 871 bp, Homo sapiens
  misc_feature: GYAE6OF01A5UVM.10.39.D06.1.454.CMB.1.raw
  modified_base (345)..(345): a, c, t, g, unknown or other
  misc_feature (345)..(345): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccacccgtcggtgtcagtcggccccaggacagacggccacgctgaccgtggtaggggatacgacaagttaggaagtaatcgtgtgcacgtggtaccagcagacggccaggccgacggccccgtggtcggttgtcgtctataatgataaccgccgccctcgagggactcccgngacgcgtacttctcgtcggctaccgaagtttccgggacaaaccgaccggccccaacccgtacacttccaacttccgaccgtacgggggtaccggacggggacccggggtactacggggaaccggtacccgaaccgttaaccgttaccgtacggtacggtaacggggtttcgggttaacggggttaacttttaccggaaacgttttaaccggtacggtaaacgtttaccggtaacgggttttcggggggtttaccgggggggttttaccggtttacccgggggggtaaccgggggtaaaccggggggtaaacccccggttaaaacgggggttacccccgggtttaaaccgggttaaaccccccggggttttaaaccccgggtttaaaaacccggggttacccggtaaaacccccgggggtaacccccccgggttaaaaaccggggggttccccccggtttaccccccggggttaacccccccccgggttttaacccgggggttaacccccctttaaaccccccgggg

SEQ ID NO: 132398 - DNA, 620 bp, Homo sapiens
  misc_feature: GYAE6OF01DMP5Z.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtggggatacacaattggaagtatcgtgtgcactggtaccagcagaggccaggccacggccctgtggttgtcgtctataatgatacgaccggccctcgaggactccctgagcgtattctctggctacaagttcggacacgacggccaccctcatcatccaccgagggtcgacgggcccgggatcggaggcccgactacgtacgtgtacgagggtggtagggtactttcgaacgttactaggtactcgtaggttgggttacggggggttcctttccggggaccggggtaagggacccgtaaggtcccgttacgggaacccggttcccgtaaaaggtcccgtaacggaacccccgtaaacggggtcccttacccggtaccccccggttcggtcccgttaaccccgg

SEQ ID NO: 132399 - DNA, 757 bp, Homo sapiens
  misc_feature: GYAE6OF01CV54J.10.39.D06.1.454.CMB.1.raw
tcagcatagtagtgcacgaccggtgctcgatttagtgacatctcgcagttctttggggctggggcctaaggaagcagcactggtggtgcctcagccatggcctggaccgttctcctcctcggcctcctctctcactgcacagactctgtcgacctcctatgcgctgactcacgccctacccgtcggtgtcaggtcggcccgaggacagacggccacgctcgaccgtgggtggggaactacgaactaagtaggaagttaagtcggtgtcgactacgtacggtaaccgagcgaaggacggaccgacggccgacggcccctgggtcggtttcggtcgtacttaataagtacgtaacgttaaccggacccgtccgtaacggacgggtaacctcccgtaggtacgtacgtacgtttcgtcgtacggtcctaaccgtaacggttccgggaacaaccgtaccggcccctaaccgtacacgtaccacgtaccgaaccggtacggggtccgtacggggacggggtacgtcgggaaccgggtccgtaacgtaaccgtccgtaggtcggtagggttggtacggttaacgtttcgaaccgtttacgtacgttacgtacggttaacggttcggggttacggggttcccggttagggggaccgggttaacgggaaccgtacggtccggtaccggttacccggtacgtaaacggtcccgaaacggtcccggtaaacggttcccgtacccgccccggttgtaccgttaccccg

SEQ ID NO: 132400 - DNA, 793 bp, Homo sapiens
  misc_feature: GYAE6OF01AJI61.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccaccctcggtgtcagtcggcccaggacaggaccggccacgctcgacctggtaggggatacactaagttggaagtagtcgtgtgcacgtggtaccagcagacggccaggccgacggcccctagtaccgtggtccctctagtgagtcgagtacgtcgacccggtcctacgacggactccgtagacgcgtacttcctcgtcggtacctacccgtaacgtccggtacgggaaccgtaccggacccctacccgtacgaaccctacgtacccgaacccggtaggggtaccggtaaacgggccgggggtaacgttccgggaacgggtacccgttaaacgtttacggtttaacggtttacggtacccgggtagggtttacggtttaccggttttaaacgtttcgtaaacgggtttaacggtttacggtttacccgtttaaaccgggggttttcccgggggggtttaccgggtaccgggggttaccgggtaaaccggtaacggtccggtacgggttaaccccgggttccgtaagggtcccgtaaacccggtacccgggtaacggtcccggttacccccgttcccccgggtaccgggtttaccctacccggttcccgtttaacccccggg

SEQ ID NO: 132401 - DNA, 630 bp, Homo sapiens
  misc_feature: GYAE6OF01CDMRY.10.39.D06.1.454.CMB.1.raw
  modified_base (393)..(393): a, c, t, g, unknown or other
  misc_feature (393)..(393): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacggccacgctgacctggtggggatacacaagttggaagtaatcgtgtgctacgtggtaccagtacaggacgccgtacggccaggccctgtggttgtcgtctatatcgactaacgccgtcctgacggactccgtgacgcgtattctacgtggactaccgaagttccggactaaccgccggaccctacccgtanacctcgtactccgaccgtacggggtccggacgggtcccggggatcggacggtccgaacttacgtacgtcggttaccgagggttgtacgggtacttttcgacttaacgtcgtatttcgacggttggttcgggggttcctaccgggtacggggacgggtaaacccaggtccgtacggtacccgttaccgaagtaccgacgtacccgaaggtcccgtacccgcccccgttggccgtaccg

SEQ ID NO: 132402 - DNA, 695 bp, Homo sapiens
  misc_feature: GYAE6OF01C2572.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccaccctggtcgtcacggtcggccccgaggacacggacggccgacgctcgaccgtggtggggactacacgtaagttaggaaagttaagtcgtgtcgactacgtcggtaaccgagacgaggacggccgaacggccgacggtccccgtggtcggttcgtcgtactagtaagtgaactaaccggccgtcctggacggactccgtgacgtcgtacgttctacgtcggcctacgacggttcggactaaccgacccggcctacccttacacttaccactaccgacggacgggtacggaacggggtccgggtagtacgggaccggtaccgaccgtaaccgtacgtcgtacgtagggtcggttagggtactttacgtaacgtacggtacgtacgttacgtaggttcgggttcggggttacgtcggggtacgggtacggaaccgtacgtaccggtacggtaaccggtacgtacggtaccgacggacccgtaaccgggtccctacccggtcccccgtaggtccttaccccgg

SEQ ID NO: 132403 - DNA, 687 bp, Homo sapiens
  misc_feature: GYAE6OF01EJXPL.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccacccgtcggtgtcagtcggccccaggacagacgccacgctgacctggtgggggatacactaagttaggaagtatcgtgtcgcacgtggtaccagcaggacggccaggccgacggcccctggtggttgtcgtctatatgactaaccggccgccctagacggactcccgtggacgcgtacttctcgtcggtcctaccgtaagttccgggaccaaaccgacccggacccctaacccgtcaactccaacttcccgaaccggtacggggtaccggaacggggtcccggggaagtacgggaccgggacccgtaccgttaaccgttacgtcgtaccggtagggtcggttagggttacttaccgtacgttaccgtagtacgttcgtaggttcggggttacggggtccgttacggggacgggtaacgggaccgaaggtccgtaccggtaacccggttccgtaacggtccgaccggacccggtaacggtcccgtacccggccccccgttggtcccttaccccgg

SEQ ID NO: 132404 - DNA, 792 bp, Homo sapiens
  misc_feature: GYAE6OF01ET2WJ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggactacacaattggaagtaatcgtgtgcacgtggtaccagcagaggccaggccaggccctgtggtgtcgtctatatgataacgaccgcctgacggtactcccgtgacgcgtattcctcgtcggcctaccgaacgttccgggactaaacccgaccgggacccctaccccgtcaacgtccaacgttacccgaacccgtagggggtccggaaccggggggtccccgggggtaagttacggggaaccgggtaccccgtaacccgttaaccgttaccggttacgggttaccggtaacggggtttacgggttacgggggttaccttttaccggtaaccgtttaaccggttacggttacgttaaccgtaacgggttttcgggggttcgggggggttttacccgtttccgggggaacgggggtaaccggggtaaacccggtaaacgggtcccggttaaccgggttaaccccgggttaccgttaaaaccgggtcccgtaaacccggtacccccgggtaaacgggtccccgtacccccgggttcccccccggttacggggttccccctttaaccccgg

SEQ ID NO: 132405 - DNA, 830 bp, Homo sapiens
  misc_feature: GYAE6OF01CWJEC.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccaccctcggtgtcagtcggccccaggaccagaccggccacgctcgacctgggtagggggactacaacgtaagttagggaaagttaagtcgttggtcggctaacgttcggtaaccagccgaaggacggccgaggccacggccccttggtggttgtcgtctaataatgaagtaaccgaccggccctacgagggtactcccgtaggacgtcgtaagttcttccggtcggtacctttacccgtaaaacggtttcccggggaaccctaaaccgacccggggtaccccctaacccccgttacctaacttacccgtaaccgttaccgaaccccgggtaacggggggttacccggaaccggggggtacccggggggtaagtacgggaacggggtcccggtaaccgttaaccgttaaccggttcggtacggtaaggggttacgggtcggggtaacttacgggttacctaccggttcggtaccgttaaggaccggtaacccggttaacccgggggtttcgggttaccggggaccgggaaccgggggtaaaccaccgggtaccgtaccggggtaaccccgttcggttaaacggggtccccgtaaccggtaccccgaaacggggtaccccttcccggtaaccccccgggttccggcccgtttaaccccg

SEQ ID NO: 132406 - DNA, 697 bp, Homo sapiens
  misc_feature: GYAE6OF01BQ9B5.10.39.D06.1.454.CMB.1.raw
  modified_base (678)..(678): a, c, t, g, unknown or other
  misc_feature (678)..(678): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcagcccaccgtcggtgtcagtcggcccaggacagacgccacgctcgaccgtgggtaggggactacaacgtaagttagggaataagtcgtgtcgactagtcggtaccgagacgaacggacggccgacggccgaccggtcccgtggtggttcgtcgtactatagcgtaacgtaccgcccgctagacggtactccgtagacgcgtactccgtacgtcgaccgtacgtaacggtccggtaccaaaccggtacccggacccctaaccctactaccgtaccgtacgtaacccggaaccggggtacggggtaccgggaccgggggtacccgggttaacgacggggaccggtaacccgtacgttaacgttcgtacggtacggttgggtacggtttacggtaaccttacgaaccttaggtacagttcgttaagggtcgggtacgggttcgacgggtacgggacggtacacgggtctaccggacttacggcgaccgacggtaccgtacgtccggtacccncccggttcgacgttacccg

SEQ ID NO: 132407 - DNA, 862 bp, Homo sapiens
  misc_feature: GYAE6OF01EVHWK.10.39.D06.1.454.CMB.1.raw
  modified_base (370)..(370): a, c, t, g, unknown or other
  misc_feature (370)..(370): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccacccgtcggtgtcaggtccggccccgaggacacggaccggccacgctcgaccgtggggtgggggaactaacaactaagtttagggtaaagttaacgttcggtaggtcgaccaaccgttacgggtaacccagaccgaaggacggacccgacggggcccaacggggtcccccttgggtcggggtttcggtttaccgnttttaccggtaagttaaagtcggtaaaccttaaaccgggaccccggtcccgtacggacggggtacctcccgtaggtacggcgttacttccgttacgttcggtttaacctaacggttccgggacctaaaccgacccggaccctacccgtactacgtacctacgtacccgaaccgggtacggggtaccggtaccgggggaccggggtacgtacgggaccgggtaccccgtaacgttaaccgttacggtcggttacggtagggtacgggtttacgggttacttttacgaaccgtttaacgtagtacgttacggtaaggtttcggggttcgggggtttaccggtaccggggtacggggtaaccgggtaaccgtaaacgggtcccggttaaccggtaccccggttaaccggttaaccggtccgaacccggaaccccggtaacggggttccctacccccggttccccccggttccgggtaccccgtttaccccccggg

SEQ ID NO: 132408 - DNA, 658 bp, Homo sapiens
  misc_feature: GYAE6OF01AVBBT.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacggccacgctgacctggtggggatacacaagttggaagtaatcgtgtcgcacgtggtaccagcgaggacggccgacggccgaacggcccctggtcggttcgtcgtactaatagtgaacgtaaccggccggccctcgacgggtactcccgtagacgcgtattcgtcgtcggtctaccgtaagttccgggactaaccgaccggaccctacccgtacactccacgtccgaaccggacgggtcggacggggaccgggtagtacggacggacccgtacgtaaccgtacgttcggtacgtagggttcggtgggttactttacgaacttagtcgattcgtagttcgggttacgggtcgttacggggacggaacgggacgtaacggtcgtacggtacccgttacgtaacggtaccgacggcccgtaaacggtccctacccggtcccccgttggttcccgtcccgg

SEQ ID NO: 132409 - DNA, 801 bp, Homo sapiens
  misc_feature: GYAE6OF01ECK18.10.39.D06.1.454.CMB.1.raw
tcagcatagtagtgcacgaccggtgctcgatttagtgacatctcgcagttctttgggctgggcctaaggaagcagcactggtggtgcctcagccatggcctggaccgttctcctcctcggcctcctctctcactgcacagactctgtgacctcctatgcgctgactcacgccacccgtcggtgtcagtcggcccaggacagacggccacgctcgacctggtggggatacacaagttaggaagtaatcggtgtgcacgtggtaccagacaggaggccgacggccgacggtcccctggtcggttgtcgtactatagtgataaccggaccgcctacgaggtactccgtgacgacgtacttcgtacgtggtcctaccgtaacgttccggactaaccgaccggacccacccgtcaactcctaacgtacccgaccggtaacggggtcggaacgggggtacccggggagttacgggaacgggtcccgtaaccgttaccgttaaccgttacggttacggtacggggttacgggttacgggttaacgttttaccgtaacggtttaaccgttacggtaacgttaccgggttaacgggtttcgggggtttaccgggggggtttacccggtttacccggggggaccggggttaaacccgggggtaacccggtaaagggttcccggttaaaccgggtaaccccgggtttaacccggttaaaccgggttacccgaacccgggtacccccggtaaaacggggtccccgttaccccggggtcccccccggttacggggttccccgttaacccccggg

SEQ ID NO: 132410 - DNA, 689 bp, Homo sapiens
  misc_feature: GYAE6OF01CGZA1.10.39.D06.1.454.CMB.1.raw
  modified_base (573)..(573): a, c, t, g, unknown or other
  misc_feature (573)..(573): n is a, c, g, or t
tcagcatagtagtgcacgaccggtgctcgatttagtgacatctcgcagttctttgggactgggcctaaggaagcagcactggtggtgcctcagccatggcctggaccgttctcctcctcggcctcctctctcactgcacagactctgtcgacctcctatgcgctgactcacgcccaccctcggtgtcagtcggcccaggacagaccggccacgctcgaccgtggtaggggactacgactaagttaggtaaagtaagtcgtgtgacgacgtggtaaccagcaaggacggccgacggccgacggcccgtggtggttcgtcgtactagtaatgtaacgtaaccggacccgcccgtagacgggtaccttacccgtggacgtaccgtacttcgtcgtcggaccttacgaacgttccggaacaacccggaccggccctacccgtcaacttccaacgttccgaaccggtacggggtaccggacggggtacccggggtatacgggaccgggtacccgtaccgtaacgttacggtcggtacgtaaggggttcgtacgggttactttccgtaacgtaacgttnacgtgtaggttgggttacggggttcgtaccggggcggtacgggacgacggtccgtacgtaccgtacgtacgaccaccggacccgaacggtcccgtccggaccccttggccctaccg

SEQ ID NO: 132411 - DNA, 826 bp, Homo sapiens
  misc_feature: GYAE6OF01BNQRJ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctctatgcgctgactcacgcccacccgtcggtgtcgaggtcggcccgaggacacggacggccacgcgtcgaccgtggtgggggactacaactaagttaggaaagttaacgtcgtgtcgacgtacgtacggtaaccagacgaacggacggaccgacggccgaccgggtccccgtagggttcggtttcgtccgttacttaagtaagtacgtaacggtaacccggacccggtacccgtacggtacgggtacctccgtagacggtcgtacttcgtcgtcggtctaccgtaacggttccggaccaaccggtacccggaccctacccgtactactacaaccgtacccgtaaccgggtcggggtacccgggacgggggtacccggggtagtacgggaaccggtacccgtaacgttaccgtacggttcgtaccggtaggggttcgttaacgggttactttaccggacttaacggtcgtacgttacgtacggggtttacgggttcgggggttacggttacccgggggaggggtaaaccgggtaaccgtaaaccgggttcccgggtaacccggttaacccggttacccggttaaaaccgggtacccgtaaccgggtaacccccgttacgggtacccccggttacccccggaacccccgggtttcggttaccccgttaacccccgg

SEQ ID NO: 132412 - DNA, 695 bp, Homo sapiens
  misc_feature: GYAE6OF01B2M1A.10.39.D06.1.454.CMB.1.raw
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
  modified_base (672)..(672): a, c, t, g, unknown or other
  misc_feature (672)..(672): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcaggtcggcccgggacaggaccggccacgctgaccgtggtgggggatacacgtaattggaagtaatcgtgtgacacgtggtacagcaggacggccaggcctacggccccgtggttgtcgtcgtactaataganaacgaccggaccgtcgaggacgtcctacgngtacgcgtcttcgtgcggtacctaacgttacggaccgaacgacccggacccaccctacctacacactaccgaccgacgggtacgggcgggaccggggacgtaggacgggaccgaccgtacgtacgttacgtacgtaggtagggttcggtacggttttaccacttaacgtcgtatactcgggtagggttcgggggttccgttacgggggaccggaacgggggtaaccgaaccggtacgggttaccggtacccgggtaccccgtttaaggaacccgccgttaccccgggaaacgtcccggtcccgtaccccccggtagggttccccngtttaacccccggtttcccccgg

SEQ ID NO: 132413 - DNA, 690 bp, Homo sapiens
  misc_feature: GYAE6OF01EWS8P.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagaccggccacgctcgaccgtggtagggggatacacgaagttggaaagtatcgtgtgcacgtggaccagcagacggccacggccacggccctggtggttgtcgtctataatgaactaaccggccgccctacggacggtacctcccgtaggacgacgtactttcgtcgttcgcctaccgtaacgttccgggaaccaaaccggaccggaccccaacccgtcaacgttaccacgtacccgtaaccggacgggggtacggaacggggccggggtaagtcgggacggtacccgtaacttaaccgtacgtacggtacggtaggggttggttacggggttactttaccgaaccgttaacgtcggtaacttacggtaggttggggttcgggggttccggttcggggacgggtaaccgggacctaacggtcgtacggtacccgttacgtaacgtaccgaccgaccgaccggtccgacccgtccccgtacggtcctacccg

SEQ ID NO: 132414 - DNA, 880 bp, Homo sapiens
  misc_feature: GYAE6OF01DBEZU.10.39.D06.1.454.CMB.1.raw
  modified_base (241)..(241): a, c, t, g, unknown or other
  misc_feature (241)..(241): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctagtgcgctcgactcacgcccaccgtggtcgtcgacggtccggcccaggacgacggaccgccacgtcgtcgacgtgggtaggganaactacgtagtaggaagtacgtcgtgtcgacacgtacggaccagacgaggacggacgacggccgacggtcccgtggttaggttcgtacgtacgtaataacgtacgtaaccggtaccggaccgtaccgacggacgggtacctccgaggtacgtacgttactccgtcgtaccggtacctacggtaaccggtccggaactaacccggaccgtaccctacccgtacgtaccgtaccgtaccgtacccgggacggggttaaccgggggaccgggtaacgggggacccggtaacggttaaccggaacccgggttaaccgtaaccgtttaaccggttacgggtttccgggtaacgggtaacggggtttaccgttacgggtttaaaccctacggtttaaccgttaccgggtacggtaaacgtttccggggtaccgggggttttacggggttacccgggggttacccgggtaacgggggaacccgggttaaagggtaccccggtaaacgggttcccgggttttaaacccggacccgggtttaaaccccgggtagttaacccccgggaaacccgggtttccccgggtaaccgtttcccccgggtaaccccccggtttcccgtccccgggttacccgttttaccccccgg

SEQ ID NO: 132415 - DNA, 561 bp, Homo sapiens
  misc_feature: GYAE6OF01AZZVX.10.39.D06.1.454.CMB.1.raw
  modified_base (237)..(237): a, c, t, g, unknown or other
  misc_feature (237)..(237): n is a, c, g, or t
  modified_base (269)..(269): a, c, t, g, unknown or other
  misc_feature (269)..(269): n is a, c, g, or t
  modified_base (457)..(457): a, c, t, g, unknown or other
  misc_feature (457)..(457): n is a, c, g, or t
  modified_base (481)..(481): a, c, t, g, unknown or other
  misc_feature (481)..(481): n is a, c, g, or t
  modified_base (505)..(505): a, c, t, g, unknown or other
  misc_feature (505)..(505): n is a, c, g, or t
tcagcatagtagtgcacgaccggtgctcgatttagtgacatctcgcagttctttgggggctgggcctaaggaagcagcactggtggtgcctcagccatggcctggaccgttctcctcctcggcctcctctctcactgcacagactctgtcgacctcctatgcgctgactcagcccaccctcggtgtcaggtcggcccaggacagaccggccacgctgaccgtggtgggggataccanaagttggaagtaatcgtgtcgcacgtggaccngcaggacggccacggccacggccctggtcggttgtcgtctatatgactaacggacccggcctcgaggacctccgtaggacgcgtacttcgtcgtggctaccgacgtcggacaacgccggccacccgtcactcactaccgaccgaggggtcgacgggccggagtcggacggccgactactcgtgtacgnggtggtgtactttcgacgtctagntcgagttgggtagggtctacgggnggacggacgagcgtcgaccgactagccacggccgacgcgtccgcccgtcggctccg

SEQ ID NO: 132416 - DNA, 705 bp, Homo sapiens
  misc_feature: GYAE6OF01EH4TT.10.39.D06.1.454.CMB.1.raw
  modified_base (338)..(338): a, c, t, g, unknown or other
  misc_feature (338)..(338): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgaccgtggtgggggatacacaattaggaataatcgtgtgcactggtaccagcaggacggccaggccacggtcccctgtcggttgtcgtactataatgactaacgaccgcctcgagggtactcccgngacgtcgtacttctcgtcggctaccgtaacgttccgggacctaaaccgacccggaccctacccgtccacgtaccactccaaccggtacggggtacggacggggccggggagtacgggacgggtcccgtaacgttaaccgtacgtcggtacgaggggtttcggtagggtactttcgaaccgttacgtggtactcgttaggtcggggttacgggggttccggtttacggggaccgggaacggggtacccgtaaacggtccggttaccgggtaacccggttacccgtaaacggtacccgtaacccggacccccgggtaaacggtccccgttaccccgggtcccccccggttccgggttcccctaacccgg

SEQ ID NO: 132417 - DNA, 693 bp, Homo sapiens
  misc_feature: GYAE6OF01CAWFL.10.39.D06.1.454.CMB.1.raw
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
tcagcatagtagtgcacgaccggtgctcgatttagtgacatctcgcagttctttggggctgggcctaaggaagcagcactggtggtgcctcagtcatggcctggaccgttctcctcctcggcctcctctctcactgcacagactctgtgacctcctatcgcgctgactcacgcccaccctggtgtcagtcggcccaggacagaccggcacgctcgaccgtggtggggactacacgtaagttaggaaagttaacgtcggtgtcgacaacgtcggtaaccagacgagacggccgacggacgtacggccccgtggtcggttgtccgtcttaagtaagtagtactaaccgaccggtccctacgacgggtactcccgngagcggtattctcgnggtacctcgtaacgttccgggacaaaccgccggtacctacccctagacgtaccacgtccgaaccggacggggtaccgaacggggtccgggtaagtcgggaacggtacccgtaacgttaccgtacggttacggtccgtacgggtgttacgggtaaccttttcgaaccgtatacggtacgttacgtacggtttagggtccggggggttacttccgggggaggttaaccgggaccgtaacggtcgtaaccggtacccgtaacgtcggtacgacgacccgtaggccctaccggcccgtcgacccttccg

SEQ ID NO: 132418 - DNA, 761 bp, Homo sapiens
  misc_feature: GYAE6OF01DM1NE.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgccctacccgttcggtcgtcgacggtccggaccccgaggacgacggaccggcccgaccgtcgtacggaccgttggggtacggggactaacgaacgttaagttagggaaagttaacgtcggttaggtcgaccgtacggtacggtaaccaggacgaaggacggaccgacggcccgacggtccccgttagggtcggtttcgtacgttactaagtaagtacgaacgtaacccggacccggtacccgtacggacggtaccttcccgtaggacggtacttacgttccgtacgtcggtacctaaccggtaacggtccgggaaccaaccggtacccggaccctacctacgactaccaacgtaccgaacgggtacggggtacggacggggaccgggtagacggaccggaccgtacgtacgtacgtcggtacggtagggttgtacggttacttcgtaacttacgtagtacgttcgtagggttcggggttacggggttcggttacggggaccgggacggaccgtacggtcgtacggtacccgtagtaaccgaccgaccggacccgtacggtaccctacccggtccccgtgtcccgtacccg

SEQ ID NO: 132419 - DNA, 755 bp, Homo sapiens
  misc_feature: GYAE6OF01EUNME.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccaccctcggtgtcagtcggcccaggacagaccggccacgctcgacctggtggggactacactaagttaggaagtaatcgtagtcgactacgtcggtaccagcaggaggaccgacggccacggtccccgttggtacggttcgttcgtactaataacgtgaacgtaaccggacccggtccctacggacgggtacctcccgtagacggtacgtacgttctcggtcggtcctaccgtaacggttccgggactaaaccggacccggacccctacccgtcctacgtaccacgtacccgaaccggtacggggtaccgggacggggaccggggtacgtacgggacgggtacccgtaaccgttaccgtaacgttcggtacggtaagggtcgggtttagggtactttaccgaacgttaacgtacggtaacttcgtaagggttcggggttcgggggttaccggttcggggaaccgggtacgggtaacccggtaacgtccgggtacgtaacccggttccggtaaagtaccggtaaccgggaaccccgtaacgggtccctacccgggtccccccgttcggtcccgttaccccgg

SEQ ID NO: 132420 - DNA, 663 bp, Homo sapiens
  misc_feature: GYAE6OF01BM9QV.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccacccgttcggtgtcagtcggccccaggacagacggccacgctgacctggtgggggatacacaagttaggaagtaagtcgtgtgcacgtggtaccagcagacggaccacggccacggcccctggttggttcgtcgtactataatgaactaaccggaccgtccctcgacggtactccctggacgcgtattctcgtcggacctccgtaacgttccgggactaaaccgccggacccctaccctcactccactccgaaccgtacgggtacggacggggacccggggtatacgggacggacccgtaccgtaacgtacgtcgtacggagggttggtacgggtactttacaacttacgtcgtaagttcgtaggttgggttacggggttccgttcgggacgggtacgggtaccgacgtcgtacgggtacccgttaccgtaacgtcccgaacggaccccgaacgggtccgtaccccgccccgttccggtcccgttacccg

SEQ ID NO: 132421 - DNA, 691 bp, Homo sapiens
  misc_feature: GYAE6OF01CKM2H.10.39.D06.1.454.CMB.1.raw
  modified_base (529)..(529): a, c, t, g, unknown or other
  misc_feature (529)..(529): n is a, c, g, or t
  modified_base (580)..(580): a, c, t, g, unknown or other
  misc_feature (580)..(580): n is a, c, g, or t
tcagcatagtagtgcacgaccggtgctcgatttagtgacatctcggcagttctttggggctgggcctaaggaacgcagcactggtggtgcctcagccatggcctggaccgttctcctcctcggcctcctctctcactgcacagactctgtcgacctctatcgcgctgactcacgccacccgtggtgtcgaggtcggacccgaggaccaggaccggccacgtcgcgaccgtgggtacgggggtataccgaacgtaagtttaggaagttaaagtcggtagtcgacgtacgtacgggtaaccaggacgaaggaccggaccgtaccgggaccgaaccggtccccgtagggttcggttcggtccgttacgtaataaagttacggaaacgttaaaccgggaccggcccgtacggacgggtactacccgtaggacgtacggtaattcctcggacggtacctaacgtaacgtcggtaacaacgaccggtaccaccgtacactacgacaccgtacggaggggtcgacgggaccggganacggaacggcaacgtccgaatcgtagaggtgtgggtaactttacgacctancgtaatcgtacgttagggtcgggtacgtcggacggacggactaacgcgtaccgaccgtcgtaaacgccgaacgtccccgaagtcccacccggccccgtggtccttaccggg

SEQ ID NO: 132422 - DNA, 616 bp, Homo sapiens
  misc_feature: GYAE6OF01BB313.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtggggatacacaagttggaagtatcgtgtgcacgtggtaccagcagacggccaggccacggccctggtggttgtcgtctatatgactaacgccggccctcgaggactcccgtagacgcgtattctcgtgctacctaacgttcgggacaacgccgacccaccctcactcactaccgaccgacgggtacggacgggccggggtatcggacggccgactactacgtcggtacgaggtggtgggtacttcgaactacctgtacgtcgtagttgggttcggggttcgttacggggacgggtaaccgggtaccgaacggtccgtcggacccgggttactaacgggtaccaccggtaccccgtaacgggtcctaccccggtccccccggttcgtcccgttaccg

SEQ ID NO: 132423 - DNA, 702 bp, Homo sapiens
  misc_feature: GYAE6OF01DQUB8.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccacccgtcggtgtcacggtcggccccgaggaccgacggaccgccacgcgtcgaccgtgggtcggggatacaactaagttaggaagtatcgtgtgctacgtcggtacgagcgagacggaccgacggccgaccggtcccttggtcggttgtcgttactaataagtacgaacgtaaccggacccggtcctacggacggtacctcccgtggacgtcgtacttccgtcgtcgcctacgtaacgtcggacaccgtacccggccctacctaccgactacgacctaccgtaaccgggtacgggtaccggacggggtaccgggtagtacggaacggtcccctacgttacgtaccgttcgtacgtaggggttgtacgggttactttaccgaacttacgtacgtacgttgtacggttggggttacgggttcggtacggggaccggtacggaaccgtaggtaccgtacggtacccgttacgtacgaccgaccggtaccgtaaccggcccttaccccggaccccgttgtacccgttccccg

SEQ ID NO: 132424 - DNA, 846 bp, Homo sapiens
  misc_feature: GYAE6OF01COF0O.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctctatgcgctgactcacgcccacccgtcggtgtcacgtcggcccaggacaggacgcctacgcgtgaccgtcgggtaggggactacaacgtaagttaggaagttaagtcgtgtcgctacgtacggtaccagcgaaggacggaccgacggccgaacggtccccgttgggttcggtttcggtcgttacttaagtaaacgttggaacgtaaccggacccggtccctacggacgggaaccttcccgtagacggtacgtactttcctcgtcggtcctaacgtaacggtccgggaactaaacccggacggaccccctaaccgtactactaccgtaaaccgtcccgtaaccgggaacggggttcccggaacggggggtaccccggggtaacggtacgggaaaccgggtaccccgtaaaccgtttaaccggtaaccggtttggtaaccgggtagggtttacgggtgggttaaccttttacggaaacctttaccggaagttaaccggtttcgtaacgggtttacgggggttccgggggttaccgttacggggtaccggggaaacggtaaacccggtacggtacccggtttaaacgggtaccccgtttaaccgggtaaaacggttcccgaaacccgggtaccccggtaaaccgggttcccgtacccccgggttccccccggttaccgggtcccttaaccccggg

SEQ ID NO: 132425 - DNA, 873 bp, Homo sapiens
  misc_feature: GYAE6OF01ALZWE.10.39.D06.1.454.CMB.1.raw
  modified_base (847)..(847): a, c, t, g, unknown or other
  misc_feature (847)..(847): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctctatgcgctgactcaccgccctacccgttcggtcgtacgacggtccggaccccgagggaccgacgggaccggcccgaccgcgtcggtaccgtggggtacggggtaactaccgaactaaaggttacgggaaagttaacgtcggtggtacgtacctaacggttacggaaccgaggacggaacggaccgggaccgaccgggaccccggtaccgggtccccggttggggtttacgggtttaccgtaccgtttaacgttaagtaacggttaacggtaacccggtaaacccgggtacccccgggtacccgtacggggtaaccgggtacccgttcccggtaaggtccggtaccgttaccgttccgttcggttacccggtaaccgtacccggttaacggttacccgggacccaaacccggaaccccggtacccctaccccgttaacaccttaccgtaccggtacccggaaccgggtacggggtaccgggaccgggggacggtacggtagggaccccgtaaccgggttacttacggttaccggtcggttacggtagggttccggttaaggttcctttacgacgttacgtaggtacgttcgggagggtttcgggttaccgggtccggtacggggtacggtaacgacgtaccggaccggtacggttacccagggttcccaaccgcggacccggtcggtaccccncccggtaccgttcgacccgttacccg

SEQ ID NO: 132426 - DNA, 833 bp, Homo sapiens
  misc_feature: GYAE6OF01DZKX4.10.39.D06.1.454.CMB.1.raw
  modified_base (163)..(163): a, c, t, g, unknown or other
  misc_feature (163)..(163): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctctatgcgtntgactcacgccctacccgtcggtgtcgaggtccggccccgaggacgacggaccgccgacgcgtacgaccggtgggtacggggactaaccgaagtaaagttagggtaaagtaacgttcggtgtcgctacggtacggtaaccgagaccgaggacggccgtacggacccgaccggtcccgttgggttcggttcgttacttacgttaaatacgtacgaacgttaacccggaccccggtcccgtacggtaacgggtccgtaccgttaacggacgggtacgtttactttcccgttacgggtcggttcccgtaacgttaacggttaccgggaaccctaaaccggcccggtaccccacctactacgtaacccacgtacccgaacgggtaccggggtacgggtaccgggggacgggtacgaccgggaccggtaacccgtaccgttaccgttacgtacggttacgggtacggttcgggttacggttacctttacgtacgttagtacgtacgttcggtaagggttcgggggttccggggttaccggtaggggaacccgggtacgggtaaacccgtaccgggttaccgtaacgggtacccggttaacccgttaggtaccgtacccggacccggttaaccggtcccgttacccccggtccccggttacgtcccttaaccccgg

SEQ ID NO: 132427 - DNA, 744 bp, Homo sapiens
  misc_feature: GYAE6OF01BF06B.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgccacccgtcggtgtcaggtcggccccgaggacgagacggccacgctgacctgggtggggactacactaagttaggaagtaacgtcgtgtgctacgtagaccgagcgaggacggccgacggccgaccggtcccgtggtcggttcgtcggtactaataagtacgtaacgtaaccggaccggtccctacggacgggtacctcccggtaggacggtaccgttacttccgtacgtcgggtccttaaccggtaaacgttccggggaaccctaacccggacccggaaccccaccgtaccacgtacctaccgtaccgaaccgggtacggggtacgggacggggacccgggtagacgggaaccgtccgtaacgtacgttacggtgtacgggtaggttacgggttcgggtactttacgtaaacggttctacggtaacttccggtaggttcgggggtttcgggggtaccggttacgggggaaccgggtaagggaccgtaacgggtcgtaaccggttacccggtaacgtacggtaccggaaccgtaccggtacggccgtacccggtcccgtaacgtctacccgg

SEQ ID NO: 132428 - DNA, 746 bp, Homo sapiens
  misc_feature: GYAE6OF01E3ZCC.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggcccaggacagacggccacgctcgaccgtggtgggggatacacaagttaggaagtaatcgtgtgacacgtggtaccagcaggacggccgacggcccgacggtcccccgtggtcgggtttcgtcgtactaataagtagtaacgtaaccggacccggccctacgaacgggtactcccgtaggacgcgtacttctcgtcggcctaccgtaacgttccgggaccaaaccgcccgggacccctaccccgtaccactacctaactacccgtaacccggtacggggtaccgggaacgggggacccgggggtaagtacgggaccgggtacccggtaaccttaacgttacgttcggtacgtaggggttcggttacggggtactttaccgaaccgttacgtagtacgtacgtaggttcggggttcgggggttcgttccggggacggggtaccgggtaaccgaacggttccggtaccggtacccggttaacccggttaacggtacccgaaccggaccccggtaaacggtcccgtacccggtccccccggttcggtcccgttacccgg

SEQ ID NO: 132429 - DNA, 818 bp, Homo sapiens
  misc_feature: GYAE6OF01EAJ8A.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctacgactcacgccctacccgtcggtcgtcgtacggtcggccccgaggacacggaccggccaccgtctacgaccgtgggtacgggggaactaacgaacgtaagttacggtaaagttaacgtccggtgtcgaccgtacgtcggtaccgacgacgaaggtacggaccgacggcccgaaccgggtccccgttaggggtttcgggtttcggttccgttaccgtaagtaacgtacggtaacgtaaccccgggtacccggcccgtacggacgggacctccgtacggacggtcgtacttcgtcgtcggccttacgtacggttcggaccgtaaccgccggacccctaccctacgtaacctaccgtaccgacccgtaaccgggaccggggttacgggacccgggggacgggtaacgtacggggacccgggacccgtaactttaacccggtacgttcggtacgggttacgggttacgggttcgggtttaacctttaccgtaaccgttacgtacggtacgttacgttaggggtttcgggtcggggtttacccgtcgggggaacggtacgggaaaccgtacggtaccggtaccgggttaccctaacggtacgtacccggaacgtacccgtacgggtccctacccggtccccgttccgtcctaccccgg

SEQ ID NO: 132430 - DNA, 697 bp, Homo sapiens
  misc_feature: GYAE6OF01A6V01.10.39.D06.1.454.CMB.1.raw
tcagcatagtagtgcacgaccggtgctcgatttagtgacatctcgcgagttctttggggctgggcctaaggaagcagcactggtggtgcctcagccatggcctggaccgttctcctcctcggcctcctctctcactgcacagactctgtcgacctcctatgcgctgactccacgccctacccgtcggtgtcaggtccggaccccaggaccacgaccggccacgtctcgaccgtggtcgggggaaccacaacgtaagttaggaaagttaacgtggtgtgactaacgttcggaccaggtccaaggacgacgacggccacggtcccgtggtcgttacgtcgtactagtatagactacgaccgctacgacggtctccgtagtagccgtacttcctcgtacggtcctaccgtaacgttccggggaacctaacgacccggaccctacccgtactaccgtccgtaactaccgaaccggtacggggtaccggacggggtacccgggaagtcggacggacccgtactccgtactcggtacgtcggtaggtcgtacttcgaacgtacgtcgtatcgtacggttacggggttcgggtaccgttcgggacgggaacgtacgtaacgggttacgaccgggttacctaaccggtctaccggaccgtaccggtaactcccgacccgtaccccggtccgttaccgtaccccgg

SEQ ID NO: 132431 - DNA, 683 bp, Homo sapiens
  misc_feature: GYAE6OF01CV2I4.10.39.D06.1.454.CMB.1.raw
  modified_base (254)..(254): a, c, t, g, unknown or other
  misc_feature (254)..(254): n is a, c, g, or t
  modified_base (528)..(528): a, c, t, g, unknown or other
  misc_feature (528)..(528): n is a, c, g, or t
  modified_base (669)..(669): a, c, t, g, unknown or other
  misc_feature (669)..(669): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctctatcgcgctgactcacgcccacctcggtgtcgacggtcggccccaggacaggaccggcacgctggacctggtgggggatacaacaagttaggaagtaancgtgtgactacgtggaccagcaggcggacacggcacggtcccgtggtaggttcgtacgtctaagtaaagttcgaacgttaaaccggacccgggtcccttaacggacggggtaacctacccggttggaaccggtcggttaacttccgtacggtcgggacctaaccgtaaacgggttacgggacctaaacgccgggacccaccttacgaactcgtacgtaccacggacgggtaccgacggggacccgggatacggacggacctactacgtacgtcncggtaggtggtagggtacttcgtaactacgtcgaacttcgaagttcgggtacggggttcgtcgggtacgggacggacgtaagcggtacgaccggtacgtaacgtcgaaccggcccgtaacggacccgtaccaccccgggtnttcccgttaacccg

SEQ ID NO: 132432 - DNA, 708 bp, Homo sapiens
  misc_feature: GYAE6OF01DJRCN.10.39.D06.1.454.CMB.1.raw
tcagcatagtagtgcacgaccggtgctcgatttagtgacatctcgcagttcgtttggggctgggcctaaggaagcagcactggtggtgcctcagccatggcctggaccgttctcctcctcggcctcctctctcactgcacagactctgtgaccctcctatgcgctgactcacgcccacccgtcggtcgtcgacggtcggacccgaggacacggaccggccacgtcgtcgaccgtgggtaggggactaacgaacgtaaagttaggaaagttaacgtcggttaggtacgaccgtacgttacggtaaccgagacgaaggaccggaccgacggaccgaccggtccccgtggttggttcgttcgtactaataagacgtaacgtaaccggacccgtccgtacgaggtacctccgtagacgtcgtacttcgtcgtcggtacctacgtaacggtcggacctaaacccgccggtaccctacccgtacaccgtactacgtaccgaaccggtacggggtaccggaccggggacgggacgtacggaccggtaaccgtactacgtacgtcgtacggtagggtcgtagggttacttacgactacgtgtactacgtaggttcgggtacgggttccgtacggggtacggacggaaccgagtccgtaccggtaccgtacgtacgaccgacgaccgtacgccgtacccgccccgtggtcctacccg

SEQ ID NO: 132433 - DNA, 649 bp, Homo sapiens
  misc_feature: GYAE6OF01CGTQP.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccaccctggtgtcaggtcggcccaggacagacggccacgctgacctggtggggatacacaattggaagtaatcgtgtgcacgtggtaccagcgaggacggcccgaggcccgacggtccccgtggttcgggtttcgttccgttctaagttaacgtggtaactaaccggaccccggccctacggacgggtacctccctaggacgcgtacttcgtcgtcggcctacctaaggttccggacctaaccgaccggacccaccctacactccactccgaaccgtacggggtccggacggggtccggggtatacgggaccggacccgtacttaacgttacgtcgtacggacggttggtagggtactttcgacgttacgtggatcgtaggttcgggtcggggttacgtcggggacgggacgggtaccaggtccgtcgtaccgtacgtagtccgacgaccgacggctcccggcccctggtccctccg

SEQ ID NO: 132434 - DNA, 701 bp, Homo sapiens
  misc_feature: GYAE6OF01AL2ME.10.39.D06.1.454.CMB.1.raw
  modified_base (280)..(280): a, c, t, g, unknown or other
  misc_feature (280)..(280): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctctatgcgctgactcacgcccaccgtcggtgtccaggtccggaccccaggaccaggaccggccacgctcgaccgttggtacggggactacgactaagttggaagtacgtcgtgtcgcacgtcgtaccngacgtagacggccaggccgacggtccccgttggtcggttgttccgcttatagtacgaaccgttaccggccgtcccgtaggacggtactcccgtagaccgtacgtagttccgtacgtccgcctaacgttaacggtcggacaccgaccgtcccctaacctcgtactaccacgtaccgacccggtagggtacccggacggggtacccggtagtaccggaaccggtacccgtacgtaccgtacgtcgggttaccgtagggtccggttaggttacctttaccgacgttacgtggtacctacggttaggtcggggttaccgggtcgtaccgggtacgggaccgtaccgtcggtcgtaccggtacccggtacgtacgccggtaccgtcggtaaccggttcaccccggtcccgtacggtcccttaaccg

SEQ ID NO: 132435 - DNA, 723 bp, Homo sapiens
  misc_feature: GYAE6OF01B9Y7J.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcaggtcggcccaggacagacggccacgctgaccgtggtgggggatacacgaattaggaagtaatcgtgtgcacgtggtaccagcaggacggacacggccacggccccgtggtcggttgtcgtctaataagtacgtaactaacggacccgtcccgtacgacgggactcccgtgacgcgtacttcgtcgtacggcctaccgtaacgttccgggaccaaccgaccggccctacccgtcacgtacaacgtccgaccgtaggggtaccggaggggtacccggggaattcggaacgggtcctaccgtacgtacgtacggtacgtagggttgtagggtacttaccgtaacgttaccgtagtacgttacgacggttagggttccgggggttaccgtaccggggtacgggtaacgggtacccgtaagggtcccggttaacgggtaaccccggttacggttaaacgtaccccggtaaccggtaacccccggtaaacggggccccgtttaccccggaccccccccggttccgggttacccgttacccccgg

SEQ ID NO: 132436 - DNA, 721 bp, Homo sapiens
  misc_feature: GYAE6OF01AO48J.10.39.D06.1.454.CMB.1.raw
  modified_base (338)..(338): a, c, t, g, unknown or other
  misc_feature (338)..(338): n is a, c, g, or t
  modified_base (386)..(386): a, c, t, g, unknown or other
  misc_feature (386)..(386): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggcccaggacagacggccacgctgacctgtgggggatacgacaattggaagtaatcgtgtgcactggtaccagcagaggccaggccaggcccctggtcgtgtcgtactatatagagtaacgccgcctcgaggactccgtgagctacgtntcgtggctaccgaaacgttcgggactaaacgaccggtaccaccccgtnaactccaactaccgaaccggacggggttacgggacggggacccggggtaacgtcggaaccggacccggtaacgtaaccgttaccgtacggtacggtaaggttcgggttacggggtaaccttttcgaaccgttaacgttacgaagttaccgaacggttgggtttaaccggggggtcgtttaccggggaccgggtaacggggtaacccgtaaaacggggttccgtaaccggtaaaccccggttacccggtaaaacggttccggtaaaccggacccccgtaaaaggggttccccgttaacccggccccccccgtttacggggttacccttaacccccg

SEQ ID NO: 132437 - DNA, 667 bp, Homo sapiens
  misc_feature: GYAE6OF01BPYY7.10.39.D06.1.454.CMB.1.raw
  modified_base (443)..(443): a, c, t, g, unknown or other
  misc_feature (443)..(443): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctctatgcgctgactcacgccaccctcggtcgtcagtcggcccaggacacggaccgccacgcgtcgaccgtggtggggactacaacagttaggaagtacgtcgtgtgctacgtggtaccagcgaggacggaccgacggccgaacggtcccctggttcgggttacgttccgtacttaataacgtacgtaacgtaaccggacccggtcccgtaggacgggtacctccgaggagtcgtacgttctcgtcggctactaggtccggacaaccgccgacctacctactacacctacnccgaaccggaggggtccggacggggaccggtgcggtacggaccgtactacgtcgtgtacgtgggtgtcggttacttacgacgttactagacttacgagggtttcggggttacgggttcggttacgggacgggtacggaccgtacgcgttaccggtacccgttacgtacggaccgaccgacccggtacgtcccggttacccgcccccggttgtaccccgttcccg

SEQ ID NO: 132438 - DNA, 801 bp, Homo sapiens
  misc_feature: GYAE6OF01C8T8I.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccaccctcggtgtcagtcggccccaggacagaccggccacgctgaccgtggtgggggatacaactaagtaggagtaagtcgtggtgacacgtcggtaaccagacgaggacggccgacggccgacggtccccgtaggtggttgtccgttctaataagtgaacgtaaccggaccgccccgtacgacggacctccgtgacgcgtacttcgtcgtcggtcctacgtaacgtccgggaacaaccggaccggacccctaacccgtctactaccaacgtacccgaacccgggtcggggtaccgggacggggtccccggggtaattcgggaaaccgggccccggtaaaccgttaccgttaaccggttagtacccgggtagggtttacgggttacggggttaccttttaaccgtaaccgttacttaccggtattccgggttaagggtttccgggggttgggggtttcccggttacgggggacccgggggttaaacggggaaacccgtaagggttaccgtacccccggggttaacccgtttaacccggtaaaacgggttcccaaaccggggtaacccccggtacgggtaccccgttacccccggttcccccccggttaccggtccccgtttacccccgg

SEQ ID NO: 132439 - DNA, 714 bp, Homo sapiens
  misc_feature: GYAE6OF01B9DER.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctctatgcgctgactcacgcccaccctcggtgtcagtcggcccgaggacagacggccacgctgaccgtggtggggatacaactaagttaggaagtaatcgtgtgacacgtggtaccagacgaggacggccgacggccgaccggccccgttggttcgggttcgttcgtcttaataagtcgaacgtaaccggacccggtccctacgacgggtctcccgtagacgcgtattccgtcgtcggcctaccgtaaacggttccgggacctaaccgacccggacccctacccgtactactaccaccgtacccgaacccggtacgggggtaccgggaccgggggaccggggtaacggtacgggtaacgggacccggtaaccgtaccgttaccggtacggtacggtacggggttgggttacggttacgtttaccgtacgttaccgttagtaccttaggtacggttcggggttacggggtccgttacggggacgggtacgggacgacgtccgtacggtaccgtacgtacgacgaccgacccggtacggccgtacccggcccgtcggtccctccg

SEQ ID NO: 132440 - DNA, 765 bp, Homo sapiens
  misc_feature: GYAE6OF01C4BCY.10.39.D06.1.454.CMB.1.raw
  modified_base (502)..(502): a, c, t, g, unknown or other
  misc_feature (502)..(502): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctcgactcacgcccacccgtcgggtcgtcgacggtccggccccagggacacggaccggccgacgctacgaccgtgggtaggggactacacgtaagttaggaaagttaacgttcggtgtacgactacgtacggtaccaggacgacggacggccgtacggccgacggtccccgttgggtcggtttcgtcggtactaataacgtacgtaacgtaaccggacccgccgttacggacggggtacctccgtaggtaaccggtacgttacgttccgttacgtaccgggtacctaaccgttaaaccggttcccgggaacaaaccggtcccggtaaccctacccgttanaccgttactaacgtacccgtaacgggtacgggtacgggaccggggacgggtacgtacgggaccggaaccgttacgtacgttacgacggttgtacggggtttagtacggttacttacggtaacctaggtacgtacgttaggtacgggttacgggtcgggttacggttcggggacgggtaacggaccgtacgtacggtaccggtaccgtaggtaccacggtaccggaccgtacggacccgtacccggtcccgtatcccggtaccg

SEQ ID NO: 132441 - DNA, 735 bp, Homo sapiens
  misc_feature: GYAE6OF01EBQC4.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgccgctgactcacgcccacccgtcggtgtcagtcggcccaggacagacggccacgctcgacctggtgggggactacacaagttagggtaaagtaactcgtgtgctacgtgggtaaccagcaggacggaccgaggcccgacggtccctggttggttcggtcggttactaacgtaatagaactaacggacccggtccctcgagggacctcccgtggacgtcgtacttcgtcgtggcctacgtaacgttccgggactaaaccgcccggacctaaccctcactactaacgtccgaacccggtacgggggtaccggaaccggggtaccgggggagtacgggaaccgggaccccggtaactaaccggtttacctacggtacgtacggggttagtcgggttatttaccgaacgttacgtacgtacttaccgaaggttgggggttaggggttcccggttacggggacgggtaacgggacccgtaaggtccgttaccggtaacccggttacgtaacgggtcccaaccggaaccccgttaacgggtacccctcccgggttacccccctgggtaacccttaccccgg

SEQ ID NO: 132442 - DNA, 691 bp, Homo sapiens
  misc_feature: GYAE6OF01AXUYZ.10.39.D06.1.454.CMB.1.raw
tcagcatagtagtgcacgaccggtgctcgatttagtgacatctcgcagttctttgggggctgggcctaaggaagcagcactggtggtgcctcagccatggcctggaccgttctcctcctcggcctcctctctcactgcacagactctgtgacctcctatgcgctgactcacgcccacccgtcggtgtcagtcggccccaggacaggaccggccacgctcgaccgtggtgggggatacacaagttaggaagtaatcgtgtgcacgtggtaccagcaggacggccgacggccgacggcccctggtggttcgtcgtactatagtgactaaccggaccgcctcgagggtactccgtgacgcgtattctcgtcggtacctccgaacgttcggacaaccgaccggacccaccctctactcacgtaccgaccggtaggggtacggacggggtacccggggatcgggacggaccgaccgttacgtaccgtcggtacgtaggggttcggttacgggtacgtttacaacgttacgtacggtacttacggtaggttcgggggttcggggggttccgttacggggtaccggggtaacgggtaccgtaacgggtccgtaccgggttacccgttaccggtaacggacccgtaacggaccccgtaacgggtccctaccccggcccccgttcggtacccgtacccgg

SEQ ID NO: 132443 - DNA, 652 bp, Homo sapiens
  misc_feature: GYAE6OF01CQUAD.10.39.D06.1.454.CMB.1.raw
  modified_base (532)..(532): a, c, t, g, unknown or other
  misc_feature (532)..(532): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccacccgttcggtcgtcacggtcggccccgaggacaggaccggccacgctcgaccgtggtgggggactacactaagttaggaagtaacgtcgtggtcgcacgtaggtaccagcaagcggccaggccgacggccctggtcggttcgtcgtctaagtatgaactacggaccgtccctacgagggctccgtaggacgtcgtacttcgtcgtcgcctactaacgtcggacacgacggcccaccgtcataccactacgacgtacgggtcggacgggaccggggatacgggacgggtccgtaaccgttacgtacgtcgtacggtagggtcggtagggttactttaccgtacgtacgtagaacgttntaggttcggggttggggtccgttacgggcgggtacgggaccgacgtccgtcggtaccggttacctaaggtccgaaccggacccgtaacggtcccgtaccgtccccgtcggttcctacccg

SEQ ID NO: 132444 - DNA, 661 bp, Homo sapiens
  misc_feature: GYAE6OF01DQZT5.10.39.D06.1.454.CMB.1.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (298)..(298): a, c, t, g, unknown or other
  misc_feature (298)..(298): n is a, c, g, or t
  modified_base (429)..(429): a, c, t, g, unknown or other
  misc_feature (429)..(429): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagacttctgtgacctcctatgcgctgactcacgccacccgttcggtgtccaggtccggccccaggacaggaccgccacgcgtcgacctgggtggggactacgactaagttaggaagttaatcgtgngactacgtggtaccngnaggacggccacggccncggccccgttggtggtttcgtcgtctatacgtgaacgtaacggacccggcctcgacgggactccgtagacgtcgtattcgtcgtgtccgtacgtaacggttccggaccaaccgacccggtacccaccctanacttccgactaccgaccgggtacgggccggaacggggtcggggactacgggacggtaccgtaactacgttcgtcggtcgtagggtcggtgggttaattccgacttacgtgtatacgtaggttggggttcggggtcgttaggggaccgggtacggacccgtaggccgtaccgtacccgttacgtacgtaccgtaaccgccgtaccggctccccgggtccctccgtctcccggg

SEQ ID NO: 132445 - DNA, 761 bp, Homo sapiens
  misc_feature: GYAE6OF01BPOOP.10.39.D06.1.454.CMB.1.raw
  modified_base (269)..(269): a, c, t, g, unknown or other
  misc_feature (269)..(269): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccacccgtcggtgtcagtcggccccaggacagacggccacgctgaccgtggtggggactacacgaagttggaaagtagtcgtgtgcacgtggtaccngcagacggccgacggccgacggtccctggtggttcgtcgtctataagtgacgtaaccgccgcctacgacgggtactccctagacgcgtacttctcgtacgctaccgtaacgttccgggaccaaacccggtacccggacccctacccgtactaacgtaccaaccgttacccgaacccggtacgggggtacccgggaacggggaccccgggggtaagtcgggaaaccgggaccccgtaacttaaccggttacgttacggttaccggtaacggggtttcgggttacggggtttaactttaccgtaacgttaaccgtaggtaacgttacgtaacgggtttcggggttacgggggttccgttaccgggggacggggtaaacccggggaccgtaaaccggtaccggtaccgggttacccgtaacccggttaaacggtcccgaaccggaccccggaacggtccccgtaccccggttcccccgtacggttccctacccgg

SEQ ID NO: 132446 - DNA, 742 bp, Homo sapiens
  misc_feature: GYAE6OF01BU9N5.10.39.D06.1.454.CMB.1.raw
  modified_base (539)..(539): a, c, t, g, unknown or other
  misc_feature (539)..(539): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctcgactcgacgcccacccgtcgggtcgtcgacggtccgggaccccgagggacacggaccggccacggtcgtcgtaccgtgggtacgggggaactaacgtaacgtaagttagggaaagttaagtccggttagtcgaccgtaacgtacggtaaccaggacgaacgggaacggtccgaacgggccaacggtccccgtaggttcggttcgttcgtactaagtaagttagaacgtaaccgacccggtccctacgacgggtacctccgtaggacgtcgtattcgtacgtcggtactaccgtaacgttccggacaaaccgccggtaccctacctacgactaccgactacccgacgggtacggggcgggaggggcccgggtaancgggaccggtaccgaacgttacgtaccggtggtcggaggttcgggtacggttactttcggaacgtttagcgtaactccggtaaggttcggggttacggggtccgttacgggacggggaacgtaccgaaggtccgttacgggacccgttacgaacggtccgaccggacccgaggtcccgacccggcccttcgggtcttaacccg

SEQ ID NO: 132447 - DNA, 858 bp, Homo sapiens
  misc_feature: GYAE6OF01APUGO.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacacgactctgtcgacctcctatgcgctcgactcacgccctacccgttcggtcgtcgacggttccgggaccccgaagggacgaccggaccggacccaccggtccgtacggtaaccgtggggtacgggggtaacctaacgtaaccgtaaaggttaacggggtaaacgttaaacgttccggttaggttacgaccgtaaccggttacggtaacccgacggaccgaggaccggaccgaacggcccgaccggtccccgttgggttcggttcgtcgttacttactaagtacggaacgtaacccggaccggtaccctacggacggtaccttccgacggtacgcttacttccgttcgtaccgtacctaccggtaacgttccggaccgaacccggacccgtcccctaacctccgtaactaccgtaccgtacccggtaccgggtcgggtaccggtacggggtacccgtgggaacgtaccgggaaccggtacccgtaaaccgttcgtaacccgttgggtaacgttcggggttggttaccggttaacctttaccggtaacttcgtacgttaccgtcgggttacggtttcgggggtaaccgggtttcgggacccgggtaaggggacccggtaccgtacggtcccggttaccgttacccgtaacccggtacgttacccggaccgggtaacccgtacgggttcccctcccccggttcccgggtccccgttaacccg

SEQ ID NO: 132448 - DNA, 754 bp, Homo sapiens
  misc_feature: GYAE6OF01B8VZS.10.39.D06.1.454.CMB.1.raw
  modified_base (77)..(77): a, c, t, g, unknown or other
  misc_feature (77)..(77): n is a, c, g, or t
tcagcatagtagtgcacgaccggtgctcgatttagtgacatctcgcagttctttggggctgggcctaaggaagcagnactggtggtgcctcagccatggcctggaccgttctcctcctcggcctcctctctcactgcacagactctgtcgacctcctagtgcgctcgtactcgacgcccacccgtcggtgtccgaggtccggcccgaggacgacgaccggccaccgctcgaccgtgggtagggggaactacgaactaagttaggaagttaagtcggtgtcgtcgtacgtacggtaacacgacaagggacggccgacggtacccgacggtccccgtggttcggtttgtccgtacttaagtacgtaggaacgtaaccgaccggtacccgtacggacgggaccttcccgaggacgtacgtacgttcgttacgtcggtaccgtacccgtaaggttccggtaaccgaaaccgtcccggaaccccttaccctacgtaccttacgaccgtacccgaacccgggtacggggacccggacgggggaccggtaacgtacgggaaccggtacccgtacgttaacggttcggtacgtaccggtgggttaggttacggttacgtttacgaaccgttagtcgtactcgtacggttggggttccgggtcgtacggggcggaacgggtaaccgaggtaccgtacccgggtaccttacggtcggaccgaccgtccggaacgcccgtcccggaccctggttaccctacccgg

SEQ ID NO: 132449 - DNA, 682 bp, Homo sapiens
  misc_feature: GYAE6OF01CHGFR.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccacccgtcggtgtcgacgtcggcccaggacacggaccggccacgctcgaccgtgggtagggggactacactaagttaggaagtaagtcgtgtcgacgtacgtacggtaccagacaggacggaccgacggccgacggccccgtggtcggttcgtcgtctaagtaacgtacgtaagtaaccggaccggcccctacgacggtaccgtcccgtaggaccgtcgtacgttcctcgtcggtcctaccgtaagttccggacaccgtaccggaccctacccgtctactacctagtaccgaaccggtacggggtaccggacggggaccgggtagtcggacggtaccgtacgtaccgtacgtacggtcgtagggtggtcggtattcgaaccgttagagtactcgtaggtcgggttacgggtcggttcgggacgggtacgggtaccgaggtccgtacggacccggttacggtacggtaccgacgaccgaggtcccgtaccgccccgttcgtccgttaccg

SEQ ID NO: 132450 - DNA, 821 bp, Homo sapiens
  misc_feature: GYAE6OF01CDG54.10.39.D06.1.454.CMB.1.raw
  modified_base (270)..(270): a, c, t, g, unknown or other
  misc_feature (270)..(270): n is a, c, g, or t
tcagcatagtagtgcacgaccggtgctcgatttagtgacatctcgcagttctttggggctgggcctaaggaagcagcactggtggtgcctcagccatggcctggaccttctcctcctcggcctcctctcctcactgcacagactctgtcgacccttcctatgccgctcgactcacgccctacccgtcggtgtccgaggtccggacccaggacacgaccggccacgctagaccgtgggtagggactacactaagttaggaagtacgcgtgngacgtacgtacgtacagacgagacggccgacggccgaccggccctggttcggttcgttacgtctaatagtagtaacgtaaccggcccgcccgttacggaacggtcctacccgtaggacgtacgttctttaccgtcggtcggtaccttacctaacgggttaccggaccaaacccggtacccggaccccacccttaccggaacttaccgacctaccggtaacccggaacgggggttaccgggaccgggggacgggtaacggttacggggaacgaccccggttaaccgtaaccgtaccgtcggttaccggagggtttcgggttaacgggtttacttaccgtaccgttacgttggtacttaaccgggtcggtttacgggggttacgggggtttccctacgggggtaacgggtaaccggggaaacccgttaaacgggtccggttaaacccggtaccccgggttaaccggttaaacccgacccgggttaaccgacccgggttaaccgggaccccttacccccgggttcccccggttaccggttcccttacccccggg

SEQ ID NO: 132451 - DNA, 677 bp, Homo sapiens
  misc_feature: GYAE6OF01DJ5GP.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccaccctcggtgtcagtcggcccaggacagacgccacgctgacctggtggggatacactaagttggaagtaatcgtgtgctacgtggtaaccagcaggacggccgacggccacggtccctggtcggttcgtcgtctaatagtgacgtaaccgaccggtcctacgaggactccgtgacgcgtattcgtctcggcctaccgtaagttccggacaacgacccggaccctaccctcaactctacgtaccgaccggtacggggtacggacggggtacccggggtatacggggaaccggtacccggtaacttaccgtacggttacggcggttaaggggttgggtacgggttacgttttaccgaacctttacgtacggtacttcgagttcggggttacggggttccgttcggggacgggtacgggacctacggtcgtaccggtaccgtaccgttaacggcctaccgggacccgtaacgggaccctcccggtacccccgtggtccctacccgg

SEQ ID NO: 132452 - DNA, 727 bp, Homo sapiens
  misc_feature: GYAE6OF01ESU2A.10.39.D06.1.454.CMB.1.raw
  modified_base (288)..(288): a, c, t, g, unknown or other
  misc_feature (288)..(288): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacggccacgctgacctggtgggggactacacaagttggaagtaatcgtgtgcactggaccagcagagcaggccgaggccctgtggttntcgtctatatgataacgaccgtcctcgagggactcccgtgacgcgtacttcgtcgtggacctaccgtaacgttccgggactaaaccgacccgggtaccccacccgttacgaacttccgacttacccgaacccggtacgggggtaccggaacgggggtccccgggggaaagttcgggaacgggtaccccgtaaccgttaaccgttaacgttcggtaccgtaggggtttacggttacgggggttactttaccgtaaccgtttaacgtggtaacgttccgtaaggttcggggtttacggggggttcccgtttaccgggggacggggtaaacggggtacccgaaacggttccggtacggttaaccccggttacgtaacgggttacccgacggtaccccgaacgggtccctacccggtaccccccggttcggtccttaccccgg

SEQ ID NO: 132453 - DNA, 753 bp, Homo sapiens
  misc_feature: GYAE6OF01CCO8P.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgccctacccgtcggtcgtcgtaggtcggccccgaggacacggaccggccacgctcgaccgtgggtgggggatacactaagtaggtaagtaagtcgtgtcgcacgtcggtaccagcgaggacggccgacggccgacggccccttgggtcgggttcgttcgtactataagtagtaacgtaaccggaccccggtcccgtacggacgggtacgttcccgtaggacgtacgtactttccgtcgttcggtcctacccgtaaggttcccgggacaacccgtacccggacccctaccctccgtactcgacctccgtaaccgggtacggggtccgggtacgggggccggggtacgtagggacggtacccggtactaaccgttcgtcggttacggtgggttacggtagggttacttcgtaaccttaggtaccgtattcgtaggttcggggtacgggggttccggtaccggggtacgggaacggggtaccaacggtcccggtacggtaacccggttacgtacggttacccgaaccggtaccccggtaaccggtcccgttacccccggcccccggttccggtacccttccccgg

SEQ ID NO: 132454 - DNA, 665 bp, Homo sapiens
  misc_feature: GYAE6OF01BPKQR.10.39.D06.1.454.CMB.1.raw
  modified_base (91)..(91): a, c, t, g, unknown or other
  misc_feature (91)..(91): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (470)..(470): a, c, t, g, unknown or other
  misc_feature (470)..(470): n is a, c, g, or t
tcagcatagtagtgcacgaccggtgctcgatttagtgacatctcgcagttctttggggctgggcctaaggaagcagcactggtggtgcctnagccatggcctggaccgttctcctcctcggcctcctctctcactgcacagactctgtcgacctcctatgcgctgactcacgccacccgtggtcgtcgacggtcggcccgaaggacacgaccggccacgctcgaccgtgggaggggactacactagttaggaagtagtcgtgtcgactacgttacggtacagcgaggaccggcgacggccgacggtccccgttggtacggttcgtcgtactaagtacgagtaacgtaaccggacccgtccgtaggacggtcctccgaggtacgcgtacttcgtacgtcgtactacgtacggtcgacaccgccgacactntacacnctacaccgacggtcgggacggtaccgggacgggtntacgggacgtacctaacgtactacgtggtcggtagggttcggtacgtacttcgaacttcgagtctaacgttggtccggggttggttccggtagggtaccgggtaacggtacgtaccggtcgtaacccggtacctacggttaccggtaccgccggtaacccgtaggcccgttacccggtccccggttgtaaccccg

SEQ ID NO: 132455 - DNA, 850 bp, Homo sapiens
  misc_feature: GYAE6OF01BCPLI.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgccctacccgtcggtgtcaggtccggcccgaggacacggaccggccacgctgaccgtgggtggggactacactaagttaggaagtagtcgtgtacgactacgtcggtaccaggacgaggacggacgtacggccgaccggtcccgttaggtgggttcgtcgttactaataagtaggtaacgtaaccggaccccggtcctacggaacgggtaccttccgaggacgcgttacttctacgtcggtacctaccgtaacggttccggaaccgtaaccgacccgggaccctacccgtactaccgttaccaacgttacccgaaccgggtacggggtacccggggaccggggtaccggggtaacgtacgggaaccgggtaccccgtaacgtttaaccggtacgttccgggtacggtacgggttcgggtttacgggttaaccttacgtaaccggttacgttacggtaacttaccggttaaggggtttccgggggtttacggggggtttacccggttaccggggggtacccgggaaaccgggggttaacccgtaacgggttaccggtaaacccgggtttacccggttaaacccgggtaaaccggttacccggacccgggtaaacccgggtaccgggttaccccggttaccccgggtcccccgtttaacccgggttcccgttaacccccgg

SEQ ID NO: 132456 - DNA, 808 bp, Homo sapiens
  misc_feature: GYAE6OF01AZL0A.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagcggccacgctgacctggtcggggatacactaagttggaaagtaagtcggtgtcgctacgtggtaccagacgagacgccgacggccacggccccgttggttcggttcgttccgtacttaagtaacgtcgtaacgtaaacccggtacccggtacccgtacgaacggtacttacccgtaggacgtacggtacgtttcctcggttcggtcccgttacccgtaaaggtttcccggggaaccaaaccgggtccccgggaccctaaccccgttaccgaacgttacccgtaacttacccgaaaccggtaccgggggttaaccgacgggggtaccccggggtaacgtacgggaacgggtaccccgtaacgttaccgttaaccgtacggttacggtaagggttcggggtttacggtaacttttacgaaccgttaacggttcgaaccgtttacggtaaggtttcgggttacgggggtttccgtacggggtaccggggtaacgggtaaccgtaacgggttccggttacccggtacccggttaacggtacgtaaccggtacccgtaccccggtaaacggtccccgttacccggtccccccggttaggtcccgttaccccgg

SEQ ID NO: 132457 - DNA, 812 bp, Homo sapiens
  misc_feature: GYAE6OF01BOGDY.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctctatgcgctgactcacgccctacccgttcgggtcgtcgacggtccgggaccccgaaggaccgacggacccggacccaccggctacggacccgttgggggtagggggaactaccgaacgtaagttacgggtaaagtaacgttccggttggtacgactaacggttacggtaacccaggaccgaacgggaccggacccgacggggaccccgaccgggttccccggttgggttcgggtttcggtccgtacgttaattaacggtcgtaacggtacccggaccccggtccctagggacgggtacctccgtggaccgtacgtacgttctcggtacgtccgtaccgtacggttccggacacccgtacccggcccctaccgctacgactactacccgacgggtacgggtccgggaacggggtacgggtaacggtcggaaccgggtacccgtaaccgttaccgtaccggtaggtaccggtaggggtttacggttagggttaacctttacgaaccgttagtaccgtagttacggttgggttacggggttccgggggttaccgtaccggggggacgggtaaccgggtaccgtacgggtcgtccggttaaccggtacgtacgccgacccgtaacggtcccgtacgtccccgtccccgtacgtccgtacccg

SEQ ID NO: 132458 - DNA, 865 bp, Homo sapiens
  misc_feature: GYAE6OF01DOD21.10.39.D06.1.454.CMB.1.raw
  modified_base (128)..(128): a, c, t, g, unknown or other
  misc_feature (128)..(128): n is a, c, g, or t
  modified_base (515)..(515): a, c, t, g, unknown or other
  misc_feature (515)..(515): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctntctcactgcacagactctgtcgacctctatgcgctagactcgacgcccacccgttcggtcgtcgaggtccgggacccccgaaggaccgacggaccggccgaccgcgtcgaccgtggtaggggaataccgaacgtaagttaggtaaagtagtcgtgtcgactacgtacggaaccaggacgaggacggacccgtaacggccccgaccgggttccccgttgggtttcgggtttacgtaccgttaccttaaaggttaacgtacggtaaccgtaaccggtaccccgtcccgtacgggacggtaccttcccggtaggaacgtcggtttaccttcgtacgtcggtacctaccgtaacttacggtacgggaaacccgaccgtacccccgtaaccnccggtaaccaccgtacccggaaccgggtaacggggtacgggaaccggggtaccggggtacgtacggaacccgggtaccgttaaacgttttcgtttaagtttaccgggtaacggtagggtttaggtttacgtttacgttttaacccggtaaggttttaaccgtttacgttacccggggtttaccggggttttccggggggttaacccggggaacggggttacccgggaacgtacggttccccgtaacgggttaccctacgggtaccctacggacccggttaccccggagtccccgttcccgccccggttacgtaccgtaccgttccccgttaaccgtccccccttaccccg

SEQ ID NO: 132459 - DNA, 774 bp, Homo sapiens
  misc_feature: GYAE6OF01A03Z9.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatcgcgctgactcacgcccctacccgtcggtcgtcgtacggtccggaccccgacggaccgacggacccggccaccgtccgtacggtacccgttaggggtaggggggtactaaccgacgtaaaggttagggtaaacgttaacgttcggtcgtacggacctacggtacgggtaaccaggacgaacgggacggacccgacgggaccccggtaccggtcccccgttagggtttcggttcggttaccgttactaacgttaagtacggtaacgtaaacccgggacccggtccccgtacggtaaccgggtaccttacccggtaggcggtaccgttacttccgtacgtcggtacctacgtacgttcccgggacaacccggacgaccccaccgtacactaccaacgttacccgaaccgggtacggggtaccgggacggggtaccgggacgtacgggaccggtaccgtacctactacggtcgtacggtagggttcgtacggttaccgttactacgttacgagtacgtaggtggttcggggtggggtccgtcgggacgggacgacgaccgtcgtaccgtaccgtacgcgtcgaccgtacggtaccaccgtcccgcccgtcgtctcccg

SEQ ID NO: 132460 - DNA, 744 bp, Homo sapiens
  misc_feature: GYAE6OF01ADZ7B.10.39.D06.1.454.CMB.1.raw
tcagcatagtagtgcacgaccggtgctcgatttagtgacatctcgcagttctttggggctgggcctaaggaagcagcactggtggtgcctcagccatcggccgtggtaccgttcctcctcctcggcctcctctctcactgcacacgactctgtcgacctcctatgccgctcgactcgacgccctacccgtcggtcgtcgtacggtccggacccgacggacgacggaccgccgaccgtcgtacggaccggtgggtacggggactaaccgaacgtaaggttacgggtaaagttaacgttcggtagtcgacgtacgttcggaaccgagacggacgacggccgacggccgaccggtcccgttgggttggttcgtcgtactaagtacacgtaacgaccggccggccgtacggacgtcctccggacgacgcgtacgtcgtcgtcgtactacgtacggttccggaaccaccgccgaccctactcactactacgtaccggaccgggtcggggtacgggacggggtaccgggacgtaccgggaccgaacccgtaactacggttaccgtacggtcggtaagggtcggttaagtccttaccgcggtagtggtacgtaacggtggttcggggttcggtccgggacgggtaccgggtacggaccgtcggtacccggtcggtaccccgttaggacccggaccgtacggaccccggtacggtccccgttaccccgggaccccgtccgttccgtaccccg

SEQ ID NO: 132461 - DNA, 616 bp, Homo sapiens
  misc_feature: GYAE6OF01CKWB5.10.39.D06.1.454.CMB.1.raw
  modified_base (372)..(372): a, c, t, g, unknown or other
  misc_feature (372)..(372): n is a, c, g, or t
  modified_base (466)..(466): a, c, t, g, unknown or other
  misc_feature (466)..(466): n is a, c, g, or t
tcagcatagtagtgcacgaccggtgctcgatttagtgacatctcgcagttctttgggctgggcctaaggaagcagcactggtggtgcctcagccatggcctggaccgttctcctcctcggcctcctctctcactgcacagactctgtgacctcctatgcgctgactcacgccacccgtcggtgtcagtcggcccaggacagacgcacgctcgacgtggtggggatacacgtaattaggaagtaagtcgtgtgacgtacgtggtaaccaggccaaggacggccgacgccgacggtcccctggtaggtttcgtccgtactataagtagaacgtaaccggacccgcctacggagggtaccttccgagacggtacnttcgttcgtggcctacgtaagtccggacaaaccgcgtaccccactcactacactacgaccggagggcgacggggcggataggacgtcatacgtntcggtacgtaggtcggtagtactttcgacttaagtgactagtaggtgggttcggggtacgccggggtaggaccggtaacgaacgcggttacgaccgttacgtaagcccgaagacccgtacggctacccggtccccgtggttcccacccgg

SEQ ID NO: 132462 - DNA, 944 bp, Homo sapiens
  misc_feature: GYAE6OF01EW3HX.10.39.D06.1.454.CMB.1.raw
tcagcatagtagtgcacgaccggtgctcgatttagtgacatctcgcagttctttggggctgggcctaaggaagcagcacgtggtggtcgcctcagccatcggcctggaccttctcctcctcggcctcctctctcactgcacagactctgtcgtacctcctatcgcgtctgtactacacgccctacccgttcgtacgtccacggtccggacccgaaggaccaacgggtacccggccgaaccgtcgtaccgtaccggttagggtacgggggtaaactaacgtaacgtaaaggtttacgggtaaaacgttaacgttccggtagtccgtaacgtacgttaccggtaaccgacggacctaaacggggaccgacccggaaccgggaccccgtaaccggggtacccccgtttggggtttcgggtttacccggtaaccggtttaaccttaaaacgttaacggtacgttaaaacccggtaaaaccccgggtaaccccggtaccccgttaaagggaaccgggttaacccgttcccgacggtaccgtaacgttccgttccgttccgtaacggttaccctacggtaaccgggttaccggaacaacccggtacccggtacccaaccgttactacgtacgtaccgtacccggaacggtacggggtaccgggacgggacgggttacaaccgggaccgtaaccgtacgtaaaccgttcggtacggtttacggagggttacgggttaacgtttacctacggttaaaccgtttaccggtacgttaaccgttagggtaacgggttttccgggggtaacggggtttcccggtaaccggggtacggggtaaccgggtaaaccggtaccggtaccgttaccggtacccggtaacgtaaccgtcccggaaaccgtcccgggtaaacgtcccccttaccgacccccgggttcccgttacgttaccccg

SEQ ID NO: 132463 - DNA, 873 bp, Homo sapiens
  misc_feature: GYAE6OF01A8I7I.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgccacccgtcggtgtcaggtcggccccgaggaccacggaccggccacgctcggaccgtgggacgggggactaacgacgaagttacggaaagttaagtcgtaggtgacctacggttacggtaccaggaccgaaggacgggaccgacggaccggaccggtccccgttggttcgggtttcggtccggttacttaagtaagtacggtaaacgtaaccggacccggtacctacggacgggtactccgtagacggtctagttccgtcgtcggtacctaccgtaacggttccgggaccaaacccggtcccggaacccctacccgtaccgtaaccgtaacgtccggaaaccggtacggggttaccgggaacgggacccgggggtataacggggaccgggtacccgttaaagttacgtttaacggtcggtaccggtagggttaggttacggtttaatttaccggtaaggtttaaccgttacgttttaccgggaccgggggtttttacccggggggggttaccggaaggggtaaccggggtaacccgtaaggttcccgggtaaccggttacccccggggttagttaacccgggggacccgttaaccggggaacccccggttaaacggggtcccccttcccggggtaaccccccttgggtaacccctttacgggtttcccccgggttccccgtacccccccgggtttcccccc

SEQ ID NO: 132464 - DNA, 708 bp, Homo sapiens
  misc_feature: GYAE6OF01B5KSS.10.39.D06.1.454.CMB.1.raw
  modified_base (471)..(471): a, c, t, g, unknown or other
  misc_feature (471)..(471): n is a, c, g, or t
  modified_base (508)..(508): a, c, t, g, unknown or other
  misc_feature (508)..(508): n is a, c, g, or t
tcagcatagtagtgcacgaccggtgctcgatttagtgacatctcgcagttctttggggctgggcctaaggaagcagcactggtggtgcctcagccagtggcctggaccgttctcctcctcggcctcctctctcactgcacagactctgtcgacctctatgcgctgactcacgccaccgtcggtcgtcgacggtcgacccgaggacgacgaccggccacgcgtacgaccgtgggtacggggactacgaacgtaaggttacggaaagttaacgtcgtagtcgactacgtacgtacgagacgaacggcggaccgacggccgaccggtcccgtgggttcggttcgtacgtactaagttacgtacgaacgtaacccggacccggtcccgtacggacgggtacctccggtaggacgtcgtacttccgtagtccggtacctaccgtacggtccggacaaccgtccgaccctacccgtnaccgtcacgaccgaccggtagggcgacgggcgggtancgggacgtactacgtacgtcgtcggtagtggttcggttaggttactcgtaagtactagtagttacgtagggttcgggggtcggtttacgggcgggaaacgggtacggtaacccgtaggtccggtaccggtaacgttaccggttagacccgccgtaacccgggacgttcccgacccggtacccgttcgtacccttacccgg

SEQ ID NO: 132465 - DNA, 785 bp, Homo sapiens
  misc_feature: GYAE6OF01EDFYV.10.39.D06.1.454.CMB.1.raw
  modified_base (164)..(164): a, c, t, g, unknown or other
  misc_feature (164)..(164): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgaccctcctatcgcgngtacgcctcacgcccgtacccgtcggtcgtcgacggtccggacccgaggacgacggaccggaccacgtcgtacggtaccgtgggtacgggggactaaccgtaacgtaaggtttacgggtaaaagtacgttcggtggacgtaccgtacggttacggaaccgagacggaacggacggaccgaacggccgacccgggtcccgttgggttcggtttacgtcggttacgttaactacggtacgtaaacgaacccggtcccggtacctacggacggtacctccgtagacggtcgtacttcgtcggtacgtcttacccgtaacggttaccggaacctaaacccggccggtacccaccgttacgtacctacgttaaccgaccgaaccgggtacggggtaccgggtacgggggaccgggttacgggacgggaccggaccggttacttaaccgtacggtcgttacgggtggttacggttgggttacttacgtacgtacggtacgtacgtcggttaggttcgggttacggggtcggttacgggacgggtaaccggtacgacggtacgtcccggtacgttacgtacgccgacgtacccggacgtacccgcccgtacgttccggccctacccgg

SEQ ID NO: 132466 - DNA, 626 bp, Homo sapiens
  misc_feature: GYAE6OF01BD33X.10.39.D06.1.454.CMB.1.raw
  modified_base (221)..(221): a, c, t, g, unknown or other
  misc_feature (221)..(221): n is a, c, g, or t
  modified_base (402)..(402): a, c, t, g, unknown or other
  misc_feature (402)..(402): n is a, c, g, or t
  modified_base (418)..(418): a, c, t, g, unknown or other
  misc_feature (418)..(418): n is a, c, g, or t
tcagcatagtagtgcacgaccggtgctcgatttagtgacatctcgcagttcttggggctgggcctaaggaagcagcactggtggtgcctcagccatggcctggaccgttctcctcctcggcctcctctctcactgcacagactctgtgacctcctatgcgctgactcacgccacccgtcggtgtcgagtcggcccaggacagacggccacgctgacctggnggggatacacgaattggaagtatcgtgtgcgactggtaccagcgagacggccacggccacggccccttggtggttacgtcggtctaataacgtgactaaccggacccggtccctcgacggacgtccgtgacggtcgtattcgtcgtgcctacaacgttcgggacaaccgaccgccaccctnactcgactaccgacgngggtacgacggggacggtacgtggacggaccgtacgtacgttacgtcgtacggaggttcggtcggtacttacgacgttacgtgtaactcggtaggttcgggttcggggtccggtcgggccggggtacggaccgaagtcccggtaggtacccggttacgtacggtccgacgacccggcgtaccgttacccggccccgttcgtcgtaccc

SEQ ID NO: 132467 - DNA, 798 bp, Homo sapiens
  misc_feature: GYAE6OF01BHY29.10.39.D06.1.454.CMB.1.raw
tcagcatagtagtgcacgaccggtgctcgatttagtgacatctcgcagttctttggggctgggcctaaggaagcagcactggtggtgcctcagccagtcggcctggtaccgttctcctcctcggcctcctctctcactgcacagactctgtcgacctctatgccgctgactcgacgccctacccgtcggtctacgacgtcggaccccgaggacgacggaccgggccacggtccgtacgaccgttggggtacgggggaactaaccgtaacgtaaaggtttacgggtaaaacggtaaggttcggttgtccggtacgaacgtttcggaaccgacgacgaaggaccggaccgaggccccgacggtcccgtaggttcgggttcgttacgtaaccttaagtaacgtacgaacggttaaccgaccggtcccttacggaggtacctccgtggacgtccgtacgttccgtcgtaccggtataacccttaaggtttcggacccgtaaccgaccggttacccaacccgttacaactctaacgtacccgaacggaacgggttcggaacgggacccgggtagacgggaaccgtaccgtaacgtaaccgttacggtacgtacggtacggtacgggttacggtaactttaccgactttacgacgttacgttacgtaaggtttcggggtacggggttaccggttaccgggaacggggaccggtaacccggtaagtccggttaccgtaaccggtacgtaacccgttacgacccgttaacgaccggtctaccccggttcccgtccgtaccgtaccg

SEQ ID NO: 132468 - DNA, 892 bp, Homo sapiens
  misc_feature: GYAE6OF01A7084.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccacccgtcggtcgtcaggtccggccccagggacaggaccggtccaccgctcggaccgtgggtagggggaactacacgtaagttagggaagttaacgttcggtggtgaccgtacgttcggtaaccaggcaaggcggaccacggacccgacggtcccccgttgggttcgggtttcgttccgtaccgttaagtaacgttaggaacttaacccgggaccccggtaccccgtacgggtaaccgggtaaccttcccggtggaacggtcccgtaatttcccgtcgttcggaccttacccgtaaggtttccggggaacccttaaacccgggacccgggtaccccttaccccgttaccgtaaccgttaccgtaacccgtacccgtaaacccgggtacgggggtacccgggaccggggggtaacccggggtacggtaacggggaacccgggacccgtaaccggtttaaaccgttcccggttacgggtacggtaaggggttcgggttccgggttaactttttaccgaccgtttaggtaccgtacggttaccgttacggtttacgggggttacgggggtttcgtacccggggtacggggtaacgggtaacccgaaccggttccggtacccgggttaacccgggtacccgtaaacgggtcccgaaccggtaccccggtaaccggttccccgtaccccgggttcccccgttccggttacccgttacccccgg

SEQ ID NO: 132469 - DNA, 812 bp, Homo sapiens
  misc_feature: GYAE6OF01BNPOO.10.39.D06.1.454.CMB.1.raw
  modified_base (266)..(266): a, c, t, g, unknown or other
  misc_feature (266)..(266): n is a, c, g, or t
tcagcatagtagtgcacgaccggtgctcgatttagtgacatctcggcagttctttggggctgggcctaaggaagcagcactggtggtgcctcagccatggcctggaccgttctcctcctcggcctcctctctcactgcacagactctgtcgacctcctatgcgctagctcacgccaccgtggtctcgagtcggcccgaggacagacggccacgtctcgacgtgggacggggatacacgtaagttacggaaagttacgttcggtagngtccgtacgttcggaaccaggaccgaaggacggccgaacgggccgaacggtccccgttagggttcggttacgttccgttacgttaacgtaacgttcggtaaaccgtaaacccgggtacccggtcccgtaacgggtaaccgggtaacgtccccgttaggaccgggtaccttacgtttaaccggtccgttacgggtaccttaccggtaaacggtttccggaacccgtaaaccgtacccgggtcccttaaacccgtcacgttaccacgttaccggaaccggtacgggggttaaccggacggggtacccggggtaagtccggggtaaccggtaccgaaccgttacgtaaccggttggtaacgtcgggttacggttacggttacctttaaccggaactacggttacgacggtttccgagggttacggggttccggggttacggttacggggcgggtaacggtaccgaacggttccgttaccggtaccggttaccgaacggtccgaacggtcccgtaactccgggtaacccgccgtcggttacccgtaccgg

SEQ ID NO: 132470 - DNA, 809 bp, Homo sapiens
  misc_feature: GYAE6OF01E11IT.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcgcctcctctctcactgcacagactctgtcgacctcctatgcgctgactcacgcccacccgttcggtgtctacggtcggcccgaggacgacggacggccacgcgtcgtaccgtgggtgggggtaactacacgtaagttaggtaaagttaacgttcggtgtcgactacgtacggtaaccgacgacgaggacggccgaccggccgacccgggtcccgttgggttcggtttcggttaccgttacgttaaagttaacgtacggtaaccgttaaccggaccccggtacccgtacgggaacggttaaccgtcccgtacggacgaccggttaacttccgttcgtccggtcccttaaccgttaaccgggttaccgggaacccgtaaccggaccccggtacccccgtaaccctaccgtactacctaccgtacccggaacccggtacggggtaccgggaccgggggaccgggtacgacgggtaccgggacccggttaaccctacgtttaccgttcggtacggtagggttcggtcggtttaaccttcgtaacgttacgtagtacgttacgttagggttcgggtttacgggggttaccgtcgggggaacggtaccgggaaacggcgtaccggtcggtacccgttacgtaccggagacccggaccgtaccggtccctacccgtcccccggtgtcgttaccccgg

SEQ ID NO: 132471 - DNA, 750 bp, Homo sapiens
  misc_feature: GYAE6OF01ATUNB.10.39.D06.1.454.CMB.1.raw
tcagcatagtagtgcacgaccggtgctcgatttagtgacatctcgcagttctttgggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacacggacggccacgctcgaccgtggtagggggactacgacgaaagttagggaagtaatccggtggtcgctacgtcggtaccagccaggacggccacggccacggcccctggttcggttcgtccggttactaagtactggacgtaaccgacccgggcctacggacggtactcccgtgacgcgtattcgtacgtcggccttaccgaacggttccggggaaccctaacccggacccgggtaccccaccccgtcacctaccgtaccgtaccgaaccggtacggggttaccgggaccggggaccggggtaactacgggaaccgggtacccgtaaccgttaaccgttacggtcgggtaccgtagggttcgggtaggttacgtttacaccgttacgtgtacgtgtacggttcggggttacggggttcgttaccgggacgggtaaccgggtaccgaacggtccggtaccggttacccgttaccggtaacggttacccgaaccggtacccggtaaacggccccgttacccgggtacccccgttccgggttcccttaccccgg

SEQ ID NO: 132472 - DNA, 818 bp, Homo sapiens
  misc_feature: GYAE6OF01BMR7X.10.39.D06.1.454.CMB.1.raw
  modified_base (348)..(348): a, c, t, g, unknown or other
  misc_feature (348)..(348): n is a, c, g, or t
tcagcatagtagtgcacgaccggtgctcgatttagtgacatctcgcagttcttggggctgggcctaaggaagcagcactggtggtgcctcagccatggcctggaccgttctcctcctcggcctcctctctcactgcacagactctgtgacctcctatgcgctgactcaagccaccctcggtgtcaggtggccccaggacagacggccacgctgaccgtgtgggggactacacaagttggaagtaatcggtgtagcaacgtggtacccagtcagaggccaggccaaggcccctggtcggttgtcgtctagtaacgtgactaacgaccgcccttcgacgggtactcccgngaaccgcgtacttcgtcgtcggctcccgtaaagttcccggggactaaaccgaccgggtaccctaccccgtactaacgtacccgaatacccgtacccggtaacgggggtaccggaacggggtaccccgggggtaactcgggtaaaccgggacccggtaaccgttaaccggttaaacccgttccgggttaccggtaacgggtttacgggttaccggggtaaacgttttacccggtaaccgttaaccggttacgttaacgttaccccgttaaggtttacggggttacggggggttacccggtttaccgggggtaccgggggttaaaccgggggacccttaaaacggggtcccggttaacgggtaacccccggtttaccggtaaaccgggttacccgtaaccggggtaacccccgtaaacggggtcccttaacccgggtcccccccggtaaccggggtacccgtttaaccccgg

SEQ ID NO: 132473 - DNA, 841 bp, Homo sapiens
  misc_feature: GYAE6OF01BFYVW.10.39.D06.1.454.CMB.1.raw
  modified_base (312)..(312): a, c, t, g, unknown or other
  misc_feature (312)..(312): n is a, c, g, or t
tcagcatagtagtgcacgaccggtgctcgatttagtgacatctcgcagttctttggggctgggcctaaggaagcagcacgtggtggtgcctcagccatggcctggaccgttctcctcctcggcctcctctctcactgcacagtactctgtcgacccttctagtcgacgtcgtagactcgacgccctacccgttgggtcgtctacggtccggaccccgaggacacggaccggccacgcgtcgtaccggtgggtaggggtactacgaacgtaaggttaggaaagtacgtcgtagtcgacctaggttaccgacgngacgaaggccggccgacggccgtaccggtcccgttaggtcggttcgttcgtataacgttagacgtaacgtaacccggccccgtccgtacggacggtaccgtccgaggtcgtacgttacgttccgtgtccgtaccgtaacgtacgggtccggaaccaacccggtcccgaccccgtaccgtactacctcgtaaccgtacccggaacggggtaccgggggtaccgggaccgggggtaccgggtaacggtacgggaacccggtaccgtaaccgttaccgtaccggtcggtacgggttcgggttacgggttaccgttaactttaccggtacgttacggttacgtacgttaccggtttggggttcggggggtttccgggtacgggttacccggggggaacgggtacccggtaccggaccggttttaccgggacccggtttaacccgtttacggttaaccgggaccccgtaaccggtacccgggttccccgtaccccgttaccccggttacccgttacttaccccggtttccccgg

SEQ ID NO: 132474 - DNA, 677 bp, Homo sapiens
  misc_feature: GYAE6OF01DJJNW.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcagcccacccgtcggtgtcagtcggccccaggacagacgccacgctgacctggtggggatacacgtaagttaggaagtatcgtgtgacacgtggtaccagcgaggacggccaggccacggtccctggtaggttcgtcgtactataatcgtaagtaccgaccgccctgacggactcccgtggacgcgtacgttactcgtcggtcctaccgtaacggttccgggacaaccgacccggtaccccacccgtacgtactaccaactaccgaccggtacggggtaccggaacggggcccgggagtcgggaaccggccgtaactaccgtacgtcggacgtagggtcgtagggttcttacgtactacgtgtacgttcgtaggttcgggtcgggggttccgtcggggaacgggtaccgggaaccgtaggtaccggttaccggacccgttacggttaacggaccgtaccgaccccggtaggtaccccgttcccggtccccccggttgtacccttcccgg

SEQ ID NO: 132475 - DNA, 817 bp, Homo sapiens
  misc_feature: GYAE6OF01BOBTQ.10.39.D06.1.454.CMB.1.raw
  modified_base (259)..(259): a, c, t, g, unknown or other
  misc_feature (259)..(259): n is a, c, g, or t
  modified_base (315)..(315): a, c, t, g, unknown or other
  misc_feature (315)..(315): n is a, c, g, or t
  modified_base (418)..(418): a, c, t, g, unknown or other
  misc_feature (418)..(418): n is a, c, g, or t
tcagcatagtagtgcacgaccggtgctcgatttagtgacatctcgcagttctttggggctgggcctaaggaagcagcactggtggtgcctcagccagtcggcctggaccttcctcctccgtcggcctcctctcctcactgcacagctctgtcgacctctagtcgcgtctacgactccacgccctaccggtcggtctcgtaggccggacccgaaggaccgcggaccgaccacgtcgtcgacggttggggagggtaacaanaacgtaaggttagggtaaacgttagtcggtagtacgccgtaacggttaccgaacgnggacctaggaccggcgaaccggtccgacggtccgttggtagttcgtactagtaacgtataaccggtaacgtacccggaccgttacccagggacgtaacgtccnggtacgtccgttatccgtaggcgtaccttaaccgacggttaccgaacgaacccgtccccggtactacccgataccgtccgtaaacgtcccgaaaggggggtaccgtccgggggaaaccggtccgggggtaaacgtacgggtacccgggtaacccttaaccgggttaccgtaacggtttaccgggtacgggtaagggttcccggttaggttacccttaggtaaaccgttcgtaggtacttacgggtgggttccgggggttacggttaccgggcgggttaaccgggagtaacccggtaaggtcccggttaccgaaccccgggttactaaacggggccccggtaactaccccgggtccgtacccggttacccccggaccttaacccggtttccgtacccccg

SEQ ID NO: 132476 - DNA, 731 bp, Homo sapiens
  misc_feature: GYAE6OF01AN7KW.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctactctcactcgcacagactctgtcgacctcctatgcgactgactcacgccaccctcggtcgtcagtcgcccaggacacgacggcacgctgacctggtggggactacactaagttaggaacgtaagtcgtagtcgctacgtcgtacacgcagacgcacggcacggccctgtggttagtctcgtaatactagtaacgtaaccgaccgtcctacgacggtactcccgagacgtactacgtctcgtcggtcctaaccgtaacgttaccggaaccgacgaaccggtacccacccgtacctactacctacgtaccgaaccgtacggggtccggaacggggcccgggtaacgtacggacgggtacctaacccgttaacgtacgttccgtacgtaacgggtcgggttacggtaacctttacgaaccgtttaccggtagtaacgggttaccctaagggttcggggtttacggggtaccggtttccggggacggggttaaacgggaacccgtacgggtacgtccgggaaccccttacggttacggaacccgtccgttaaaccccggaacgggttaccttacccccggtaccccggttccccgttcgtaaccccg

SEQ ID NO: 132477 - DNA, 906 bp, Homo sapiens
  misc_feature: GYAE6OF01BJGUA.10.39.D06.1.454.CMB.1.raw
tcagcatagtagtgcacgaccggtgctcgatttagtgacatctcgcagttctttggggctgggcctaaggaagcagcactggtggtcgcctcagccatggcctggaccgttctcctcctcggcctcctctctcactgcacagactctgtcgaccctcctatcgcgtctacgacctcgacgccctacccgttcggtcgtcgaggtccggacccgaggacacggaccggccacgcgtacgaccgtaggggtaggggaacttacgaacgtaaggttaggtaaagttaagtccggttgacgtaccgtacgttaccggaaccaggacgaggaccggccgacgggacccggaccggtccccgttggtttgggttccgttacggttaacttaagtaaaggtcgtaaccgtaacccgggacccggtcccgtaacggacggtaccgtcccgtaggacgtcgttacttcgcggtacgtaccgtaccgtaacggttccgggaaccaaccggacccgtacccgaccctactacgtacgaccgtacccggaacgggttcgggtaccgggaaccgggggtcccgggtaagtaccggggtaacccgggtaacccgtaacgtttacccgtaacgggtacgggttaccggtaaggggtttcgggttaacccggtttaacgtttaccgtaaaccgttaacgttcgggtaaaccgtttaccggttaaggggtttcggggttaaccggggggtttacccgtaccggggggtaacgggaaacccgggttaccggaaggttaccccgggttacccggtaaccggtttaaacccggttaaacgggtccccgggtaaacccgtaacccccggggtaacgggttcccccgtacccgggttaccccccgttaggttacccgttaacccccgg

SEQ ID NO: 132478 - DNA, 555 bp, Homo sapiens
  misc_feature: GYAE6OF01ASY6Y.10.39.D06.1.454.CMB.1.raw
  modified_base (389)..(389): a, c, t, g, unknown or other
  misc_feature (389)..(389): n is a, c, g, or t
  modified_base (421)..(421): a, c, t, g, unknown or other
  misc_feature (421)..(421): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacagaccggccacgctgacctggtgggggatacacaagttaggaagtatcgtgtgcactcggtaccagcagacggccaggccacggcccctggtggttcgtcgtctatatgataaccgccgccctgacggctcccgtgacgtcgtacttctacgtggcctacctagttcggacaacgaccggcccaccctnactacactccaccgagggtcgacgggcggganggacgccgactacgtcgtgtcgaggtcgtggtacttcacgtactgtactcgtagtggtcggggtctcgggcggagaccgaggccgtcgaccgtctagccaggacccgtaggcctacccgcccgtcgtcctaccg

SEQ ID NO: 132479 - DNA, 735 bp, Homo sapiens
  misc_feature: GYAE6OF02FGGMT.10.39.D06.1.454.CMB.1.raw
  modified_base (170)..(170): a, c, t, g, unknown or other
  misc_feature (170)..(170): n is a, c, g, or t
  modified_base (184)..(184): a, c, t, g, unknown or other
  misc_feature (184)..(184): n is a, c, g, or t
tcagcatagtagtgcacgaccggtgctcgatttagtgacatctcgcagttctttgggctgggcctaaggaagcagcactggtggtgcctcagccatggcctggaccgttctcctcctcggcctcctctctcactgcacagactctgtgacctcctatgcgctgactcgcncccaccgtgtcacngccgaccgagacgacggccgccgacgcgtacgtaccgtggggtagggactacaactaggtaggtaaattacgtcggttgcgacctacggttaccggtaaccgacgacgaagggacccggaccggaccggaccggacccgtccccgttgggtttcggttcgtcgttacttaaattaagagtaaacgtaacccgggacccgtcctacgggaggtacccttccgaggacgcgttacttcctcggtcggtccctaacgttaacgggttccgggaaccaaccggacccggacccctaccctactactactacctacccgaaccggggttcgggacgggaccgggggaccgggtatacggggacccggacctaaccgttacctacgtcgtacggtagggttgggtaggtttaccttacgtaaccttacggtagtactacgtaggtttcggggggtcgtttcggtcgggacggggaccggacgagcgtaccggacccgttaacgtacgtcgacccgtaaccggacggtccgtccccgccccggttcggaccttacccg

SEQ ID NO: 132480 - DNA, 500 bp, Homo sapiens
  misc_feature: GYAE6OF02G5UDY.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctcaattcgggcaacacggccaccctcatcatcaccagggtcgaggccggggatgaggccgactactactgtcaggtgtgggatttcactactgatcatgtggggtcttcggcgaggcagcgtgaccgtctaagtcagccaggctcgcccctcggctacg

SEQ ID NO: 132481 - DNA, 542 bp, Homo sapiens
  misc_feature: GYAE6OF02IRV68.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacggccacgctgacctgtggggggatacacaattggaagtaatcgtgtgcactggtaccagcagaggccaggccaggcccctgtggttgtcgtctataatgataacgaccggcctcagggatccctgagcgattctctggctccaattcgggcaacgcggccacctcatcatcacagggtcgaggccgggatcggacgccgactactacgtgtcgagtgtgggatttcaactactgactcgatggtaggggtctcgggacggtacgggaccgaagcgtacggaccgttccgtaaggtccgacgtccccgaagggccttcggccccccgttaggtacctacccg

SEQ ID NO: 132482 - DNA, 519 bp, Homo sapiens
  misc_feature: GYAE6OF02GWXIQ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccgccctcagggatccctgagcgattctctggctccaattcgggcaacacggccaccctcatcatccaccagggtcgaggccggggatggacgggccgacgtactacgtgtcgaggtgtgggatttcactactgatcagtgtggggtcttcgggcgagggacaggcgtcggaccgtcgtaagtcagcccaggcctcggcccctggtctaccg

SEQ ID NO: 132483 - DNA, 514 bp, Homo sapiens
  misc_feature: GYAE6OF02GBHVA.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggcctcagggatccctgagcgattctctggctcaattcgggcaacacggccacctcatcatcaccagggtcaggccgggatggaggccgactactactgtcaggtgtgggatttcgactactgatcagtgtggggtcttcgggcggagggtaccaagcgtggaccgtccgtaagtcagcccaaggcctcgcccctcggtctaccg

SEQ ID NO: 132484 - DNA, 543 bp, Homo sapiens
  misc_feature: GYAE6OF02I9GT9.10.39.D06.1.454.CMB.1.raw
  modified_base (360)..(360): a, c, t, g, unknown or other
  misc_feature (360)..(360): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggactccctgacgcgattctctggctccgaactctgggaacncggccaccctgaccatcacacgggtcgaagccgggatcggaggccgactagtattgtcaggtgtggtatttcgagttagtacttcgtacgttccgggggttttcggacggtagggtaccgaagtcgtggaccgtcgtaggtcgacgcccgaaggtcctcggcccccgtcggtcaccgtctccg

SEQ ID NO: 132485 - DNA, 466 bp, Homo sapiens
  misc_feature: GYAE6OF02IBH7D.10.39.D06.1.454.CMB.1.raw
  modified_base (286)..(286): a, c, t, g, unknown or other
  misc_feature (286)..(286): n is a, c, g, or t
  modified_base (456)..(466): a, c, t, g, unknown or other
  misc_feature (456)..(466): n is a, c, g, or t
tcagcatagtagtgcacgaccggtgctcgatttagtgacatctcgcagttctttgggggagagactgaagaacccagcattgcagcagctccaccatggcctgggctcctctgctcctcaccctcctcagtctcctcacagggttgactcagccaccttctgcatcagcctccctgggagcctcggtcacactcacctgcaccctgaacagcgactacatcttgggctcaggcctcaatcggtgcctgaccaccaacaacatctacgaagaggtgagagtgtcctnactgtgggcagacaatggcagtgggagcaatttcgtgagagtgttcggcggagggaccaacgtgaccgtcttcctaggtcagcccaaggctcgcccctggtcactctgttccccaccctcctcccacttactactcgcttcgaggccggctcgggcaagggcgcgatagnnnnnnnnnnn

SEQ ID NO: 132486 - DNA, 508 bp, Homo sapiens
  misc_feature: GYAE6OF02GE2H9.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccaggtcgaggccgggatgacggccgactactactgtcaggtgtgggattcactactgatcatgtggggtcttcggcggaggacaagcgtgaccgtctaagtcagcccaaggcctcgccccgtcggtctaccg

SEQ ID NO: 132487 - DNA, 573 bp, Homo sapiens
  misc_feature: GYAE6OF02ISCKX.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctggtggttgtcgtctataatgataacgaccggccctcagggatccctgagcgattctctggctccaattcgggcaacgacggccacccgtcactcactccaccgaggggtcgacggggcccggggtaatcggaagggcccgaactaccgtaacgtcgtacgagggttggtagggtattttcgacgttacgtagtacgtactagtgggttcgggttcgtacgggcgggaacgggacgacgtcgtacggaccgtacgtacgacgacgccgacgccgtcccgcccgtccgctcccg

SEQ ID NO: 132488 - DNA, 552 bp, Homo sapiens
  misc_feature: GYAE6OF02HJV52.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccaggccctgtggttgtcgtctataatgataacgaccggccctcagggactccctgagcgattctctggctccaattcgggacaacgacggccaccctcactcactcaccgagggtcggagggccggggatggacggccgactacgtactgtcgaggtgtgggtatttcacgttactgtatcagttggtggggtcttcgggcgggagggaccaaggtcgtacggacccgttacgtaacgtccgacgacccgaaggcctccggcccccgtcggtcctaccg

SEQ ID NO: 132489 - DNA, 518 bp, Homo sapiens
  misc_feature: GYAE6OF02IXF7E.10.39.D06.1.454.CMB.1.raw
tcagcatagtagtgcacgaccggtgctcgatttagtgacatctcgcagttctttggggcttgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcgagggatccctgagcgattctctggctccaattcgggcaacacggccaccctcatcatcaccagggtcgagggccgggatgacggccgactactactgtcaggtgtgggatttcactactgatcattggtggggtcttcgggcggagggaccaagcgtggacccgtctaagtcagcccaaggctcgccccctggcctaccg

SEQ ID NO: 132490 - DNA, 512 bp, Homo sapiens
  misc_feature: GYAE6OF02JBUIC.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccgggatgaggccgactactactgtcaggtgtggatttcactactgatcagtgtggggtcttcgggcgagggaccagcgtggaccgtctaagtcagcccaaggcctcgccccctcggtcctaccg

SEQ ID NO: 132491 - DNA, 511 bp, Homo sapiens
  misc_feature: GYAE6OF02GSWI7.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccacctcatcatcaccagggtcgaggccggggatggacggccgactactactgtcaggtgtgggatttcactactgatcgatggtggggtcttgggcggagggaccagcgtgaccgtctaagtcagcccaaggcctcgccccgtgtctacg

SEQ ID NO: 132492 - DNA, 616 bp, Homo sapiens
  misc_feature: GYAE6OF02HNSTC.10.39.D06.1.454.CMB.1.raw
  modified_base (406)..(406): a, c, t, g, unknown or other
  misc_feature (406)..(406): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctccctctctcactgcacagactctgtcgacctcctatgcgctgactcacgcccacccgtcggtgtcaggtcggccccgaggacaggaccggccacgctcgaccgtgggtggggactacaactaagttaggaaagtaatcgtgtcgcacgtggtaaccagcaaggaggccgaggccacggccctggtggttgtcgtctataatgataacgccggcctgaggactccgtgacgcgtattctcgtggctaccgtaagttccgggacaaacgaccggcccacccgtnactcatccaccgagggtcgacgggccgggatcggacggcccgaactaccgttacgtgacgtagggtcggtagggtactttcgacttactgatcgtagtggggttcggggttcttcggggcgggaacgggaccgtaaggtccgtacggtacccggttacgtaacggtccgacgacccgaagggcctccggcccccgttcggtcccgtaccg

SEQ ID NO: 132493 - DNA, 513 bp, Homo sapiens
  misc_feature: GYAE6OF02JFS5B.10.39.D06.1.454.CMB.1.raw
  modified_base (426)..(426): a, c, t, g, unknown or other
  misc_feature (426)..(426): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccgggatggaggcccgactactacgtgtcaggtgtgggntttcactactgatcagtgtggggtcttcggcggaggaccaaggcgtgaccgtcgtaagtcagcccaggcctcgcccctcggctaccg

SEQ ID NO: 132494 - DNA, 527 bp, Homo sapiens
  misc_feature: GYAE6OF02HXS80.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgacgggcgggatggaggccgactactacgtgtcaggtgtgggatttcgactactgatcagttgtggggtcttcgggcggagggaccaaggcgtggacccgtctaagtcgacgacccgaaggcctcggccccctcggtcctaccg

SEQ ID NO: 132495 - DNA, 511 bp, Homo sapiens
  misc_feature: GYAE6OF02G7H5M.10.39.D06.1.454.CMB.1.raw
  modified_base (336)..(336): a, c, t, g, unknown or other
  misc_feature (336)..(336): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattcnctggctccaattcgggcaacacggccaccctcatcatcacagggtcgaggccgggatgaggccgactactactgtcaggtgtgggatttcactactgatcagttgtggggtcttcgggcggagggacaagcgtggaccgtcctaagtcagcccaggcctcgcccctggtctaccg

SEQ ID NO: 132496 - DNA, 532 bp, Homo sapiens
  misc_feature: GYAE6OF02IPH0C.10.39.D06.1.454.CMB.1.raw
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtggggatacacaattggaagtaatcgtgtgcactggtaccagcagaggccaggccaggccctgtggttgtcgtctataatgataacgaccggccctnagggactccctgagcgattctctggctccaagttcgggcaacacggccaccctcatcatcaccngggtcgagggccgggatgaggccgactactacgtgtcgaggtggtggatttcattactgatcgagttggttggggtcttcgggcgggacgggacagcgtggtaccgtacctacgtcacggacccgaacggcctccggcccccgttcggctaccg

SEQ ID NO: 132497 - DNA, 526 bp, Homo sapiens
  misc_feature: GYAE6OF02G2GFL.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggccccaggacagacggccacgctgacctgtgggggatacacaattggaagtaatcgtgtgcactggtaccagcagaggccaggccaggcccctgtggttgtcgtctataatgataacgaccggccctcagggatccctgacgcgattctctggctcaattcgggcaacacggccacccgtcactcatcaaccagggtcgacgggccgggatggacggccgactacgtactgtcaggtgtagggtatttcgatacgtgatcagttggtaggggttctcgggcggaggacgaagcgtgaccgtctaagtcagaccaggcctcggcccctggtctaccg

SEQ ID NO: 132498 - DNA, 536 bp, Homo sapiens
  misc_feature: GYAE6OF02IZ0EK.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctgctccaattcgggcaacacgccaccctcatcactcaccagggtcgagggccggggatggacggccgactactactgtcgaggtgtggatttcacgtactgatcagtggtcggggtcttcgggcggagggaccaagccgtcggtacccgtacgtaagtcgacgacccgaaggtccgtaccgcccccgtcggtcctaccg

SEQ ID NO: 132499 - DNA, 488 bp, Homo sapiens
  misc_feature: GYAE6OF02IIUKR.10.39.D06.1.454.CMB.1.raw
  modified_base (180)..(180): a, c, t, g, unknown or other
  misc_feature (180)..(180): n is a, c, g, or t
  modified_base (285)..(285): a, c, t, g, unknown or other
  misc_feature (285)..(285): n is a, c, g, or t
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
  modified_base (413)..(413): a, c, t, g, unknown or other
  misc_feature (413)..(413): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (469)..(470): a, c, t, g, unknown or other
  misc_feature (469)..(470): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (485)..(487): a, c, t, g, unknown or other
  misc_feature (485)..(487): n is a, c, g, or t
tcagcatagtagtgcacgaccggtgctcgatttagtgacatctcgcagttctttgggggagagactgaagaacccagcattgcagcagctccaccatggcctgggctcctctgctcctcaccctcctcagtctcctcacagggttgactcagccaccttctgcatcagcctccctgggancctcggtcacactcacctgcacctgaacagcgactacatcgttgggctcaggcctcaatcggtgcctgaccacaacaacatctacgaagaggtgagagtgtcccncactggtgggcagacaatggcaggtggancaagtttcgngagagtgttcggcggaggaccaacgtgaccgtcttcgagtcacgccaaggctcgcccctgtcactctcgtccaccctctccactactancgctggacgccgggcgtcggacgaacgggtccgactaaccgtagcncgngcgcncnncncncgcgcncngcnnnc

SEQ ID NO: 132500 - DNA, 511 bp, Homo sapiens
  misc_feature: GYAE6OF02F1FT7.10.39.D06.1.454.CMB.1.raw
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
  modified_base (452)..(452): a, c, t, g, unknown or other
  misc_feature (452)..(452): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtgggttgtcgtctataatgataacgaccggccctcagggatccctgagcgattcnctggctcaattcgggcaacncggccaccctcatcatcaccagggtcgaggccgggatggaggccgactactactgtcaggtgtgggtattcactactgatcatgtgggtctcggnggaggaccgaagcgtgaccgtcctaagtcagcccaggcctcgcccccgtggtcctaccg

SEQ ID NO: 132501 - DNA, 513 bp, Homo sapiens
  misc_feature: GYAE6OF02G9RGA.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggcctcagggatccctgagcgattctctggctcaattcgggcaacacggccaccctcatcatcacagggtcgaggccgggatgaggcccgactactactgtcaggtgtgggatttcgactactgatcagtggtggggtcttcgggcgagggaccaaggcgtggaccgtctaagtcagcccaaggcctcggcccctggtctaccg

SEQ ID NO: 132502 - DNA, 575 bp, Homo sapiens
  misc_feature: GYAE6OF02HW0LD.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcgagggactcccgtgagcgattctctggctcaattcggacaacacggccaccctcatcatccaccgagggtcgagggcgggatggacggccgatactactgtacaggtgtggactttcgacttacgtgtactcgaagttggtcgggggtacttcggggacgggtacgggtaccgaaggtccgttacggacccgttaccgtaaaggtcccgaacggtaccccgaagggcccttccgggacccccgttcggtacctaacccg

SEQ ID NO: 132503 - DNA, 542 bp, Homo sapiens
  misc_feature: GYAE6OF02IHGE5.10.39.D06.1.454.CMB.1.raw
  modified_base (370)..(370): a, c, t, g, unknown or other
  misc_feature (370)..(370): n is a, c, g, or t
  modified_base (431)..(431): a, c, t, g, unknown or other
  misc_feature (431)..(431): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacggccacgctgacctggtgggggatacacaattggaagtaatcgtgtgcactggtaccagcagaggccaggccaggccctgtggttgtcgtctataatgataacgaccggcctcagggactccctgagcgattctctggctccaagttcgggcaacgacggccaccctnactcatcaccagggtcgaggccggggatggacggccgactactactgtcgagggtgtgggntttacgacttactgatcgagttggtcggggtctcgggacggacgggaccgaggtcgtcggcccgtacgtacgtacgacgacccgaaggccgtacgcccccgtgtcctaccg

SEQ ID NO: 132504 - DNA, 557 bp, Homo sapiens
  misc_feature: GYAE6OF02IFEH5.10.39.D06.1.454.CMB.1.raw
  modified_base (316)..(316): a, c, t, g, unknown or other
  misc_feature (316)..(316): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaagttggaagtaatcgtgtgcactggtaccagcagaggccaggccacggccctggtggtgtcgtctataatgataacgaccgctntcagggactcctgagcgtattctcgtggctaccgaaattcgggacaacgaccggcccaaccctcactcactccacgacgggtcgaggcggggatggacggccgactacgtactggtacagggttggagggtattacacgttactgatacagtgggtgggttctcgggcggagggaccaggccgtacggacccgtcgtaacgtcgacggacccaaggcctaccggtcccccgtaggtacccg

SEQ ID NO: 132505 - DNA, 580 bp, Homo sapiens
  misc_feature: GYAE6OF02I9DBD.10.39.D06.1.454.CMB.1.raw
tcagcatagtagtgcacgaccggtgctcgatttagtgacatctcgcagttctttgggctgggcctaaggaagcagcactggtggtgcctcagccatggcctggaccgttctcctcctcggcctcctctctcactgcacagactctgtgacctcctatgcgctgactcagccaccctcggtgtccagtggccccaggacacgacggccacgctcgacctggtggggatacacaagttaggaagtatcgtgtgctacgtggtaccagcagacggccaggccacggccctggtggtgtcgtctatatgataacgaccggcctagagggactcccgtgacgcgattctcgtggctaccgtaagttccgggacaaacgccggccctaccctcactaccataccaccgagggtaccgacgggccgggactaggacggaccggtactacgtacgtcgtcgacggtgtgggtactttcgacgtactgactcgagtggtcggggttcttcgggcggacggaccgaaggcgtacggaccgttacgtaacgtacgacggaccgaaggccgtcgtccccgtcggtcctaccg

SEQ ID NO: 132506 - DNA, 531 bp, Homo sapiens
  misc_feature: GYAE6OF02G170N.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgacgcgattctctggctccaagttcgggcaacacggccaccctcatcactcaccagggtcgagggccggggatcggaggcccgactactactgtcaggtgtgggatttcgacttactgatcagtgtggggtcttcgggcggagggaccaaggcgtggacccgtcgtaacgtcaggtccaaggcctcgcccccgtcggtcctaccg

SEQ ID NO: 132507 - DNA, 529 bp, Homo sapiens
  misc_feature: GYAE6OF02HC4B5.10.39.D06.1.454.CMB.1.raw
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacncggccaccctnactcatcaccagggtcgaggccgggatggaggccgactactactgtcaggtgtgggatttcacgttactgatctagtgtggggtcttcgggcggagggaccgagcgtcggaccgtctaaggtccgagcccgaaggcctaccggcccccgtcggtctacccg

SEQ ID NO: 132508 - DNA, 670 bp, Homo sapiens
  misc_feature: GYAE6OF02J0X4P.10.39.D06.1.454.CMB.1.raw
  modified_base (180)..(180): a, c, t, g, unknown or other
  misc_feature (180)..(180): n is a, c, g, or t
  modified_base (638)..(638): a, c, t, g, unknown or other
  misc_feature (638)..(638): n is a, c, g, or t
  modified_base (648)..(648): a, c, t, g, unknown or other
  misc_feature (648)..(648): n is a, c, g, or t
  modified_base (654)..(654): a, c, t, g, unknown or other
  misc_feature (654)..(654): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (669)..(669): a, c, t, g, unknown or other
  misc_feature (669)..(669): n is a, c, g, or t
tcagcatagtagtgcacgaccggtgctcgatttagtgacatctcgcagttctttgggggagagactgaagaacccagcattgcagcagctccaccatggcctgggctcctctgctcctcaccctcctcagtctcctcacagggttgactcagccaccttctgcatcagcctcctgggacncctcggtcacactccacctgccacctgaacagcgactacatcgttggctcgacggcctcaagtcggtcgcctacgaccaaccaacaacatactaacgaagagggtgagtagtcgtcctacgacgtggacggggcaaggaactaagtgggacagggtacgggaagacttaaagtttcggtaaggaggtacggttcggttcgggacgggtaacgggaaccctaaaccgtcggtaacccgttccgtttaacccggtagggtaccgaacgtacccgtaaagggtcccgttacccggcccccgttacggttccctaaccgtttcccgttacccgtttacccccgtaaccccgttcccgttaacccgttacccgttaactttccgttaccggtacgttaccgggtaccggtccggggtaccgttcggggaaccgtaaacggggtccacgtaacgtacgcgtacncgtagcgtcncgagcngtcgcgcgcncncgnc

SEQ ID NO: 132509 - DNA, 633 bp, Homo sapiens
  misc_feature: GYAE6OF02IM5NJ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacggccacgctgacctggtgggggatacacaagttggaagtaatcgtgtgcactggtaccagcaagaggccaggccaggccctgtggtgtcgtctatatgataacgaccggcctcgagggactccgtgagcgtattctcgtggcctaccgaagttccgggactaaaccgaccgggtcccaccccgtcacttacactccgtaccgtacgggtaccggacgggccggggtagtcgggacggtaccggaaccttacgttacgtcggtacgtagggttggtacgggtactttccacgttacgtagtacttacgagttgggttcggggttcgttcgggacgggtaacgggacccgtaaggtcccgtaggtacccgttcgtaacgttccgacggtacccgacggtccgtacccggtcccccgttcgggtaccttacccgg

SEQ ID NO: 132510 - DNA, 548 bp, Homo sapiens
  misc_feature: GYAE6OF02FR58U.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgaccctgtgggggatacacaattggaagtaatcgtgtgcactggtaccagcagaggccaggccaggcccctgtggtgtcgtctataatgatacgaccggccctcgagggactcccgtgacgcgtattctctggctccgtaattcgggacaacgacggcccacccgtcactcactacaccgagggtcgacgggccggggatcggacggccgtactactacgtgtcgagggtgtgggactttcgacgtactgactcgagtggtgggtcgttcgggcgggaggaccaggccgtgacccgtactacgtcacggccacggcctcgccccgtcggtcctaccg

SEQ ID NO: 132511 - DNA, 588 bp, Homo sapiens
  misc_feature: GYAE6OF02GIN7Q.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacagacggccacgctgacctggtgggggatacacaagttaggaagtaatcgtgtgcactggtaccagcagaggccaggccagcccctgtggttgtcgtctataatgataacgaccggcctcgagggactcccgtgagcgattctcgtcggtctaccagttccgggacaacgaccggcccaccctcgactcactccaaccgtagggtccggacgggccggggatcggacggaccgactactactgtcgagggtgtaggtactttcgacgtactgtatcagttgggtgggtcgttcgggacggtagggacctaaggccgttacggacccgttaccgtaacggtccgaccggtacccgaggtccgtcccggtcccccgtcggtaccctacccg

SEQ ID NO: 132512 - DNA, 558 bp, Homo sapiens
  misc_feature: GYAE6OF02JD26K.10.39.D06.1.454.CMB.1.raw
  modified_base (376)..(376): a, c, t, g, unknown or other
  misc_feature (376)..(376): n is a, c, g, or t
  modified_base (406)..(406): a, c, t, g, unknown or other
  misc_feature (406)..(406): n is a, c, g, or t
tcagcatagtagtgcacgaccggtgctcgatttagtgacatctcgcagttctttggggtctgggcctaaggaagcagcactggtggtgcctcagccatggcctggaccgttctcctcctcggcctcctctctcactgcacagactctgtgacctcctatgcgctgactcagccaccctcggtgtcagtggccccagggacagacggccacgctgacctgtgggggatacacaattaggaagtaatcgtagtgcactggtaccagcagaggccaggccaggcccctgtggttgtcgtctataatgataacgaccggccctcagggatccctgacgcgattcgtctggctccaattcgggacaacgacggccaccctnactcatcaccacgggtacgagggccggganggacggccgactacgtactacgtctaggtgtggtattacatactgatcagttgtgggtcttcgggacggaggaccgtaaggcgtacggaccgttcgaacgttcgaacggcccgtaacggcccgtacggtcccccggttcggtacccgtaccg

SEQ ID NO: 132513 - DNA, 584 bp, Homo sapiens
  misc_feature: GYAE6OF02IQ5X5.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacgacaagttggaagtaatcgtgtgcactggtaccagcagaggccaggccaggccctggtggttgtcgtctataatgataacgaccggccctcgagggactcccgtgagcgtattctctggctacaagttcgggacaacgaccggccacccgtcactcactccgaaccgaggggtcgacgggccggggatcggagcccgaactaccttacgtgtcgaggtggtggtatttcgactacgtgtactcgtaagttgggttcgggggtcgtttccgggacggggtacgggaccgaaggtcgtcggtaaccgtactaacggtcgaacggcccgaagggtcctccggcccccgttcggcctaccg

SEQ ID NO: 132514 - DNA, 531 bp, Homo sapiens
  misc_feature: GYAE6OF02IY8BE.10.39.D06.1.454.CMB.1.raw
  modified_base (357)..(357): a, c, t, g, unknown or other
  misc_feature (357)..(357): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggactccctgagcgtatctctggctcaattcggacaacncgccacctcatcactcaccagggtcgaggccggggatgacggccgactactactgtcaggtgtgggtatttcgacttactgatcgagtggtggggtcttcgggcggagggaccgaaggcgtggtaaccgtcgtaagtccagcccgaaggtccgtcggcccccgtcggtccaccg

SEQ ID NO: 132515 - DNA, 842 bp, Homo sapiens
  misc_feature: GYAE6OF02JUV6F.10.39.D06.1.454.CMB.1.raw
tcagcatagtagtgcacgaccggtgctcgatttagtgacatctcgcagttctttggggtctgggcctaaggaagcagcactggtggtgcctcagccatggcctggaccgttctcctcctcggcctcctctctcactgcacagcctctgcgacctcctatcgtgctgtctcacgccaccctcggtcgtcagtcggccccagggacgacgaccggccgagggactaacccgtggtgggggagacgagccagttgaaagtgaagctgtaccacgtcggtaccagaccagacggccagggcccacgggcccctaggaccgtggtcctcgtatcggatgataggtcgacccgccgtcacggggtactcccgtagacgtacgacttctaccgtcggcctacctaacgtcggtacggggaaaccctccggggaccctacccgtacggaccctaaccgttccaaacccgggccgggttaaccgggaaacccgggtaccgggggtaacgtacggggaccgggtaacccgtaacgtttaacggtttaacggttcggacccgttaagggggtcggtttagggtttaacgttttaccgggtaacggttaacggtttaacgttttccgggtaacccgggtttttacccggggggggggtttttcccgggtaaaccggggggttaaccggggaaacccggttaccgggttacccggtttacgggtaaccccggggtttcccgtaacgggggttaccgtaacccgggtaacccccggtaaggggttacccgttccccgggggtacccccctttaccggggggttaccctaccccgggtttcccgtttaacccccggg

SEQ ID NO: 132516 - DNA, 763 bp, Homo sapiens
  misc_feature: GYAE6OF02GMRGZ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaagttggaagtaatcgtgtgcactggtaccagcagaggccaggccaggcccctgtggttgtcgtctataatgataacgaccggccctcgagggactcccgtgacgcgtattctcgtcggctacccaagtttccggggacctaaaccgaccgggtacccctaaccccgtaccaacgttaccgaacttacccgaacccgtaacggggggttacccggaacgggggccccggggggtaagtacggggaacgggaccccgggtaaccgttaaacccgttaccgttacggttaccggtaaggggttcgggttacggggtaacttttaccgaacctttaaccgttacggtaacgttaccgtacgtttcggggttcggggggttaccgtttccgggggacggggtaacgggggtacccgtaacgggtccggttaacgggtaaccccgggttaccgttaaaccggttaccgaaccgggtacccccgtaaacgggtcccgttaccccgggtaccccccggttaccggttccctaaccccgg

SEQ ID NO: 132517 - DNA, 563 bp, Homo sapiens
  misc_feature: GYAE6OF02FRTXR.10.39.D06.1.454.CMB.1.raw
  modified_base (364)..(364): a, c, t, g, unknown or other
  misc_feature (364)..(364): n is a, c, g, or t
  modified_base (455)..(455): a, c, t, g, unknown or other
  misc_feature (455)..(455): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccaggcccctggtggttgtcgtctataatgataacgaccggccctcgagggactcccgtgacgcgattctctggctcaagttcgggacaacncgccaccctcatcatcaccagggtcgacggccggggatcggaggcccgactacgtacgtgtacgaggttgtgggtatttcacgtactgatnagttggtggggttcgttcgggacggagggacgaacggcgtacggaccgttaccgtaaggttcgacggacccgaacggtccgtaccggcccccgttcggtaccctaccg

SEQ ID NO: 132518 - DNA, 564 bp, Homo sapiens
  misc_feature: GYAE6OF02I07T1.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataaccgaccggccctcgagggatccctgacgcgattctctggctccaattcgggacaacgaccggcccaccctcatcatccaccgagggtcgaggccggggatggacggccgactactacgtgtcgaggtcgtgggatttcgactactgtatcgagttggtggggttcttcgggcgggtacgggaccgtaaggccgtacggacccgttaccgtaaggtccgacggacccgaacggccgtccggacccccgttcggtcctaccg

SEQ ID NO: 132519 - DNA, 668 bp, Homo sapiens
  misc_feature: GYAE6OF02JJGY4.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacatcctatgcgctgactcagccaccctcggtgtcagtggccccaggacagacggccacgctgaccgtggtgggggatacacaagttggaagtaatcgtgtgcacgtggtaccagcgaggacggccgaggcccgacggcccctggtcggttgtcgtctatatgataacgccgcctcgagggactccgtagacgcgtacttctcgtcggtctaccgtagttccgggacaacgaccggaccctacctcgactccaactaccgaaccgtacggggtacgacggggccggggtactacgggacggacccgtactaccgtacgttcgtcggaacgggtcgtacgggttactttaccgaacgttacgttacggagttccgtagttcggggtcggggtttaccgtcgggggaccgggtaccggggtaacctaacggggtcccggtaagtaccccggttaccgttaacgggtccctaccggacccggtaacgggtccctacccggtacccccggttaggtaccccgg

SEQ ID NO: 132520 - DNA, 523 bp, Homo sapiens
  misc_feature: GYAE6OF02F0MBJ.10.39.D06.1.454.CMB.1.raw
  modified_base (358)..(358): a, c, t, g, unknown or other
  misc_feature (358)..(358): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggactccctgagcgattctctggctccaattcgggcaacncggccaccctcatcactcaccagggtcgagggccggggatcggacggccgactactacgtgtcgagggtgtgggtatttcgactacgtgatcgagttggtggggtcttcgggcggagggacagcgtgaccgtctaagtcacgcccaggcctcgccccgtgctccg

SEQ ID NO: 132521 - DNA, 625 bp, Homo sapiens
  misc_feature: GYAE6OF02HAKH2.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacggccacgctgacctgtgggggatacacaattggaagtaatcgtgtgcactggtaccagcagaggccaggccaggcccctgtggttgtcgtctataatgataacgaccggccctcagggactcctgagcgtattctctggctccaagttcgggacaacgacggccaccctcactcgatccaccgacgggtcgacggggaccgggagtcggacgggacccgaacgtaccgtaacgtacggttccgaagggttcggtagggtacgtttcgaaccgttactaggtacttcgtagttgggttcgggggttccttccggggacgggtaacgggtaccgacggtaccgtcggaaccggttaccgttaaggtccgaacgggaccccgaacgggacccgttccggaccccccggttggtacccttaacccgg

SEQ ID NO: 132522 - DNA, 536 bp, Homo sapiens
  misc_feature: GYAE6OF02IRO7B.10.39.D06.1.454.CMB.1.raw
  modified_base (442)..(442): a, c, t, g, unknown or other
  misc_feature (442)..(442): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataaccgaccggccctacgagggactccctgacgcgattctctggctcattcgggcaacgcggccaccctcatcatcaccgtagggtcggaggccggggatgagggccgactactactgtcgaggtgtggtattcatctagntacagtggtgggtcttcgggacggaggaccaggtcgtcggaccgtaccgtaagtcacggaccgaacggcctcggccccgttcggtaccctaccg

SEQ ID NO: 132523 - DNA, 576 bp, Homo sapiens
  misc_feature: GYAE6OF02JIOKP.10.39.D06.1.454.CMB.1.raw
  modified_base (383)..(383): a, c, t, g, unknown or other
  misc_feature (383)..(383): n is a, c, g, or t
  modified_base (431)..(431): a, c, t, g, unknown or other
  misc_feature (431)..(431): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtcgggggatcgacaattggaagtaatcgtgtgcactggtaccagcagaggccaggccaggccctgtggtgtcgtctataatgaatacgaccggccctcgacgggtatccctgacgcgattctctgctcaattcgggactaacgacgccacctcatcactcaaccgngggtacgacgggtccggggatcgggaggcccgacgtactacttggacncgggtgtcgggtatttacgacgttactgtatcctagttggttgggggttccgttacgggaccgggagggtaccaaggcgtacgggaccgttcctaacgtcgacggtacccgaagggcctaccggtcccccgtcgggtcctaccgg

SEQ ID NO: 132524 - DNA, 509 bp, Homo sapiens
  misc_feature: GYAE6OF02JAVLL.10.39.D06.1.454.CMB.1.raw
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
  modified_base (462)..(462): a, c, t, g, unknown or other
  misc_feature (462)..(462): n is a, c, g, or t
  modified_base (489)..(489): a, c, t, g, unknown or other
  misc_feature (489)..(489): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaagttggaagtaatcgtgtgcactggtaccagcagaggccaggccaggcccctgtggttgtcgtctataatgataacgccggccctcgagggatcctgacgcgattctctggctcaattcgggcaacncggccacctcatcatccaccngggtcgagggccggggatggacggccgactactactgtcagggtgtgggatttcgactactgatcgagtgtggggtcttcgggnggacggacagcgtgaccgtctaagtcngccaggctcgccctgctacg

SEQ ID NO: 132525 - DNA, 670 bp, Homo sapiens
  misc_feature: GYAE6OF02JD7U0.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggacaacacggcccaccgtcatcactcaccgaggtcggaggccggggatggacgggccgtaccgtacttaaccgtggtaccgaagggttgtacggggtactttttaccgaaccttaccgttacggtaatttcccgaggtttacggttcgggggggttactttcccgggggacggggtaacggggaacccgtaaggtcccgttacgggtaacccccggtttaccggttaaaccggttacccgtaaccggaacccccggtaacgggtaccccgttacccgggtaaccccccccgttcccgggggtttaccccttaaccccgg

SEQ ID NO: 132526 - DNA, 650 bp, Homo sapiens
  misc_feature: GYAE6OF02HG1ID.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaattggaagtaatcgtgtgcactggtaccagcagaggcaggccacggccctggtggttgtcgtctatatgatacgaccgcctacgagggactccgtgacgcgtatctcgtcgctaccaagttcgggacaacgaccggacccaccctcactcactaccgaccgagggtccggacggggccgggagtcggacggtcccgaacgttacctacgtcgtacgagggtgggtagggtactttacgaccgttacgtgtacttacgtagttcggggttcgggggttccttacgggggacgggtaacggggacctaacgggtcccggttaacggtaccccggttaccgtaaacggtcccgtaaccggaccccggtaacgggtcccgttacccccgggtccccccggtttacggtacccttaaccccgg

SEQ ID NO: 132527 - DNA, 499 bp, Homo sapiens
  misc_feature: GYAE6OF02F7RYS.10.39.D06.1.454.CMB.1.raw
  modified_base (357)..(357): a, c, t, g, unknown or other
  misc_feature (357)..(357): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacncggccaccctcatcatcaccagggtcgagggccggggatggaggccgactactactgcaggtgtgggatttcgactactgatcattgtggggtctggcgaggacagctgaccgtcaagtcagccaggcctcgcccctgctcg

SEQ ID NO: 132528 - DNA, 799 bp, Homo sapiens
  misc_feature: GYAE6OF02H9UBK.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacgccacgctgacctgtgggggatacacaattggaagtaatcgtgtgcactggtaccagcagaggccaggccacggccctggtggttgtcgtactataatgagtaacggacccggccctacgaacggggtactcccgtaggacgtccgtaatttccgttacgtcgggtcccttaccgtaaaacgtttccgggggaccaaaccgaccgggtaccccaaccccgttacaacgttccgaaacgttcccgtaaacccgtaacgggggttccgggaaaccgggggtcccggggtaagttacgggaaaccggggcccgtaaacctaacccggttaacgttacggttaccgtaaggggttcggttaggggtaaccgtttttaccgaaccgtttaaacgttcggtaaacgtttaccgtaaggtttcggggttacgggggggtttcctttaccggggggtaccggggtacggggtaacccggtaacgggtaccggttaacgggtaaccccggtttaccgtaaacgggtttaccgaacccgggttaccccgaaaccggggtcccgtttaccccggtccccccggtttacccgggttcccgttaaccccgg

SEQ ID NO: 132529 - DNA, 704 bp, Homo sapiens
  misc_feature: GYAE6OF02I1XCT.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacagacggccacgctgacctggtgggggatacacaattggaagtaatcgtgtgcactggtaccagcagaggccaggccaggcccctgtggttgtcgtctataagtgataaccgaccggccctcgagggactcccgtgacgcgtattcctcgtcggtcctccgtaaacgttcgggaccaaaccgaccggaccccacccctccgactccactacccaacccgtacgggggtccggacggggccggggtacgtcgggaacgggcccgtaaccgttaccgttaccgttcggttaccgagggttcgggttagggttacttttaccgaaccgttacgtagtaccttcgtaggtttcggggttcggggggtttcgttccggggtacggggtaacggggaacccgtaacgggtccgtaccgggtaaccccggttaccgttaaacgggttacccgaaccggaccccggtaacgggtcccgtaccccgggtcccccggttaccgggtccctacccg

SEQ ID NO: 132530 - DNA, 568 bp, Homo sapiens
  misc_feature: GYAE6OF02IU3C3.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccaggcccctgtggttgtcgtctataatgataacgaccggccctcgagggactcccgtgagcgtattctctggcctccgtaagttcgggacaacgaccggcccaccctcactcactcaccgagggtcgacgggccgggtagtggacggcccgactacctacgtgtcgtagggtgtagggtatttcgacttatgactcgagtgggttggggttcttcggggacgggacggaccgaggtcgtcgtaccgtccgtaaggtccgacgacccgaaggcctccggccccgtcggtcctaccg

SEQ ID NO: 132531 - DNA, 547 bp, Homo sapiens
  misc_feature: GYAE6OF02GN85S.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgaataacgaccggccctgagggatccctgagcgattctctggctccaagttcgggcaaccgcggccaccctcactcatccaccgagggtcgacgggccggggatcggaggcccgacttactacgtgtacgagggttgtgggtatttcgactacgtgattcagtcggttggggtcttcgggcggagggaccaagtcgtcggaccgtcctaaggtccagcccgaaggcctcggccccgttcggctacccg

SEQ ID NO: 132532 - DNA, 593 bp, Homo sapiens
  misc_feature: GYAE6OF02GHK5U.10.39.D06.1.454.CMB.1.raw
  modified_base (330)..(330): a, c, t, g, unknown or other
  misc_feature (330)..(330): n is a, c, g, or t
  modified_base (452)..(452): a, c, t, g, unknown or other
  misc_feature (452)..(452): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacaggacgccacgctgacctggtgggggatacacaagttggaagtaatcgtgtgcactggtaccagcagaggcaggccaggccctggtggttgtcgtctatatgataacgaccggccctcgagggactcccgngacgcgtattctcgtggcctccaagttcgggacaaccgaccggcccacccgtacactcactccaccgacgggtcggacgggaccggggagtacgggacggcccgactacgttactggtacgngggtaggtgggtactttcacgttacgtagactcgagttgggttggggtccgttcggggacgggacgggacaacggtcgtcggaccgtaccgtaacgtccgaacggacccgaacggccctccggcccccgtcggtcctaccg

SEQ ID NO: 132533 - DNA, 612 bp, Homo sapiens
  misc_feature: GYAE6OF02H4TVT.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacaggacggccacgctgcctaaaggtgggggatacacaagttggaagtaatcgtgtgcactggtaccagcagaggccaggccaggccctgtggttgtcgtctataatgataacgacccggccctcgagggactcctgagcgattctctaggcctcaagttcgggcaaccgacggcccaccctcactcactccaccgagggtcgacggggccgggagtcggacggcgactaccgacttgacgtaggtgtgggtatttcgacttactgactactagttcggttagggggttcgtttcgggacggggtacgggacccgtaacgggtccgtacgggtacccgttaccgtaacggtccgtaaccgaccccggtaacgggtcccgttacccggcccccgttaccgggtacttaaccccgg

SEQ ID NO: 132534 - DNA, 549 bp, Homo sapiens
  misc_feature: GYAE6OF02F5J01.10.39.D06.1.454.CMB.1.raw
  modified_base (438)..(438): a, c, t, g, unknown or other
  misc_feature (438)..(438): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcgagggtactcccgtgagcgattctctggctcaagttcgggcaacgcggccaccctcactcactcaccgagggtcgagggccgggatcggacggccgacgtactactgtcgaggtgtagggtntttcgactacgtgatcagttggtgggtcgttcgggcggacgggaccgagcgtacggaccgttaccgtaacgtcacggcccaaggtcctaccggccccgtacggtctacccg

SEQ ID NO: 132535 - DNA, 511 bp, Homo sapiens
  misc_feature: GYAE6OF02GRMSL.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcgagggactccctgacgcgattctctcggctccaacgttcgggacaacacggccaccctcatcactcaccagggtcgagggccgggatggacggccgactactacgtgtcaggtgtgggattcactactgatcagtggtgggtcttcggcggaggacagcgtgaccgtctagcagcaggctcgccccgtgtctacg

SEQ ID NO: 132536 - DNA, 576 bp, Homo sapiens
  misc_feature: GYAE6OF02I7N43.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaagttggaagtaatcgtgtgcactggtaccagcagacgggccaggccgaggcccctggtggttgtcgtctataatgataacgaccggccctacgagggactccctgacgcgtattctcgtcgctccaacgttcgggacaacgcggcccaccctcactcactccgaccgacgggtcggacggggccggggagtcggacggcccgtactacttacgtgtcgtaggtgtcgggtacttcacgttactgatcgagttgggtgggtcttcgggcgggtacggacagtcgtcgtacccgtacgtacgtccgaggacccgtacggtccgtccgtccccggtcgtacctaccg

SEQ ID NO: 132537 - DNA, 543 bp, Homo sapiens
  misc_feature: GYAE6OF02G1VRY.10.39.D06.1.454.CMB.1.raw
  modified_base (218)..(218): a, c, t, g, unknown or other
  misc_feature (218)..(218): n is a, c, g, or t
  modified_base (376)..(376): a, c, t, g, unknown or other
  misc_feature (376)..(376): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgngggggatacacaattggaagtaatcgtgtgcactggtaccagcagaggccaggccaggcccctgtggttgtcgtctataatgataacgaccggccctcgagggactcccgtgacgcgtattctctggctaccaagttccgggcaacgcggccaccctnactcatcaccgagggtcgacgggccgggatggacggccgactactctgtacgaggtgtgggtactttcgacttacgtgatcgagtggtggggtctcgggcggaggaccagccgtggaccgtccgtaagtccgagacccaaggcctaccggccccgtcggtactaccg

SEQ ID NO: 132538 - DNA, 628 bp, Homo sapiens
  misc_feature: GYAE6OF02I5UUP.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggcccaggacagacggccacgctcgaccgtggtgggggactacacgtaagttaggaagtaagtcgtgtgacacgtggtaccagcagacggccaggccgacggccctggtcggttgtcgtctatatgactacgaccgccctgacgggtactccgtagacgcgtacttctcgtcggctcgtaagttccgggacaacgaccgcccgacctcactcgactaccgaccgcgggtacggacgggccgggagtacggacggaccgtaccgtacgtacgtggtcgtacggggttcgtacgggtacttacgtacttacgtcgtacgtcgtagttcgggttcggggttcgtcggggacgggtaaccggacgtaaccggtcgtaacggtaccgtacgtaacgtacgaccgtacccgacggtccgtacccgccccgttacgtccgtacccg

SEQ ID NO: 132539 - DNA, 633 bp, Homo sapiens
  misc_feature: GYAE6OF02ISQFO.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacgccacgctgacctggtggggatacacaagttggaagtaatcgtgtgcactggtaccagcagagccagccaggcccctggtggttgtcgtctatatgataacgaccggccctgaggctccctgagcgtattctctggctcgagttcggcaacgaccggacccaccctcaactcgatacccgaccgtaggggtaccgacgggccggggatcgggacgggacccggtacctaaccgttaccgtcggtacgtagggttggttacggggtacttttacgaccgtttaccgtggtacttcgtaagttcggggttcgggggtaccttcgggggacgggtacgggaccgaacggtccgtcggaacccgttaccgtaacggtaccgaccggtacccgaaggtcccgttaccggaccccccggttcgggtccctacccgg

SEQ ID NO: 132540 - DNA, 611 bp, Homo sapiens
  misc_feature: GYAE6OF02FXZ0Z.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacaggacggccacgctgacctggtgggggatacacaattgggaagtaatcgtgtgcacgtggtaccagcagaggccaggccaggcccctggtggttgtcgtctataatgataacgaccggccctgagggtactcccgtgacgcgattctcgtggcctaccgagttcgggacaacgccggcccaccctcactcatccaccgagggtccggacgggccggggagtacggacggcccgtaactacgttaccgtagtcgaggggttcgtgggtacttttcgacttacgtgaacttcgagttgggtggggttcgttccggggacgggacgggaccgaaggtcgtacggtacccggttaccgtaacgtccgacggacccgaacggtcccgtacccggtcccccgtaccggtaccctaccg

SEQ ID NO: 132541 - DNA, 659 bp, Homo sapiens
  misc_feature: GYAE6OF02FU81C.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggcccaggacagacggccacgctgacctggtgggggatacgacaagtggaagtaatcgtgtgcatggtaccagcagaggccaggccaggcccctggtggttgtcgtctataatgaataacgaccggccctcgagggactcccgtagacgcgtattcgtcgtcggctaccaagttcgggacaaccgaccggaccccaacccgtccaacgtcaacttaccgaaccggacgggtaccggaacggggcccggggtaatcggggaccgggacccggaccttaacgttaccgtcggtccgtagggtcgtaggggttactttccgaacttacgttgacttcgtacgttgggtcggggtttcttcggggacgggtaccgggacgtaacggtccgtacggtaccccgttaccgttaacggtcgtaccggaccccgtaacgggtcccgtacccgcccccggttaccggtccctaaccccg

SEQ ID NO: 132542 - DNA, 577 bp, Homo sapiens
  misc_feature: GYAE6OF02G0ED2.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaagttggaagtaatcgtgtgcactggtaccagcagaggccaggccaggcccctgtggttgtcgtctataatgataacgaccggccctcgagggactcccgtgacgcgattctcgtggcctcctaacgttcgggacaaccgaccggcccaccctcactcactccaccgagggtcgacgggccggggatggacggccgactacgtacgtgtcgaggtgtagggtctttcgacgtacgtagactcgtagttggtcggggttcgttcgggacggacgggaccgaggccgtggaccgttacgtaagtccgacggacccgaacggtccgtccggtccccgtcggtcctacccg

SEQ ID NO: 132543 - DNA, 595 bp, Homo sapiens
  misc_feature: GYAE6OF02JC9Q0.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaattggaagtaatcgtgtgcactggtaccagcagaggccaggccaggcccctggtggttgtcgtctataatgataacgaccggccctcgaggactccctgacgcgattcctcgtcggcctaccgaaagtttccggggacctaaaccgaccgggacccacccctcgactcacgtaccaccgagggtccggacgggcccgggagtcggacggcccgacgttaacctacgtgtacgagggtcgtgggtattcgactactgatcgtatgggtaggggtcttcggacgggtacggacaggccgtcggtaccgtactaacggtcaacggtcccgaacggtcctaccggtcccccgttacggtcctacccg

SEQ ID NO: 132544 - DNA, 616 bp, Homo sapiens
  misc_feature: GYAE6OF02HGOH7.10.39.D06.1.454.CMB.1.raw
  modified_base (180)..(180): a, c, t, g, unknown or other
  misc_feature (180)..(180): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (587)..(587): a, c, t, g, unknown or other
  misc_feature (587)..(587): n is a, c, g, or t
  modified_base (592)..(592): a, c, t, g, unknown or other
  misc_feature (592)..(592): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (609)..(609): a, c, t, g, unknown or other
  misc_feature (609)..(609): n is a, c, g, or t
  modified_base (611)..(614): a, c, t, g, unknown or other
  misc_feature (611)..(614): n is a, c, g, or t
tcagcatagtagtgcacgaccggtgctcgatttagtgacatctcgcagttctttggggggagagactgaagaacccagcattgcagcagctcaccatggcctgggctcctctgctcctcaccctcctcagtctcctcacagggttgactcagccaccttctgcatcagcctccctgggancctcggtcacactcactgccaccctgaacagcgactacatcttggctnagcctnaatcggngcctcgaccaccaacaacatctaacgaaggagggtcagtagtcgtccctacgacgtggtcggggaccaaggaaccaagtcgggactagggtgggagacgtaaagtttcgaggtaagagggttggttccgggcgggtaacggggaaccctaaaccgtcggtacccgtccgtttaccgaggttccgacggtaacccgaagggtccctccggtccccgtcggtaccgtaccttccgttccggttccccggcccctttacccgtaccctaaccgttactaacgtcggtaccgtaggaacgggtcccggggacttacgggtaccgaaggccggactaaacgtcgtacggancgtanacgtgacagngncacgngnnnncg

SEQ ID NO: 132545 - DNA, 720 bp, Homo sapiens
  misc_feature: GYAE6OF02JHHVS.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacgccacgctgacctgtgggggatacacaattggaagtaagtcgtgtgcacgtggtaccagcagaggccaggccacggcccctgtggttgtcgtctataatgataacgaccggcctcgacggactccgtggagcgtattctcgtggacctaccgtaacgttccgggacaaccgtaccgggaccctaccctaccgaactaccaactcccaaccggaacggggtaccggaacgggacccggggagttacgggaaccgggcccggaacttaccgttaacgtcggttaccgaacgggttgtacgggtacttttccgaccgttacgtacggtacttaccgtagttcggggtttacggggggttcctttaccggggggaccggggtaacggggtaccctaaacgggtaccggttaccgggtaaaccccggtttaccggttaaaccggttaccgaaacccgggtaccccggtaaaccgggttcccgttacccgggtaccccccggttccggggttaccctaccccgg

SEQ ID NO: 132546 - DNA, 585 bp, Homo sapiens
  misc_feature: GYAE6OF02FGPOQ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacgacaattggaagtaatcgtgtgcactggtaccagcagaggccaggccaggcccctgtggttgtcgtctataatgataacgaccggccctcgagggactcccgtgagcgattctctggctccctaagttcgggacaacgaccggcccaccctcactcactcaccgagggtccgacgggccggggatggacgggccgacgtacctacgtcgtcgaggtgtgggtatttcgacttactgaactcgagttcgggttggggttccgttcgggcgggtacgggaccaaggccgtacggaccgtacccgtaaggtccacggacccgaacgggtccgttccggccccccgttcggtacctacccg

SEQ ID NO: 132547 - DNA, 685 bp, Homo sapiens
  misc_feature: GYAE6OF02JC84C.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccattctcctcctcggcctcctctctcactgcacagactctgtgacctcctatgcgctgactcagccaccctcggtgtcagtggccccaggacagacggccacgctgacctgtgggaatacacaatggaagtaatcgtgtgcactggtaccagcagaggccaggccaggcccctggtcggttgtcgtctatatgataacgaccggcctcgagggactccgtgacgcgtactttctcgtggtcctaccgtaagttccggggaccaaaccgaccgggaccctaccccgttacaactccaacgttacccgaaccggtaacgggggtccggaacggggcccggggtaagtacgggaaccgggtacccgtaaccgttaccgttaaccgtggttaccggacggggttcggtacgggttactttaccgacgttacgtacgtacttacgtaggttcggggttcggggttccgttccgggggacggtacggggaaccgtacggtccggttacggtacccggttacccgttaaggtcccgacggacccggtaacgggcccgttcccggtcccccggttaccggtaacccg

SEQ ID NO: 132548 - DNA, 689 bp, Homo sapiens
  misc_feature: GYAE6OF02IETZ7.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagaccggccacgctgacctggtgggggactacacaattggaagtaatcgtgtgctacgtcggtaccagcgagaggccaggccacggccctgtggttgtcgtctatatgataacggaccgcctacgtacgggactcctgacgacgtacttactcgtcggtctaccgtaacgttccgggactaaaccgccggtacccaccctactacgtactaactccgaaccgacggggttaccgacggggccgggggtaatcgggacgggtacccgtaacgttaaccttacggtacgttaccgtagggttacgggtacgggtaacttttacgaaccgtttacgtacggtaacgttcgtaagttcggggttcggggtaccggtttcgggaccgggtaagggtaaccgaaggtccggtaacggtacccgttacgtaaacggttacccgacggtacccgaacgggtccccgtaccggtacccccgttcggtaccttaaccccgg

SEQ ID NO: 132549 - DNA, 617 bp, Homo sapiens
  misc_feature: GYAE6OF02F35WU.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgaccgtggtgggggatacacaattaggaagtaatcgtgtgcactggtaccagcagagccaggccacggccctggtggttgtcgtctataatgaataacgaccgccctacgagggtactcccgtgacgcgtattctcgtggcctccaacgttccgggacaaccgccggacccacccgtacactcactccgaccgagggtccggacgggccggggagtcggacgggacccgacgtaccgtacgtcgtcgaggttggtagggtacttaccacgtacttcgatctaggttcggtggggttccgttacgggcgggacgggtaccgaacggtcgtaacggaccccgttacgtaaccgccgaacggcccgtaacgggtcccgtaccggcccccggttcggtaccgttacccg

SEQ ID NO: 132550 - DNA, 562 bp, Homo sapiens
  misc_feature: GYAE6OF02IPEZ8.10.39.D06.1.454.CMB.1.raw
  modified_base (307)..(307): a, c, t, g, unknown or other
  misc_feature (307)..(307): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccacctcggtgtcagtggccccaggacagacggccacgctgacctgtgggggatacacaattggaagtaatcgtgtgcactggtaccagcagagcagcaggccctgtggtgtcgtctatatgataacgaccgccctnagggatcccgtgagcgattctctggttccaagttcgggcaacgacggccacccgtcactcatcacccgagggtcgagggcccggggatcggaggcccgacgtactacgtgtcgaggtgtgggtactttcgactactagactcagttggtcggggttcttcgggacgggtacgggaccgagtcgtacggtacccgtaccgtaaacggtcaacggcccgaacggccgttccggcccccgttcggtcctacgttcccg

SEQ ID NO: 132551 - DNA, 544 bp, Homo sapiens
  misc_feature: GYAE6OF02HZ65U.10.39.D06.1.454.CMB.1.raw
  modified_base (409)..(409): a, c, t, g, unknown or other
  misc_feature (409)..(409): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctacgagggactcccgtgacgtcgattctctcggctaccgaagttcgggacaacacggcccaccctcatcatcacgagggtcgaggccgggatagnggaccgactactacgtgcaggtgtggtatttcgactacgtgatcgagtcggtggggtcttcgggcggtaggaccaaggcgtagacccgtcgtaacgtcgacgccgaacggtcctaccggccccgtcggtctaccg

SEQ ID NO: 132552 - DNA, 533 bp, Homo sapiens
  misc_feature: GYAE6OF02FRLU4.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacggccacgctgacctggtgggggatacacaattggaagtaatcgtgtgcactggtaccagcagaggccaggccaggcccctggtggttgtcgtctataatgataacgaccggccctgagggatccctgagcgattctctggctccaagttcgggcaacacggccaccctcatcatcaccgagggtcgaggccggggatggacggccgactacgtactgtcaggtgtgggatttcgactactgactcgagttggtggggtcttgggtcgggagggtaccaaggcgtgacccgtcgtaagtccaggcccagggcctcggcccccgtggtctaccg

SEQ ID NO: 132553 - DNA, 617 bp, Homo sapiens
  misc_feature: GYAE6OF02GHU4B.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaagttggaagtaatcgtgtgcactggtaccagcagaggccaggccacggccctgtggttgtcgtctatatgataaccgaccggccctcgagggtactcccgtggacgcgtacttctcgtcggccttaccgtaacgttcgggaccaaccgaccggacccaccctcactacactccgaccgacgggtacggacgggaccggggtagtacgggacggacccgacgtaaccgttacgtacggtcgtaggggttggtacgggtactttacgaacgttacgtagtactcgtagttggggttcggggttcgttcgggacgggacgggacgaggtcgtacggtaccgtactaacgtcgacgaccgacggccgttccgcccccgtcggtcctccg

SEQ ID NO: 132554 - DNA, 787 bp, Homo sapiens
  misc_feature: GYAE6OF02IOTO2.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccacccgtcggtgtccagtcggcccaggacacgacggccacgctgacctggtggggatacacaagttaggaagtaagtcgtgtgcacgtggtaccagcgagacggcaggccacggccctggtcggttgtacgtctaatagtacgataaaccggcccgcctacgagggactccgtggacgcgtacttctacgtcggcctaccgtaaggttccgggacctaaccgtacccggtacccacccgttacgtaacctacgtaaccgtacccgaacccgggtaacggggtacccgggtaaccgggggacccgggggttaacgtacggggtaacccggggaaccggtacccgttaaccgttaaaccgggttcggttaccggtaacggggttcgggttaaggggtaacgttttaccgtaacgttacggttacggtaacgttccggttaacggttgggggttaccggggttaccggtccggggtaaccggggtacgggacccgttaacggtccggttaacgggtaaccccgttaacgttaaccgggtaccgaacccgggttacccggaaacgggttcccgttaccccggttacccccggttccgggttacccgtttaacccccgg

SEQ ID NO: 132555 - DNA, 571 bp, Homo sapiens
  misc_feature: GYAE6OF02FLY3U.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccacggcccctggtggttgtcgtctataatgataacgaccggccctcgagggactcccgtgacgcgattctcgtggcctccgaagttcgggacaacgaccggccaccctacatccactccaaccgtacggggtaccgacggggcccggggagtacggacggacccgaacgtaccgtacgtcgtcgaggtgtgggtatttcgacgtactagattctagttggtcggggtcttcgggcggacgggaccgaagcgtcgaccgtacgtaagtcgacgaccgaggcctcggcccctgtcctccg

SEQ ID NO: 132556 - DNA, 582 bp, Homo sapiens
  misc_feature: GYAE6OF02FX88L.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctcgacctgtggggatacacaattggaagtaatcgtgtgcactggtaccagcagaggccaggccaggccctgtggttgtcgtctataatgataaccgaccggcctcgacgggactcccgtgacgcgtattctcgtggctaccaagttcgggacaaccgaccggcccaccctcactccacgtcaaccgacgggtcgagggccggggatcggacggccgactaccgtacgtgtcgaggtgtaggtatttcactactgactcgagttggtcggggttcgttcgggcggtagggaccgaagtccgtacggacccggttacgtaacggtccgaacggacccctacgggtcccgtccgcccccgtacggtcctacccg

SEQ ID NO: 132557 - DNA, 707 bp, Homo sapiens
  misc_feature: GYAE6OF02GSNA7.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccaccctcggtgtcagtcggcccaggacacgaccggccacgctcgaccgtgggtagggggaactacacgtaagttagggaaagttaagtcggtagtgaccacgtggtaaccagcgaaggacggccgaggcccaggcccctggtcggttcgtcgtactataatgaagtaaccggcccggtccctacggagggtacctcccgtggacgacgtacttccgttacgtcggtacctaccgtaacgttccgggacctaaccgaccggaccctacccctacactacactccgacgtacggggtcggacgggaccgggagtaggaccggaccgtactaccgttacgtcgtacgtagggtcgggtacggttacgtttacgtaaccgttacgtacgtacttcgtaaggtttcggggttaacgggggtccgttcggggaaccgggaacggaccgaacggtccgtacggtaaccccggttacgaaaccgtccgaaccggaccgaacggttccccgtacccggtccccggttaccggctttaaccccg

SEQ ID NO: 132558 - DNA, 692 bp, Homo sapiens
  misc_feature: GYAE6OF02H5GCJ.10.39.D06.1.454.CMB.1.raw
  modified_base (312)..(312): a, c, t, g, unknown or other
  misc_feature (312)..(312): n is a, c, g, or t
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgtgctgtctcacgcccaccgtcggtgtcagtcggcccaggagagacggccaggactaaccgtggtggggagacgagcaagttgaaagtgaagctcgtccacgtcggtaccagccgaggacggccgacggccacggccctgtacctcggttcctntatgatgatacgtcgaccggtcctacgagggactccgngacgtcgtacttctacgtcgctaccgtaacgtcgacgggtaaccnccggaccctaacccgtacgaccgtacgtaccgaccggtaacgggtacgaaaccgggtccgggtaacgtacgggtaccgggaccggttaaacgttacgtttaacgttcgggtaccgtagggttacggtttacggtttagtttacgtaaggtttacgttacgtttcggtaccgggttttccgggggtttcgggacgggtaacgggtacgtaacggtccgttaccggtacccgttacggtacggtacgaaccgtacccgaaggtcccgtaccggccccttcgtacgtcctacgttccccg

SEQ ID NO: 132559 - DNA, 520 bp, Homo sapiens
  misc_feature: GYAE6OF02H93VS.10.39.D06.1.454.CMB.1.raw
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (478)..(478): a, c, t, g, unknown or other
  misc_feature (478)..(478): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggcccaggacagacggccacgctgacctgtgggggatacacaattaggaagtaatcgtgtgcactggtaccagcagaggccaggccaggccctgtggttgtcgtctatatgataacgaccgccngagggactcccgngagcgattctctggcctcaattcgggacaacacggcccaccctcactcatccaccgagggtcgaggccgggatcggacggcgactactacgtgtcgaggtgtggtatttcactagtgatcagttggtggggtctcgggcggagggacaggcngaccgtctagtcacgccgaaggcctccgccctcggtctaccg

SEQ ID NO: 132560 - DNA, 607 bp, Homo sapiens
  misc_feature: GYAE6OF02G2NR0.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccacccgtcggtgtcagtcggcccaggacagacggccacgctgacctggtggggatacacaattggaagtatcgtgtgcactggtaccagcagacggccaggccaggccctgtggttgtcgtctatatgagtaacgaccggccctcgagggactcccgtagacgcgtattcgtcgtcggtcttaccgaagtttccgggacaaaccgaccgggaccctaccctcgtaactcctacgtaccgacccgaggggtccggacggggccggggtagtcgggacgggaccgtacgtactacgtcgtcgtagggtgtgggtactttcgacgtacgtgacttcgagttgggttcggggttcgttcgggacgggacgggacgtacggcgtcggtaccgtacgtaagtccgacgtaccgacggtcctccggcccgtcgtacctccgg

SEQ ID NO: 132561 - DNA, 699 bp, Homo sapiens
  misc_feature: GYAE6OF02IP556.10.39.D06.1.454.CMB.1.raw
  modified_base (79)..(79): a, c, t, g, unknown or other
  misc_feature (79)..(79): n is a, c, g, or t
  modified_base (226)..(226): a, c, t, g, unknown or other
  misc_feature (226)..(226): n is a, c, g, or t
  modified_base (679)..(679): a, c, t, g, unknown or other
  misc_feature (679)..(679): n is a, c, g, or t
  modified_base (682)..(682): a, c, t, g, unknown or other
  misc_feature (682)..(682): n is a, c, g, or t
  modified_base (689)..(689): a, c, t, g, unknown or other
  misc_feature (689)..(689): n is a, c, g, or t
  modified_base (695)..(695): a, c, t, g, unknown or other
  misc_feature (695)..(695): n is a, c, g, or t
  modified_base (698)..(698): a, c, t, g, unknown or other
  misc_feature (698)..(698): n is a, c, g, or t
tcagcatagtagtgcacgaccggtgctcgatttagtgacatctcgcagttctttggggggagagactgaagaacccagnaccccttgcagcagctccaccatggcctgggctcctctgctcctcaccctcctcagtctcctcacagggttgactcagccaccttctgcatcacgcctcccgtgggacgcctcggtccaccacctccacctcgaccaccctagaacncgacgactacactcgttggctcgacggcctacaagtcggtcgcctcgaacccaacaacaacattaccgtaacggaaggtagggtagagtacggttccgtcctacgtaacgtgggtcggggacacgaactagtacggcgtaggtgggaagtcttaacgttcggtaggaggtacggtttgggttacggacggggtaacgggaccctaacgtcggtacccggttcctttccggacggttcgaccggaacccgacggtcccgtacccggcccccgttacgggtccttaaccgttcccgtttccccggtttaccccccggcccctttacccgtaccccgttaaccgtttaaccgtacggtttcccgtacggttaccgggaccgggttccggggacgttaccgggaaccgggaaaccggttccggaacgttaacgtaacggcacgacgtgctcgacgcncgngacgcgngcgacncgnc

SEQ ID NO: 132562 - DNA, 541 bp, Homo sapiens
  misc_feature: GYAE6OF02HGRZ7.10.39.D06.1.454.CMB.1.raw
  modified_base (329)..(329): a, c, t, g, unknown or other
  misc_feature (329)..(329): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctggtggttgtcgtctataatgaataacgaccggcctcgagggactcccngagcgattctctggctcaattcgggacaacgccgccaccctcatccatccaccgtagggtcgacgggccgggatcggacggccgactacgtactgtcgtaggtgtgggactttcactactgatcagttggtcggggtctcgggcgggaggaccaggtccgtcggaccgtcgtaagccacggcccgaggtcctccggtccccgtggctacccg

SEQ ID NO: 132563 - DNA, 616 bp, Homo sapiens
  misc_feature: GYAE6OF02H0CFE.10.39.D06.1.454.CMB.1.raw
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtgggggatacacaattggaagtaatcgtgtgcactggtaccagcagaggccaggccacggcccctgtcggttgtcgtntataatgataacgccgccctcgagggactccgngagcgtattctctggcctacctaacgttccgggaccaaacgaccggacccacccctcgactccatccaccggagggtaccggacgggccggggatcggacggccgtaacgtaccgtacgtcgtacagggttgtacgggtactttacgaaccgttactggtacttacgagttgggtcgggggttcttcggggacgggacgggaccaaggtccgtacggtacccgttacgtaacgtccgaccggacccgaacgggtccttacccgggaccccgttcggtaccctacccg

SEQ ID NO: 132564 - DNA, 606 bp, Homo sapiens
  misc_feature: GYAE6OF02H4HOK.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacggccacgctgacctgtgggggatacacaattggaagtaatcgtgtgcactggtaccagcagaggccaggccaggcccctgtgtgtcgtctataatgataacgaccggccctcgagggactcccgtgacgcgattctctcggctccaagttcgggactaacacggccacctcactcactccaccagggtcgacgggcggggatggacggccgactacgtacttgtcgaggttcggtgggactttacgacgttacgtgtatccgagttcggtagggggttctttaccggggcgggtaacggggaccgaaaggtccggtaacggtacccggttaccgtaacggttaccgtacggaccccgtacgggtacccgtcccggtaccccccgttccgggttaccctaacccgg

SEQ ID NO: 132565 - DNA, 682 bp, Homo sapiens
  misc_feature: GYAE6OF02H071C.10.39.D06.1.454.CMB.1.raw
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagagccaggccaggccctgtggttgtcgtntataatgataacgccggccctcgagggactccctagacgcgattcncgtgctacgaagttcgggacaacgaccggacccaccctacgactacaattccaaccgtagggggttaccgacgggggacccggggtaagtacggaaccgggtcccgaaacgttaacccgtaacgttggttaccgtaggggttaggtacggggtacttttacgaaccgttaccgtaggtacgttccgtaaggtttcgggttcgggggttactttccggggaccggggtaacgggtacccgaacggtccgtaacgggtaaccccgttacggtaaacgttaccgaaccgggtccccgtaaacgggcccttaccccgggtcccccccgttacgggtcccttaaccccgg

SEQ ID NO: 132566 - DNA, 737 bp, Homo sapiens
  misc_feature: GYAE6OF02JTVFM.10.39.D06.1.454.CMB.1.raw
tcagcatagtagtgcacgaccggtgctcgatttagtgacatctcgcagttctttgggctgggcctaaggaagcagcactggtggtgcctcagccactggcctggaccgttctcctcctcggcctcctctcctcactgcacagactctgtgacctcctatgcgctgactcagccaccctcggtcgtcagtcggcccaggacaggacggcctacgcctcgacctggtacgggggataccgaactaagttagggaaagtaacgtcgtgtcgcacgtcggtaccagacaggacggccgaggcccgacggtcccctgggtcggttacgtccgttactaagtaacgttaggaacgtaaaccggacccggtcccgtaccggaacgggtacctcccgtaggtacgaccggttaacttccgttcgtacggtaccttaccgtaacggtttccgggacctaaccgaccgggaccctacccgtacacgtccactccgaccgtacggggtacgacgggtaccggggtacgtacgggaccggtaccgaaccgtacgttacgtcggtaccgtagggttcggttacgggtactttacgacttacgttagacgttacgtacgttcgggttcggggttccggtacgggtccgggtaacgggacctaagggtaccgtcggtaaccgttaccggtaacgtaccgaaccggtccgaacggtcccgttcccggccccggttacgggtaccttacccggg

SEQ ID NO: 132567 - DNA, 704 bp, Homo sapiens
  misc_feature: GYAE6OF02GULKZ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggcccgaggacaggaccggccacgctcgaccgtggtagggggatacgacaagttaggaagtaagtcgtgtgactacgtggtaccagcaggacggccgaggccgacggtccccttggtggttcgtcgtactaagtaatagtaacgtaaccggacccggtcccgtcgacgggtactccgtaggacgtacgtacttctcgtcggtcctaccgtaacggttcgggaaccaaccggaccgaccctacccgtctacgtacctaccgtaccgaccggaacggggtacccgggacgggggtaccgggtacgtacgggaccgggtacccgtaacttaccggttacgtacggtacgtaggggttacggttacgggttacttaccgaacgttacgtagtactacggtggttgggttacggggttcgtaccggggcgggtacggacgtacgtcggtcggtacccgttacgtacgtaccgacggacccgtacggtcccgtcccggtaccccgtacggtaccctcccgg

SEQ ID NO: 132568 - DNA, 685 bp, Homo sapiens
  misc_feature: GYAE6OF02F9OAK.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatcgcgctgactcacgccacccgtcggtcgtcagtcggcccgaggacacggacggccacgctcgaccgtggtggggactacactaagttaggaagtaagtcgtgtgacacgttcggtaaccagcgaaggacggccagggccacggccctggtggttcgtcgtactatagtgaactaacggaccgcctgaggactccgagcgcgtatctcgtcggctacgtaacggttcgggacaaccgaccggaccctacccgtcgtactactactacccgaaccgggtacggggtaccggaacgggggtaccggggtacgtaccggggaccgggtaccccgtaacgttaccgttaacgtcggttacggacgggttggtagggttactttaccgacgttaacgttgtactcggtacggttcggggttacgggtcggttaccgggacgggacggtaccggtaagtccggtacggtaacccgtacgtaacggtccaaccggtccgaacggtcctacccggtccccgttggacctacccgg

SEQ ID NO: 132569 - DNA, 540 bp, Homo sapiens
  misc_feature: GYAE6OF02HK0RV.10.39.D06.1.454.CMB.1.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccacctcggtgtcagtcggcccaggacngacggccacgctgacctggnggganacacaattggaagtatcgtgtgcacgtggaccancgaagcggcagccgacggtcccngtggttgcgtctagtatgaatacgcgccagnggactccgngacgctatcncgtgctacgtagtacgacacgacnccacacactcactactacgacgacggacggcgacgcgcgacgtacgtacgtacgtacgcgtacgtgtcgtacgtcgtactatacgtacgtacgtacgtacgtcggtcggtacggtacgacggtacgtacgtacgtcgtacgtacgtacgtacgacgtacgacgtacgccgtaccgtcgtacgtcg

SEQ ID NO: 132570 - DNA, 591 bp, Homo sapiens
  misc_feature: GYAE6OF02HXQ7A.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtggggatacacaattggaagtaatcgtgtgcactggtaccagcagaggccaggccacggccctgtggttgtcgtctaataatgaactaacgaccggccctacagggactccctgacgcgattctctggctacgtaacgtcgggacaacgacggcccaacccgtcactcactaccgaccgacgggtcggacggccggggataggacggccgactaactacgtgtcaggttgtggtactttcgactactgactacgagttgggttcggggtacttcggggacggtacgggaccaaggtaccgtcggtaccggttaccgtaaacgtccgaacgtcccgaacggtccgttaccggtccccgttacggtacctaccg

SEQ ID NO: 132571 - DNA, 658 bp, Homo sapiens
  misc_feature: GYAE6OF02IOAOS.10.39.D06.1.454.CMB.1.raw
  modified_base (461)..(461): a, c, t, g, unknown or other
  misc_feature (461)..(461): n is a, c, g, or t
tcagcatagtagtgcacgaccggtgctcgatttagtgacatctcgcagttctttgggctgggcctaaggaagcagcactggtggtgcctcagccatggcctggaccgttctcctcctcggcctcctctctcactgcacagactctgtgacctcctatgcgctgactcagccacctcggtgtcacgtcggcccaggacgagacggccacgcgtcgaccgtggtgggggactacgacgtaagttaggaagtaactcggtgtgctacgtcggtaccaggacgaggaacggcccgacgggaccacgggtccccgttggttcggttcggttacggttctaagtaaggtcgaacgttaacccggaccggtccctacgaacgggtcctacccgtggacgacgtacttcgtacgcggtcctacacgttaccggactaaccgaccggtcccaccgtacgtactactaacnccgtaaccgagggtcggacgggccgggtagacggacggaccgtaactcgtacgtagtcgtaggtcggtacggactttcgacgtacgtagtacgtacgtacgttgggttccgggtctcgggtacggacgggacctagccggtaacgtcccgtagtacgtcgacgtaccgaccgtaggtccctcccgtcggtacctccg

SEQ ID NO: 132572 - DNA, 587 bp, Homo sapiens
  misc_feature: GYAE6OF02GPYFI.10.39.D06.1.454.CMB.1.raw
  modified_base (567)..(568): a, c, t, g, unknown or other
  misc_feature (567)..(568): n is a, c, g, or t
  modified_base (570)..(571): a, c, t, g, unknown or other
  misc_feature (570)..(571): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(587): a, c, t, g, unknown or other
  misc_feature (577)..(587): n is a, c, g, or t
tcagcatagtagtgcacgaccggtgctcgatttagtgacatctcgcgagttctttgggggagagactgaagaacccagcattgcagcagctccaccatggcctgggctcctctgctcctcaccctcctcagtctcctcacagggttgactcagccaccttctgcatcagcctccctgggagcctcggtcacactcacctgccaccctgaacagcgactacatcgttgggctcaggcctcaatcggtgcctgaccaccaacaacatctacggaagaggggtgaggtagtcgtccctcacgtggtcggggcaaggacaagtggcgaggtgggagtcaagttttcggagaggtagttaggttcgggcgggaacggggaaccctaacgtcgtacccgttccgtttaccgtaagggtcaaccggacccgtaagggcctccggcccccttgggtacccaccgttccgttccgttacccccgaccccttcccgtaccctaccgttaaccttgtaccgcgttacgggacggcccggggtacctcggggaccgttaacgggccgacctaagacggnngnngncncnnnnnnnnnnn

SEQ ID NO: 132573 - DNA, 635 bp, Homo sapiens
  misc_feature: GYAE6OF02GF145.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctctatgcgctgactcacgcccaccctcggtcgtcagtcggccccaggacagaccggccacgctcgaccgtggtgggggatacgacaagttaggaagtaagtcgtgtgcacgtcggtaccagcgaggaggccgaggccacgggccctggtggttcgtcgtctagtatgactaacggaccgccctgagggactcccgtagacgcgtattctcgtcggtctaccgtacgttcgggaccaaccgaccgccccaccgtacactacactacgaccgtacggggtacggacgggggaccgggagtacgggacggacccgtacgtaccgttacgtcggtacgtaggtgtagggtacttacgtaccgtcgtagtactacgagttcgggtcgggttccgtcggggacgggaacgggacgtaggccgtacggtaccgtaccgtacggacgacggaccggacggtaccgtccccggcccgtccggtcctacccgg

SEQ ID NO: 132574 - DNA, 627 bp, Homo sapiens
  misc_feature: GYAE6OF02IAZ2B.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacagacggccacgctgaccgtggtgggggatacacaagttggaagtaatcggtgtgcactggtaccagcagaggccaggccacggccctggtcggtgtcgtctatagtgatacgaccgcctgaggactcctgagcgtattcgtctggctactaacgtcgggacaaccgacggcccaccctcactcactccaccggacgggtacgacggggtaccggggagtcgggacgggacccgtaaccgttaccgttacgttggtcgagggttgggtcgggtactttcgacttacgtgtaacgtctaggttcgggtggggggttacctttcggggacggggacgggtacccgaacggtccgtacgggtaccccgttacgtaaccggtccgaccggaccgaacgggtcctacccggccccgttaccggtccgtacccg

SEQ ID NO: 132575 - DNA, 753 bp, Homo sapiens
  misc_feature: GYAE6OF02HKQCR.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacacaattggaagtaatcgtgtgcactggtaccagcagaggccaggccaggccctgtggttgtcgtctatatgataacgaccggccctcgacgggactcccgtagacgtcgtattcgtcgtgggtccttacccgtaaacgtttccggggaccaaaccgtacccgggacccctaaccccgtccacgttacctaactacccgaacccgtaacgggggttaccggaacgggggcccgggggtaagtacgggaacgggaccccggtaaccttaaccgttaaccgttcggttaaccgtacggggttacgggttacggggttaacttttaccggaaccgtttaacgttacggtaacgttacgtaacgtttcggggttccgggggggtttaccgttacgggggtaccggggtaaccgggggtaaccgtaacgggtccgttaacgggtaacccggttaccggtaaacggtcccgaacggtaccccgtaaagggtcccgttcccggtacccccccgttcgggtacccttacccgg

SEQ ID NO: 132576 - DNA, 666 bp, Homo sapiens
  misc_feature: GYAE6OF02H2B0N.10.39.D06.1.454.CMB.1.raw
  modified_base (413)..(413): a, c, t, g, unknown or other
  misc_feature (413)..(413): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccacccgtcggtgtcaggtcggcccaggacagacggccacgctgaccgtggtgggggatacactaagttaggaagtaatcgtgtcgctaactggtaccagcaggacggccaggccgacgccctgtcggttgtcgtctatatagactaaccggaccgtcctacgacgggtacctaccgtgacgcgtacgttctcgtcggcctactaagttccgggactaaccgaccgccaccctcgactcacncgaccgtagggtcgacggggcgggatcggacgccgtactacgtacgtgtcgaggtggtacggtactttcgacttacgtgtacgtcgaaggtttgggttccgggggttacttccgggggacgggtacggtaccgaccggggttaacgtcccgggttacccggttaacccgttaacggtacccgtaaccgggtaccccgtaaccgggtacccgtcccccgggttaaccccggttacccggtaccgttaaccccgg

SEQ ID NO: 132577 - DNA, 716 bp, Homo sapiens
  misc_feature: GYAE6OF02FH7JW.10.39.D06.1.454.CMB.1.raw
  modified_base (266)..(266): a, c, t, g, unknown or other
  misc_feature (266)..(266): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctggtgtcagtggccccaggacagacgcacgctgactcggtggggaggtacacaattaggtaagtaatcgtggtgcgactcggttacgacncgagaggccgacgccgacgcccgtcgtggttgtcgtctataatagtagtaacgaccggacccgtcctagggacgtacctcgtagcggtacttcttctggtccgtccctaacgttacgggtaccgaaccaacccgggacccgtacccctaccgaactacccgtactaccgacccgaacggggttccgggacggggtaccgggggtaccgtaggacggggacccggtaacccttaacgttaacccgttacgggttaccgttaacgggtagggttcggggtagttttacctaaccgtaacttcgtaagttccctaagttcggggttaggggttcggtttccgggccggggtaacggggtacccgaagaccggttacgggaacccgttcccggttaagtacgaccgacccgtaacgggcccgtacggtcccccccggtcggtaccggtaccccg

SEQ ID NO: 132578 - DNA, 546 bp, Homo sapiens
  misc_feature: GYAE6OF02GT9Z1.10.39.D06.1.454.CMB.1.raw
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
  modified_base (463)..(463): a, c, t, g, unknown or other
  misc_feature (463)..(463): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacgacaattggaagtaatcgtgtgcactggtaccagcagaggccaggccaggcccctgtggttgtcgtctataangataacgaccgcctcagggatcctgagcgatctntggctcaattcggcaacgacgccaccgtcatcatcacaggcgaggccgggatagaggtccgactactacgtcgtgtacggtgtgggatttacacgtactagattcgaagttgtggggttcgttccgggnggagggtaccgaagtccgtggtaacccggtctaacggtcctaacggaccgaacggactccggcccccgttacggtcctacccg

SEQ ID NO: 132579 - DNA, 720 bp, Homo sapiens
  misc_feature: GYAE6OF02I6FQ1.10.39.D06.1.454.CMB.1.raw
  modified_base (219)..(219): a, c, t, g, unknown or other
  misc_feature (219)..(219): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacagacgcacgctgacctggngggggatacacagttaggaagtatcgtgtgcactggtaccagcaggacggcaggccgacggccctggtggttgtcgtactagtaatggaactaaccggacccggtcccctacggacggtactcccgtgacgcgtattccgtcgtggtcctaccgtaacgtttccgggacctaaacgacccgggcccctaaccctcctaactaccgtactacccgaaccggtacgggggtaccgacgggggtacccggggagtacgggacgggacccgtaacgttaaccttacgtacggtacggtacgggtggttacgggttactttacgtaacccttacgtacgtaagttaccgaaggtttccggggttagggggttcccgttagggggaccgggtaaccgggacgtaacggccggttaaccggtaacccggtttaaccgtaaaccggttcaacccgggtacccgtacgggtacccgtcccggtaccccccggttacggtacccgtacccg

SEQ ID NO: 132580 - DNA, 742 bp, Homo sapiens
  misc_feature: GYAE6OF02JDJAY.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggcccaggacagacggccacgctcgacctggtgggggactacacaagttggaagtatcgtgtgcactggtaccagcagaggccagggccacggccctggtggttgtcgtatagtaatgataacggaccgcctcgaggtactccgtgacgcgtattctcgtggtcctaccgtaagttccgggactaaccgtccgggaccctacccgtctacgtccaagtcccgaacccgtagggggttaccggacggggccgggggtaatcgggaacgggtcccgaacgttaccgtaccggtggtaccgtacggggttcggtaggggttactttacccgtaacgttacgtacggtacgttacgtaacgggtttcgggtttcgggggggtaaccctttccgggggacgggggtaaccgggggtaaccctaacgggtaccgtttacccggggtaacccggtttaacccggttaaacggttacccgtaaacccggtacccccgggtaaacgggttcccgggttaaccccggtcccccccgggttacgggttacccctttaaccccggg

SEQ ID NO: 132581 - DNA, 645 bp, Homo sapiens
  misc_feature: GYAE6OF02GLCRA.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacagaccggccacgctgacctggtgggggatacacaattaggaagtaatcgtgtgcacgtggtaccagcaggaggccaggccacggcccctggtggttgtcgtctataatagacgtaaccgaccggccctcgacgggactcccgtgacgcgtattcctacgcggtcctaccgtaagtttcgggaccaacgtaccggcccaccctccaacgtcactaccaccggtaggggtccgacgggccgggtatgggacggaccgactaccgtacgtcgtacgtagggttggtacgggtactttactaaccgttactagtactacgttagggttgggttcgggggttccgttcggggaccgggtacgggaccgtaggaccgtcggtaaccgttaccgtaacggtaccgacgtaccccggaaggtccctaccggtcccccgtcggtaccttacccg

SEQ ID NO: 132582 - DNA, 590 bp, Homo sapiens
  misc_feature: GYAE6OF02G12FH.10.39.D06.1.454.CMB.1.raw
  modified_base (450)..(450): a, c, t, g, unknown or other
  misc_feature (450)..(450): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctggtgtcagtcgccccaggacagcggccacgctcgacctggagggggatacactaagttaggaagtaatcgtgtcgcactggtaccagcagaggcaggccacgccctggtggttgtcgtctagtaatgaacgtaacgaccggtccctcgacggctcccgtgacgcgtattctcgtcgctaccgtattcggacaccgacggccaccctcactcactccacggagggtcgacgggaccgggagtcggaccggaccgtacgtaccgtacgtgtacgnggttagtagggtcttaccgacttactagactcgtagttcgggtacggggttcgtcgggacgggtacggtacgagtcgtacggtaccgttaccgtaagaccgacgtaccgaaggtcctacccggaccccgtcgtcctaccg

SEQ ID NO: 132583 - DNA, 795 bp, Homo sapiens
  misc_feature: GYAE6OF02H86J4.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccacccgttcggtgtcagtcggccccaggacagaccggccgacgcgtcgaccgtggtagggggactaacgaacgtaagttagggaaagtaaacgtcggttggttcgaccgtaaccgttacgggtaacccaaggccgaagggaaccgggtacccgaacgggcccaaccgggtcccccgttagggttcggtttcggtccggttacttaagttaaacgtacggtaaaccgtaaaccggacccggtaccccgttacggaacggggtacttcccgtaggacgtcgtacttcgtcgtcggtcctacgtaacgttccggggaactaaaccgtaccggaccccacccgtactaacgtctaactcccgaaaccggacggggtaccggacggggcccgggtaagtcggaaccgggtccgaacttaacgttaccgtggtaccgtaagggttcggtacgggttaacctttacgaaccttacggtacgtactacggtaagggttcgggtttcggggggtacccgtttaccgggggacgggtaaccgggtacgaacggtaccgtacggtacccgttacggttaacgccgtaaccggaccggaaggtcccgtcccggaccccgttcggacctacccgg

SEQ ID NO: 132584 - DNA, 715 bp, Homo sapiens
  misc_feature: GYAE6OF02I2OTK.10.39.D06.1.454.CMB.1.raw
  modified_base (687)..(687): a, c, t, g, unknown or other
  misc_feature (687)..(687): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccaccctcggtgtcagtcggccccaggacaggacggccacgctcgaccgtggtgggggatacacaagttaggaagtaatcgtgtgcacgtggtaccagacaggagccgacggccgacggccctggtggttcgtcgtctaataagtgaactaacggaccggcctacgagggtacctcccgtaggacgacgtacgttccgtcgtcggtacccttaccgtaacggttccggaaccgtaaaccgaccggaccctaaccccgttacaacttaccgaacgttacccgaaccggtaacggggtaccgggaaccgggggacccgggggtacgacgggaaccgggacccgtaaccgttaacgttaccggttacggtacgtagggttcgggttagggtactttacgtaccgttactggacttccgtaggttcggggttacgggttcggtacggggagggtaccggtacgaaggtccggtaccggtacccggtacgtaacggtacgacggaccgtaacgggtccncccgggtaccccgttcggtccgtacccg

SEQ ID NO: 132585 - DNA, 623 bp, Homo sapiens
  misc_feature: GYAE6OF02II1AQ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggcccaggacagacggcacgctgacctggtgggggatacgaacaagttggaagtaagtcgtgtgcacgtggtaccagcagaggccaggccaggcccctgtcggttgtcgtctagtaatgataacgaccggcctcgagggactcctgacgcgattctctggctcgaagttcgggacaaacacggcctaaccctcgactcaatcaaccgtacgggtcgagggccgggatcggacggccgactaacgtacgtgtaccgaagggttggtacgggtatttacgaacgttacgtacgtacttacgtagttgggttcgggggttcgttacggggtacgggaacgggtaccgaaacggtccgtaacggacccgttaccgtaaacggttccgaacggaccccgtaagggtacccgttcccggcccccgttcgggtacctacccgg

SEQ ID NO: 132586 - DNA, 571 bp, Homo sapiens
  misc_feature: GYAE6OF02G5BG1.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctggtggggatacacaattggaagtaatcgtgtgcactggtaccagcagacggccaggccacggccctggtggttcgtcgtctatatgataacgaccgccctcgagggactcccgtgacgcgtattcctcgtcggctaccaagttcgggacaacgccggcccaccctcactcatccaccgagggtcgacgggccgggatcggacggcccgactacgtacgtgtcgaggtcgtaggtacttcgactacgtgatcgtagttgggtcggggtctcgggcggacgggacaggcgtcggtaccgtacgtaacgtccgaacggcccgtaaggtcccgtaccggtccccgtcggtactacccgg

SEQ ID NO: 132587 - DNA, 719 bp, Homo sapiens
  misc_feature: GYAE6OF02GHD2B.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccaccctcggtgtcagtcggccccaggacagaccggccacgctcgacctggtggggatacacaagttaggaagtaatcgtgtgcacgtcggtaccagacaggacggccaggcccgacggccccgtggtcggttgtcgtactataagtgaactaccgaccggccctacgagggtactcccgtagacgtacgtattctcgtcggcctaccgtaagttccggacaaccgaccggcccaccctcactccactaccgaccggagggtccggacggggtaccgggtatacgggaccggacccggtacgttaccgttacgtcggtacgtaggggttacggtacggggttaactttcgtacgtaccgttacgtaacgttcgtaagggttcggggttcgggggttacggttaccggggaccggggtaaccgggtaccggaacggtccggttaacccgggtaacccgttaaccgggtaacgttacccggaacccggtaccccggtaacggtaccccggttacccggtccccccggttacggtaccccgttaccccgg

SEQ ID NO: 132588 - DNA, 653 bp, Homo sapiens
  misc_feature: GYAE6OF02GHOUK.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggccccaggacagacggccacgctcgacctggtagggggatacacaagttaggaagtaatcgtagtgcactggtaccagcagaggccaggccacgccccgtgtggttgtcgtctatatgataacgccgcctcgagggactcccgtgacgcgtattcctcgtcggtcctaccgtaagtttccgggacctaaaccgaccggacccaccctcactccatacccgaccgtacggggtccggacggggcccgggggatacgggaccgggtacccgaccttaacgttaccgtggtacgagggttcggtagggttatttccgtaacgttacttagacgttacgtaggttcgggttcgggggttccgttcggggacgggtacgggacctaggaccggtcggtacccggtaccttaaggtccgaacggtacccggtaacggtcccgacccggtaccccgtacgtccgtacccg

SEQ ID NO: 132589 - DNA, 531 bp, Homo sapiens
  misc_feature: GYAE6OF02F0W56.10.39.D06.1.454.CMB.1.raw
  modified_base (340)..(340): a, c, t, g, unknown or other
  misc_feature (340)..(340): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtggggatacacaattggaagtaatcgtgtgcactggtaccagcagaggccaggccaggcccctgtggttgtcgtctataatgataacgaccggccctcgagggactcccgtgacgcgaattcncttggttccaagttcgggacaaacgacggcccaccctcatcatcaccagggtcgagggccgggatggacggccgactactctgtcaggtgtggtatttcactactgatcgagtggtcgggtctcgggcgacgggaccagcgtcgccgtactaggccacgcccgaaggcctccgccccgtcgtccgactccg

SEQ ID NO: 132590 - DNA, 748 bp, Homo sapiens
  misc_feature: GYAE6OF02GWT8X.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggcccaggacagacggccacgctgacctggtggggatacgactaagttaggaagtaatcgtgtgcacgtggtaccgagcgagaggccaggccacggccctgtcggttgtcgtctatatgactaacgaccgcctacgacggactcccgtgacgcgtacttctcgtcggccttaccgtaagttccggggaccaaccgaccggaccctaccctactactcctacgtacccgaccggtacggggtaccggaccgggggaccggggtagtacgggaccgggtacccggtaaccgtttacccgttaaccggtttacggttaccggtaagggttcgggtaggtttaacctttacccgtaacttaaccgtttgaaccgtttacgttacgggtttcggggttttaccggggggttaccggttccgggggaccggggtaaccggtaacccgggtaaggtcccggttaaccggggtaccccgtttaaccggttaaccggtacccgaccgggacccgttaaccgggtcccgttacccccgggacccccgttaccggttacccgttacccgg

SEQ ID NO: 132591 - DNA, 654 bp, Homo sapiens
  misc_feature: GYAE6OF02GQCPM.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacaggacggccacgctgacctggtgggggatacacaattggaagtaatcgtgtgcacgtcggtaccagcagacggccagggccacggccctggtggtcgtcgtctataatgacgtaacggaccgccctcgacgggactcccgtgacgcgtattctcgtggcctaccgtaacgttccgggacaaccgcccgggaccctaccccgtcacgttccacgttacccgaacccggtaggggtaccgggacggggtaccgggggatacgggacgggacccgtaacgttaccgtaaccgtcggttaccgtaggggttcggtagggttactttccgaacgttaccgtgtactcgtagttcggggttcggggttcgttccggggcgggtacggaccgacggtcgcggtaaccgttccgtaagtccgacggtccaacgggtccgttcccgccccggtcgtacctaccg

SEQ ID NO: 132592 - DNA, 836 bp, Homo sapiens
  misc_feature: GYAE6OF02HFJHS.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccacccgtcggtgtcagtcggcccaggacagacggccacgctgacctggtggggatacacaagttaggaagtaagtcgtgtgcacgtggtaccagacaggacggccgacgggaccaccggtcccgtggttgggttcgttcggttactaataagtgaacgtaaccggacccggtcccttcgaacgggtactcccgtagacggtacgtacgttccgttcggtcggtccttaccgtaacggtttccggggaacctaaaccggacccggtaccctaaccccgtactaaccttaccgtaaccgttacccgtaaccgggtaacgggggtaccgggaaaccggggggtacccgggggtaacgtacggggaaccgggttaaccccggtaaaccgtttaaccggttaaccggttacggttacggtaacggggtttcgggttaacgggttaccgttttaaccgtaaccggtttaacgttacggtaaccgttacggtaacgggtttcgggggtttacgggggttccggttaacggggtaccgggggtaaaccgggtaaccggtaacgggtaccggttaaccgggttaacccggttaaccgttaaccgggtaacccgtacgggtacccgtaacggtcccgttaccccgggtacccccgttcggttacccgttacccg

SEQ ID NO: 132593 - DNA, 723 bp, Homo sapiens
  misc_feature: GYAE6OF02F47NY.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccacccgtcggtgtcagtcggccccaggacacggaccggccacgcgtcgaccgtgggtgggggactacgaactaagttagggaaacgttaagtcggtggtcgcctacgttacggtaccagacgaacggacgggccgacgggccgaccggccccgttggttcgggttcgtcgttactaatacgtacgtaacgtaccggacccggtccctacggacgggtacctcccgtaggacgcgtattccgtcgtcgtcctaccgtaacggttccgggaaccaaccggaccggaccctacctacactctactccgaaccggtacggggtccggacggggtccgggtagtacgggaccggccgtaccgtaaccgttacgtcggtacgtagggtcgtacgggttactttaccgtacttacgtcgtacgtcgtagggttcgggttacggggttcggttacggggacgggtaccgggacgacggtaccgtaccggtaccgtaccgtacggtaccgtacggaccggacggtacccgtcccggtccccgttaccggccttacccg

SEQ ID NO: 132594 - DNA, 660 bp, Homo sapiens
  misc_feature: GYAE6OF02GXZWA.10.39.D06.1.454.CMB.1.raw
  modified_base (268)..(268): a, c, t, g, unknown or other
  misc_feature (268)..(268): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacagaccggccacgctcgaccgtggtgggggactacactaattggaagtaatcgtgtgcacgtggtaccngacgagacggccaggccacggtcccctaggtcggttgtcgtctaataagtgaagtaaccggaccgccctacgagggactcccgtgacgtaccgtattccgtcgtcggtcctaccgtaacggttccgggacaaccgaccggaccctacccgtacactccacttacccgaccggtacggggtaccggacggggtccggggagtcggaccggtacccgtactaccgtacgtcggtacgtaggtcggtggtaccttacgaccttacgtgtacctacgtacgttgggtacggggttctacggggcggtacggaccgagtccggtaacggtacccgtacgtaaggccgtacggacccgtacgggtcctacccggtccccggtacgtcccttaacccgg

SEQ ID NO: 132595 - DNA, 756 bp, Homo sapiens
  misc_feature: GYAE6OF02F2WBB.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggcccgaggacacgacggccacgctcgaccgtggtggggactacacaattacggaagtaatcgtgtgacacgtcggtaaccagacaggacggccaggaccgacggccctggttcgggtttcgtcgttcttaatagtaggtaactaaccggaccggtccctcgagggtactcccgtaggacggcgtattcctcgttcggacctacctaacggttcgggacaaaccggaccggaccctacccgtactacgtacctacgtacccaccgggtaggggtccggacggggtaccggggaagttcggggaacgggtcccgtaacgttacgtacgtacggtaccgtagggttcggtagggtttacctttacgaaccttagtagtacgttacgtaacggttgggttccggggggttaccgttaccggggaccgggggtaaccgggtacccgtaaggtacccggttacggttaacccccgggttaacgtaaccgggttaacccggaccggtaaccccggtacggggttccccttacccccgggtaccccccggtttacgggtacccctttaccccgg

SEQ ID NO: 132596 - DNA, 738 bp, Homo sapiens
  misc_feature: GYAE6OF02HIJAZ.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgaccctcctagtgcgctcgacctcacgcccacccgtcggtcgtccacggtcggccccaggaccacggaccggccacgctcgaccgttgggtacgggggataccaacgtaagttagggaagttaactcggtggttcgacctacgttacggtaacccaggcgaacggacggcccgtaacgggcccaaccggggccccttgggttcggggttttcgtccggttacttaattaacgtagaacgttaaccggaccccggtcccttacggacgggtacctcccgtggacgtacgtattccgtcgtcggcctaccgtaaggttccgggaaccaaaccgcccggaaccctccccgtactaccgtacctactaccggtaccggtaaccggggtacggaccgggggaccgggtacggtcggaccgggaccggtacctacgttacgtgtacgtgggtacgggtggtactttcctacgttacgtacgacttacgtcgttgggttcggggttcggttcgggacgggacgggacgacggtcggtccggtaccgtacgtacgtccgacgccgtaaccgccgtcccgtcccgtcgtaccgtcccg

SEQ ID NO: 132597 - DNA, 758 bp, Homo sapiens
  misc_feature: GYAE6OF02H3VD9.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgcccacccgtcggtgtcagtcgcccgaggacagaccgcacgcgtcgaccgtggtaggggactacactaagttagggaaagttacgtcgtggtacgcctacgtacggtaccaggaccgaggacggaccgacggacccgaccggtccccgttggtttcggttacgtcggttactaagttaacgtacggaacgtaaacccggcccggtacccctagacggggtaaccttcccggaggacgtctacgttctcgtcgtccttaacgtacggttaccgacgtaaccgtacccgaccctaaccgtctacctacacctaccgaccggtacggggtacggaccggggacgggtacgtacgggacccggacctaaccgttaaccgttcgttcgggtacgtacgggtggttacggtaccgtttaacgaccgttagttacggtctacggtacgggttcggggtttcggggtaccggttacgggggaccgggtaacggtaccggtaacggttcggtacccggtaccgttaacggtaccgaccggaccggtacccggacggttcccgtaccccggtaacccggttcggtaacccttcccgg

SEQ ID NO: 132598 - DNA, 690 bp, Homo sapiens
  misc_feature: GYAE6OF02JAFVU.10.39.D06.1.454.CMB.1.raw
  modified_base (341)..(341): a, c, t, g, unknown or other
  misc_feature (341)..(341): n is a, c, g, or t
tcagcatagtagtgcacgaccggtgctcgatttagtgacatctcgcagttctttggggctgggcctaaggaagcagcactggtggtgcctcagccatggcctggaccgttctcctcctcgggcctcctctctcactgcacagactctgtgacctcctatgcgctgactcagcccaccctcggtgtcagtcggcccaggacagaccggccacgctcgacctggtggggatacacaattggaagtaactcgtgtcgcacgtggtaccagcagaggccaggccaggcccctggtactcggtcctctagtgatgatacgcgacccggcctcgacgggactcccgngacgcgtacttctcgtcgctaccactcgtacggaaccaccgcccaccgtcgaccatccgaccgtacggggtacgaacgggcggggtactacggacgggaccgtaacgttaacgtttacgttacggttaccgtggtttacggttagggtttacgtttacgtaacggttacgtttacgttacgttacggggtttccggggggttttccgggaccggggtaaacgggtacccgtaaggtccgtacggttacccgggttccgttacgggtacccgtaaccggtacccggtaaccggtcccggttcccggtacccccgttacggttccccgtacccgtttcccggttaccccgg

SEQ ID NO: 132599 - DNA, 671 bp, Homo sapiens
  misc_feature: GYAE6OF02H90JN.10.39.D06.1.454.CMB.1.raw
tcagcatagtagtgcacgaccggtgctcgatttagtgacatctcgcagttctttgggggctggggcctaaggaagcagcactggtggtgcctcagccatggcctggaccgttctcctcctcggcctcccctctcactgcacagactctgtgacctcctatgcgctgactcacgcccacccgtcggtgtctacgtcggaccccgaggaccgacggaccggaccacgccgtcggtaccgtgggtggggggaactacgaactaagttaggaaagtaattcggtgtgcacgtcggtacagcagacggcgacggcacggcccgtgtggttcgtctctatagtgacaaccgccgcctcgaggtactccagcgtcattctgtgctacgacgtcggacacgaccgacctaccctacactacgactaccgaccggtacgggtacggacggggaccgggtagtacggacgggtaccgtacgttaacgtaccgtcggtacgtagggttggtacggtacttaccgtacttacgtagtactacgtaggttggggtacggggttcgtacgggcgggtaacggaaccgtacggtaccgttacggaccggttaccgtaacggcccgtaaccggacccggtacggtcccgtaccccggtaccccgtcggttacccgtccgttaccccg

SEQ ID NO: 132600 - DNA, 727 bp, Homo sapiens
  misc_feature: GYAE6OF02FYY77.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctggtgtcagtcggcccaggacagacgccacgctgacctggtggggactacactagtaggaagtaatcgtgtgcactggtaccagcaggacggccaggccgacggccccgtggtcggttcgtcggtactaataagtgtaactaaccggacccgggtccctacggacggggtacttccccgtaggacggtaccgtactttccgtcgtcggtacctacccgtaaggttcccgggaactaaccgaccggtcccctaccctacacttccgaactcccgaaccgtacgggggtaccggacgggtacccgggggatcgggaaccggacccggtaaccttacgttaacgttcggtacggtagggttcgggttacgggtactttaccgtaacgttacgtacggtacgttacgtagttcgggggttcggggttccggttacggggaccgggtaagggacccgtaggtaccggttacggtacccggttaccgtaacggtaccgaccggtacccggaacggtcccgtacccggtcccccggttacggtcccgttaaccccgg

SEQ ID NO: 132601 - DNA, 668 bp, Homo sapiens
  misc_feature: GYAE6OF02HT4XC.10.39.D06.1.454.CMB.1.raw
  modified_base (466)..(466): a, c, t, g, unknown or other
  misc_feature (466)..(466): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccacccgtcggtgtcagtcggcccaggacagacgccacgctgacctggtaggggatacacaagttggaagtatcgtgtgcacgtggtaccagcgaggacggccgaggccgacggcccttggtggttcgtcggtactagtaatgaactaacgccggcctacgagggtactcccgtgacgcgtacttcgtcgtcgtcctacgtaacgttacgggaccaaccgacccgggccctaacccgtacgtaactaccgtaactacccgaaaccggtacggggtccgggacgggaccggggtanacgggacggacccgtaactacgttacgtacggtacgtagggttcggtacggttacttcgaacttacgtgtaactcgtaaggttgggttcggggtcgtacggggacgggagggaccgtaaggtccgttacggaacccgttacgtaacgtaccgaccggtaccgaacggtcccgtacccggtaccccgttcggtacccttaccg

SEQ ID NO: 132602 - DNA, 764 bp, Homo sapiens
  misc_feature: GYAE6OF02IM7VM.10.39.D06.1.454.CMB.1.raw
tcagcatagtagtgcacgaccggtgctcgatttagtgacatctcgcagtttctttggggctgggcctaaggaagcagcactggtggtgcctcagccatggcctggaccgttctcctcctcggcctcctctctcactgcacagactctgtgacccttcctagtgcgctgacctcacgcccacccgtcggtgttccgacggtccggacccccgagggaacgaacggaccgggacccaccggtcgtcgtacccgtggggtaggggggaacttaacaacgtaaaggttaggaaagttaacgtcggtagtcgctacgtggtaaccgagcgaaggacggccaacggccgaccgggtcccttggtcgggttcggttcgttactaattaagtcggaaacgttaaacccgggaccccggtacccctacggtacgggtaccttcccgtaggacgacgttacttccgtcgtcggtacctaccgtaaggttccgggaacaacccgacggacccacccgtactacgtaccacgtcccaaccggtaacgggtccggacgggggaccgggtacgtacgggaccggtaccggtaccttaacggttacgtcgtcgtagggttacggttaggtacttcgtacgttagtacgtacttcgtaggttcggggttacggggttcgacgggacgggaacggtacgaccgtcggccggttaaccgtacggtactaccggacggtacccggtacggtcctacccgggtaccccgttacgtccctaccgg

SEQ ID NO: 132603 - DNA, 636 bp, Homo sapiens
  misc_feature: GYAE6OF02IOEWE.10.39.D06.1.454.CMB.1.raw
  modified_base (382)..(382): a, c, t, g, unknown or other
  misc_feature (382)..(382): n is a, c, g, or t
tcagcatagtagtgcacgaccggtgctcgatttagtgacatctcgcgagttctttggggctgggcctaaggaagcagcactggtggtgcctcagccatggcctggaccgttctcctcctcggcctcctctctcactgcacagactctgtgacctcctatgcgctgactcagccaccctcggtgtcagtcggccccaggacagacggccacgctgacctggtgggggatacgactaattggaagtaatcgtgtgacacgtggtaccagcagagccaggccaggccctgtcggttgtcgtctataatgataacgccggcctgagggactccgtgagcgtattcgtctggcctacaagttccgggacaacgaccggcccaccctnactcataccaccgacgggtcggacgggccgggtatacggacggaccgacttacgtaacgtggtacgtaggtacggtcgggtacttttcgaacttaacgtacggacttacggagtttcgggttacgggggttacctttcggggacgggtaaccggggacccgtaaaggtccgtaaccgggtaacccgtaccgttaaacggtacctaccggaccccgaagggtccctacccggaccccccgttcggaccctacccg

SEQ ID NO: 132604 - DNA, 881 bp, Homo sapiens
  misc_feature: GYAE6OF02HNWJV.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccacctcggtgtcacgtcgcccaggaccagacggccacgcgtcgaccgtggtagggggactaacaactaagttaggaagtaagttcgtgtacgtcgtaacgtggtaccacgtcaacggacggccgaacggcccgaacggtccccgttggtgggttacggttccggttactaagtaaagttcgaaacgtaaaccgggtacccgggaccccgttacggaaacgggtacctcccggtacggacggtaccggtaactttccgtccggttacggtaccgttacccgtaaacggtttaccggggtaccgaaccgtaacccgaccccgtaacccgtacctaacctaccgtaaccgtaacccgaaccccggtaaggggtccgggaaccgggggtaccggggtaattcggggaaccggtacccggtaaaccgttaacccggttacgtttagggtaccggttaacggggtttcggggtaaacgggtttccctttaacgaaacccggttttaacgaccggtttactaacggttacgggttttaggggtttccggggggtttacgttacccgggggaacgggttaacgggggaacccgttaagggttaacccgtacggggttaccccttaacgggtaaaccgttacccggaaccggttaaccccggtaaccgggccccgtttaaccccgggtccccccggttacggttaaccccttcccggg

SEQ ID NO: 132605 - DNA, 636 bp, Homo sapiens
  misc_feature: GYAE6OF02F1IB7.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccacccgtcggtgtcaggtcggcccaggacaggacggccacgctcgacctggtaggggatacactaagttaggaaagtaatcgtgtgcacgtcggtacagcaggacggccgaggccgacggccctggtggttgtcgtactataagtagaacgtaaccggacccggtcctacgacgggtactcccgtagacgtcgtattccgtcgtcggtctaccgtaacgtcggactaaccgaccgaccctaccctacactacactaccaccggtacgggtcgggacgggacgggagtacggacggaccgaactacgtacgtcgtacgtaggtgggtaggtacgttacaacgtacgtagtacgtacgtaggttgggttcggggttcgtcggggacgggacggacgaacgtcgtacggtaaccgtacgtaacgtacgacggaccgacggtacctccggtccccgtcgtactcccg

SEQ ID NO: 132606 - DNA, 517 bp, Homo sapiens
  misc_feature: GYAE6OF02GI0NB.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggactccctgacgcgattctctggttccaagttcgggcaacacggccaccctcatcatcacagggtcgaggccggggatcggacggccgactactacgtcgtcgaggtgtgggtatttcactacgtgatcagtgtggggtcttggcggaggccagcgtgaccgtctacgcgagccgaggctcgccccgtcgtccactcg

SEQ ID NO: 132607 - DNA, 623 bp, Homo sapiens
  misc_feature: GYAE6OF02G9HP2.10.39.D06.1.454.CMB.1.raw
  modified_base (115)..(115): a, c, t, g, unknown or other
  misc_feature (115)..(115): n is a, c, g, or t
  modified_base (159)..(159): a, c, t, g, unknown or other
  misc_feature (159)..(159): n is a, c, g, or t
  modified_base (597)..(597): a, c, t, g, unknown or other
  misc_feature (597)..(597): n is a, c, g, or t
  modified_base (600)..(600): a, c, t, g, unknown or other
  misc_feature (600)..(600): n is a, c, g, or t
  modified_base (603)..(603): a, c, t, g, unknown or other
  misc_feature (603)..(603): n is a, c, g, or t
  modified_base (610)..(610): a, c, t, g, unknown or other
  misc_feature (610)..(610): n is a, c, g, or t
  modified_base (614)..(615): a, c, t, g, unknown or other
  misc_feature (614)..(615): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
tcagcatagtagtgcacgaccggtgctcgatttagtgacatctcgcagttctttgggggagagactgaagaacccagcattgcagcagctcatcatggcctggctctctgctccncacctcctcagtctcctcacgagggttgactcagcctaccttcngcatcgagccctccgtgggacgccgtcggtcacactcacctgccacctagaacacgaccgactacattcgttcggctcgacggcctacgaagtcggtcgtacctacgaacccaaccaaaccaacaactacaacggaaggagggtagagtacgtccgtcctcacgtggcgggacaagacgaagtggacgaggtaggatacgtaagtttcggagaacgtagtcggttacgggacggtaacggaacccgtaaaccggtcggtacccgtttaccgttaccggtaacggcgtaaccggaccgtaacggtcccgttacccggaccccgttacggtacctaaccgttccgttaccgttccccgtaccccgtacccgttacccgtaacctaacgtacgtcgtacgtacggacggcgggtcgtacggacgtaaggcctagactagcntgngancgctgcngcgnngngnagtg

SEQ ID NO: 132608 - DNA, 685 bp, Homo sapiens
  misc_feature: GYAE6OF02GRB2S.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggcccaggacagacggccacgctcgaccgtggtgggggatacactaagttaggaagtaatcggtgtgctactggtaccagtcgagacggccgacggccgacggcccctggtcggttcgtcgtactaataagtagaactaaccggccggccctacgacgggactacccgtgacgtacgtacttctcgtcggcctacctaagttcggactaacgaccggcctaccctctactccgactaccgaccgtaacgggtccggacggggaccgggtagtcggacggaccgtactacgtacgtgtacgtaggttcggtacggtactttacgtaacgtacgttacgtacttacgtaggttcgggttacggggttcgtttaccggggacgggtaacgggaaccgtaacggtccggtaacggtacccgttaaccgtaacggttacccggaacggtacccggtaacgggtcccttacccgggaaccccgttccgggtacctaccccgg

SEQ ID NO: 132609 - DNA, 729 bp, Homo sapiens
  misc_feature: GYAE6OF02HJLC9.10.39.D06.1.454.CMB.1.raw
tcagcatagtagtgcacgaccggtgctcgatttagtgacatctcgcagttctttggggctggggcctaaggaagcagcactggtggtgcctcagccatggcctggaccgttctcctcctcggcctcctctctcactgcacagactctgtgacctcctatgcgctgactcacgcccacccgtcggtcgtcacggtcggcccaggacaggaccggccacgctcgaccgtggtgggggataccgactaagttaggaagtaagtcggttgtgactacgttcggtacagcaggacggccgaggccacggccctggtggttgtcgtctatatgaacgtacgaccgccctcgagggtactccgtgacgacgtacttcctcgtcgtaccttaccgaagtttccgggaccaaccggtacccgggaccctacccgtactacgtaccacgtacccgaaccggtaaggggttaccccggaagggggccccggggtaataccggggaaccgggtacccggtaaccttaccgttaaccggttcgggtaccggttaacgggttgggttaccggggttaactttaccggtaacgtaccgtggtaacttcggtaggttcggggtttcgggggttccgttcggggaccgggtacgggaacgtaagggtccgtaacggtaccgttacggtaacgtccgaaccggtaccggacggtccgtaccccggtcccggttacgtaccgttcccg

SEQ ID NO: 132610 - DNA, 803 bp, Homo sapiens
  misc_feature: GYAE6OF02G0SFR.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgaccctcctatcgcgctgacctcgacgcccacccgttcggtcgtcgacgtccgggaccccaaggaccgaacggaccggacccaaccggccgtacggtaaccttggggtaagggggaactaaccgaaccgtaaagttaagggaaaagttaaacgtccggtaggttcgaccgaacgtacggtaacccaaggacgaaggacggacccgacggacccgacgggtccccttggtacggtttcggtcgtactaagtaactagtaaccgtaaccgacccggtaccctaggaccgggtactaccccgtagacgtcgtacttccgtgtaccggtctaccgtaacggttccggaaccaaccgtaacccggaccctaaacccgtcgaacttacctacgtaacccgaaccgggtacgggtaaccgggacggggaccggggttaagaccgggtacggaacccggtaacgttaaccggtttacgtacgggtacgtaacggggttacgggttacgggtttaccttaacgtaccgttacggtacgtacgttacggtaacgttgggggttaccggtcggtacggggacggtaacggacgaacgtcggtccgtaacgtaccgtaagtccgaaccgtacccggacggtcccgtacccgtcccgtgtacctcccg

SEQ ID NO: 132611 - DNA, 646 bp, Homo sapiens
  misc_feature: GYAE6OF02FS54O.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccctaccctcggtgtcagtcggccccaggacaggaccgccacgtctcgacctgggtacggggaatacacgtaagtttaggaagtaatcgtgtgctacgtggtaccagcaggacggcctacggcccacggccccgtggtacggtttgtcggtactataatcgtaacgtaaccggaccgtcccgtacgagggtctcccgtggacgcgtattccgtcgcggtctaccgtaagttcccgggtacaaaccgccggcccctaccctagtaactcctataccgacgtacgggtcggacggggccgggtagtcggaccggtccacgtacgtcgtacgtcgtagggtggttacggtattacgtactacgttgtacgttcgtacgttcgggtacgggttcgtcggggacgtagggtaccgaggtcgtacggtaccgtacgtaacgtcgccgcggccgtccgtcccggccccgtacgtcctacccg

SEQ ID NO: 132612 - DNA, 781 bp, Homo sapiens
  misc_feature: GYAE6OF02HLKHG.10.39.D06.1.454.CMB.1.raw
tcagcatagtagtgcacgaccggtgctcgatttagtgacatctcgcagttctttgggctgggcctaaggaagcagcactggtggtgcctcagccatggcctggaccgttctcctcctcggcctcctctctcactcgcacagtactctgtcgacctcctatgcgtctgacctcacgccacccgtcggtcgtcgacgtcggccccaggacacgacggtccacgctcgacctgggtggggatacacacgttaggaagtactcgtgtgctacgtacggtaccacgacgaggacggccgacggaccgaccggccccgttggtcggttcggttccggttactaattaacgtagtaacgtaaaacccggcccggtcccgtacgacgggtaccttacccgcggtaacgcggtacttccgtgtccggtacctttaccgtaacggtttccggaactaaacccggtacccgaccctaacccgcgtaactaccgtactccgaacccgggtcgggtaacgggccgggtaccggggttaacgcggtaccggaccggtaaccttacgttaacgtcggtcgttaacgggtggttacggtacctttccgaaccgtttcgttacggtactcgttacgggttcgggtttacggggggttaccggttaccggggtacggggaacgggtacccgtaacggttcccgggtaaccgggttaacccggttaaccgtaaccgttacccggacggtaccccgtaacgggcccgttcccggtacccccggttacgtcccttaccccgg

SEQ ID NO: 132613 - DNA, 760 bp, Homo sapiens
  misc_feature: GYAE6OF02GG6VC.10.39.D06.1.454.CMB.1.raw
  modified_base (130)..(130): a, c, t, g, unknown or other
  misc_feature (130)..(130): n is a, c, g, or t
  modified_base (253)..(253): a, c, t, g, unknown or other
  misc_feature (253)..(253): n is a, c, g, or t
tcagcatagtagtgcacgaccggtgctcgatttagtgacatctcgcagttctttgggctgggcctaaggaagcagcactggtggtgctcagccatggcctggaccgttctctcctcggcctcctctctcnctgcacagactctgtgacctcctatcgcgctgacctcacgcccaccctcggtgtccagtcggcccaggacaggaccgccacggctgacctggtggggataccactaacgttggaaacgttacncggtcgtgctacgtcggtaccgagtacgaggtacggccgagggccgacggaccccgtggttcgggttcggtccgtacttaacgtagtaggtaacgtaaccggaacccgggccccttacggaacggggtaccttaccccgtagggaccgtaccggtactttccggtaccgttaccggtccttaacccgtaacggttaccgggtacccaaaccggcccgggtaccctaaccccgtctaaccgtccgtaaccgtaccgtacccgtaacggggtaccggacggggtaccggggtatacggggacccgggtccgtaaaccgttccggtaaccgtacggttccggtagggttcgggtacggtttacttcgtaacctacggtcgtagtcctaaggttcggggtccgggtacgttcggggaccgtaccgggtacgacggccggtcggtacccggtaacgttaccggacctacggacccgtcggaccgttcccggccccgttaccggtcgtacccg

SEQ ID NO: 132614 - DNA, 620 bp, Homo sapiens
  misc_feature: GYAE6OF02JJDVP.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccaccctcggtgtcacgtcggcccaggacaggaccggccacgctcgacctggtgggggatacacaagttaggaagtaagtcgtgtgcacgtcggaccagcgagaggccaggccacggccctggtgtgtctactatagtgatacgaccgcctcgacggactccgtagacgacgtacttctcgtcggactacgtaacgtccgggacaaccgtaccggacccaccgtctactacactaccgacggtacgggtccgaacgggtaccgggatacgggacggaccgtactaccgtacgtcgtacgagggttgtacggtacttcaacgttacgtcgtacttacgagttcggggtcgggtcgtcgggacggacggactaacggtccgtaaccggtacttacgtacgtaccgacggaccgtacggccgttcccggtaccccggttccgtacgtaccg

SEQ ID NO: 132615 - DNA, 682 bp, Homo sapiens
  misc_feature: GYAE6OF02GV2M1.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccaccctcggtgtcagtcggcccaggacagaccggccacgctcgacctggtgggggatacacaagttagggaagtaagtcggtgtgacacgttgggtaccagccgaggtacggcccgacggccgacggcccgtggtcggttgtcgtctatatgtaactaacggaccggcctcgagggtctccgtgacggtctacttctcgtcgggaccttaccgtaacgttccgggactaaccgaccgcccgtaaccccgtacaccgtactactacccgaaccggacggggtacggaacggggccggggtatacggggaccggtccgtaacgttacgttacgttacggtcggtacgggttaggtacggtacttacgtaaccgttacttacggtactacggttggtacgggggtttcggggtccgtttcggggaccggggaggtaccgacgcggtaccggtaccgtaccgttaaccgccgtacgaccgacggtccgtacccgtccccgtacggtcctacccg

SEQ ID NO: 132616 - DNA, 965 bp, Homo sapiens
  misc_feature: GYAE6OF02FLUJM.10.39.D06.1.454.CMB.1.raw
tcagcatagtagtgcacgaccggtgctcgatttagtgacatctcgcagttcttgggctggcctaggaagcagcactcggtggtgcctcagccatggcctggaccgttctcctcctcggcctcctctctcactgcacagactctgtgacctcctatgcgctgactctagccaccctcggtcgtcagtggccccagacagacggcccacgctgacctgtgggggatacacaagttcgggaataactcggtagttggcctacgtcggttaccgacggtaccaacggtacgggaccctaacgggccccgaacggtccccccccgttagggtttacgggttttaccgttccgggtttaccctttaaacgttaaaacgtttacggtaaacgttttaaaaccccggaaccccggggtaccccccggtttacccgaggggggtaaccttaccccccgttaggggaaccgccgggtaaccttttaccgtttcccgttcggggtacccgtttacccccgaaaaacggtttttcccgggggacccgtaaaaacccgaacccccggggttccccaaacccccggtttccaacgtttacccgaactttacccgaacccgtacggggttaccgggtaaacggggaccccggggggtattaccgggaacgggaccccggtaaacccgttaaccgttaaccgtaacggtttaccgtaacggggttacgggtttacgggggtaactttttaccgaaccgttaccgttaacgtaacttaccgtaacgttacgggttcggggtttccggttaccggggtcccggggtaacggggtaaccccgtaaacggtacccggttaaccgggtaaaccccggttccccgttaaaaccgggtttcccgaaaccgggtacccccggtaaaaccgggtcccgttaaccgggtccccccccccggtttacgggggttacccctttaaacccccgg

SEQ ID NO: 132617 - DNA, 811 bp, Homo sapiens
  misc_feature: GYAE6OF02HI091.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactcgtgtcgaccctcctagtcgccgtctgacctcacgcccctacccgtggtgtcgacggtccggcccgaggacacggaccggccacgcgtcgtaccgtgggtaggggactacaacgtaagttaggaacgtagtcgtgacgcgtacgtacggtaccagcgaggacgaccgtacgggccgaccggtcccgtggttcggttcgtacgtactagtaactacgtaacgtaaccggccggtcctacgggaacggtcctccggtaggacgtaccgtacttccgtcggtcgtacgttaacccgtaacgggttccggtaaccaacccggtacccggaccctacccgttacaactaccgtacgtaacccgaacccggggtacggggttaaccgggaccgggggtacccgggtataccggggaacccgggtaaccccttaacgttaccggttaccgtagggttccggtaggggtttcgggtacgtttaaccttacgtaccgtttacgttcgaaccgttcggttaggtttccggggtttcggggtccggtaaccggggtaccgggaaccggttaccgaacggttccggtaaccggtttaacccgacggttaccggtaccgacccgggttaacccgcgggttaccccgttccccggtaccccggttccggacctttccccgg

SEQ ID NO: 132618 - DNA, 743 bp, Homo sapiens
  misc_feature: GYAE6OF02GCACE.10.39.D06.1.454.CMB.1.raw
tcagcatagtagtgcacgaccggtgctcgatttagtgacatctcgcagttctttgggctgggcctaaggaagcagcactggtggtgcctcagccatggcctggaccgttctcctcctcgcctcctctcctcactgcacagactcgtgtgacctcctatgcgctgactcacgcccaccctcggtgtcgagtcggccccaggacacggaccggccacgctcgacctgggtcggggatacactaagtaggaagtactcgtgtgctacgtcggtaccagacgacggacggccgacggccgaccgggtccctgggttcgggttacgttcgtaccgttaagtagtagtaacgttaaaccggacccggacccgttcgaacgggtacctcccgtggaacggtcgtacttcctcgtcggtcctaccgtagttccggacaaccgaccggtacccacctacgactaccgtacgtccgaccggtaacgggggtcgaaccggggccgggtagtacgggaccggtaacccgtaccgttacggttaaccgtcgggttaacgttggggttccggttaaggtttaccgtttaccgtaaaccgttacggttaggtacccttagggttacggttcggggttaccggggttcggttacggggacgggttacggacccgtaacgccggttacgtacccggtaattaccggacctacccggaacggtccggtcccgacccggtccccgttaggtcccttacccgg

SEQ ID NO: 132619 - DNA, 613 bp, Homo sapiens
  misc_feature: GYAE6OF02FRR6V.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccacccgtcggtgtcagtcggccccaggacagaccggccacgctcgaccgtggtgggggatacactaagttggaagtaatcgtgtgctacgtggtaccagcgagaggccgaggccacggccctggtggttgtcgtacgtataatgaactaacggaccgccctacggaggactccgtggacgcgtacttctcgtcggctacgtaacgttccgggacaaccgcccggacctacctcactcactaccgaccggtagggtaccggacgggtccgggagtcggaacggccgtaactaccgttacgtagtcgaggttggtggtacttcgaactcgtgtatcgaggttgggtcgggtcgttacgggacggtacggtacgacgtcgtacgaccgttactaacggcgtaccggccgtaacggtcccgtaccgtccccgtacggtctacccg

SEQ ID NO: 132620 - DNA, 724 bp, Homo sapiens
  misc_feature: GYAE6OF02HDJSX.10.39.D06.1.454.CMB.1.raw
  modified_base (222)..(222): a, c, t, g, unknown or other
  misc_feature (222)..(222): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgccacctcggtgtcaggtcggccccaggacagaccgccacgctgaccgtggnggggatacgactaagttaggaagtaatcgtgtgactacgtggtaccagcgaggacggaccgacggaccgacggtccccgtggtcggttcgtcgttctaataagtgaacgtacggaccggtccctacgaacgggtactcccgagacgacgtacttctcgtcggccttacctaacggttcggaccaaccgtacccggaccctacccgtactacgtacctacgtacccgaaccggtaacggggtaccggacgggggtacccggggtaagtacgggaccgggtaacccgtaccgttaacgttaccggttacgtaccggtagggttgggttacgggttatttacccgaacttaacgtgtaacgttacgtggttacggggttcgggggttacgtacggggacgggaaccgggtaccaagggtccgtaacggttacccggttacgtaaccggtacgtaccggtacccgtacgggtccctacccggtccccggtacggtaccgtacccgg

SEQ ID NO: 132621 - DNA, 715 bp, Homo sapiens
  misc_feature: GYAE6OF02HD1VW.10.39.D06.1.454.CMB.1.raw
  modified_base (229)..(229): a, c, t, g, unknown or other
  misc_feature (229)..(229): n is a, c, g, or t
tcagcatagtagtgcacgaccggtgctcgatttagtgacatctcgcagttctttggggctgggcctaaggaagcagcactggtggtgcctcagccatggcctggaccgttctcctcctcgccctcctcctctacactgctacagacgtctggtcgaaccgtccgtactgtcgctgactcacgccacctcggtgtctagtcggcccagacagacgccacgctgacctggnggggatacactaattggaataatcgtgtgctacgtaggtaccagcagacggccaaggccacggcccgtgtggttgtcgtctataatgtaataaccgaccgtcctacgaggtactcccgtagacgtacgtacttcgtctacggtacctacgtaacgttacgggaaccgtaaccgaacccggtccccaacccttacgtaactaccgtaacgtacccgaacgtaccgggggtacgaccgggggaccgggaacgttacgggaccggtacccgtaactaacgttacgtcggtaccgaagggtttcggtacgtaacgttccgtaacgttacgtagacttacggtaggttacgggttcggggttaccgttacggggacgggtaccggaccgtacggtaccggttaaccggtaccggtttaaacgtcgtaacccggtacggaaccccgtagggacccgttaccccggtacccgttcggttaccccttacccggg

SEQ ID NO: 132622 - DNA, 671 bp, Homo sapiens
  misc_feature: GYAE6OF02JEAP9.10.39.D06.1.454.CMB.1.raw
  modified_base (547)..(547): a, c, t, g, unknown or other
  misc_feature (547)..(547): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgaccctcctatgcgctcgactcacgcccaccctcggtgtcacggtcggcccgaggacaggcggccacgctgaccgtggtgggggatacaacaagttaggaagtaatcgtgtgcacgtggtaccagcaggacggcgacggcccacggcccgtggtcggttgtcgtactagtaatgaacgtaccggacccggtccgtacggagggacctccgtaggacgcgtattctcgtcggtcctaccgtaaggtccgggactaacccggaccggtaccctacccgtacacttaccgactaccgaccgggtacgggtcggaaccgggggtcggggaatagggaccgggaccgtacctacgtacgtacggtcgtagggtgggtcggttaacttcgaacgttacgtacgtntacgtagggttcgggtacgggggttcgtacggggacgggaacggtacgaacggtcgtaccgggtacgtacttcggaccacgggacccgtacggcccgtaccccggcccgttccggccttaccgg

SEQ ID NO: 132623 - DNA, 697 bp, Homo sapiens
  misc_feature: GYAE6OF02IL403.10.39.D06.1.454.CMB.1.raw
tcagcatagtagtgcacgaccggtgctcgatttagtgacatctcgcagttctttgggggctgggcctaaggaagcagcactggtggtgcctcagccatggcctggaccgttctcctcctcggcctcctctctcactgcacagactctgtcgaccttcctatgcgctgactcacgccctacccgtcggtgtcaggtcggccccaggacaggacggccacgctcgacctggtaggggactacacgtaagttaggaagtaagtcgtgtcgactacgtaggtaccagacgtagacggccgaggccgacggtcccgtaggtaggttcggtaccgttactaagttaataggtaactaaccggacccgtcccgtacgtaacggtacctaccgtaggtacgacgtacgttccgtcgtcggcctacgtaacggttccggacaaccgtaccggaccctaccctacgtactaccaactaccgaaccggacggggtaccggaacggggaccgggtagtacggacggaccgtacgttaaccgtacgtacgtacgagggttcggtacggttactttacgaacgttacgtacgtacgttacgtagggttcggttacgggggttcgtacggggcggaaggtaccgaaggtcgtaacggtacgtacgtacgaccgacggaccgtacggcctaccggacccgttggtacctaccg

SEQ ID NO: 132624 - DNA, 888 bp, Homo sapiens
  misc_feature: GYAE6OF02IVE48.10.39.D06.1.454.CMB.1.raw
  modified_base (804)..(804): a, c, t, g, unknown or other
  misc_feature (804)..(804): n is a, c, g, or t
tcagcatagtagtgcacgaccggtgctcgatttagtgacatctcgcagttctttggggctgggcctaaggagcagcactggtggtgcctcagccatggcctggaccgttctcctcctcggcctcctctctcactgcacagactctgtcgacctctatcgcgtctagacctcgacgacccctacccgtcgggttcgtccgacggtcccggacccccgaagggaccgaacgggtaccccgggccctaaccggtccgttacgggtaaccccggttggggggtaaccgggggaaaccttaaccgtaaaaccggttaaggttttaagggaaaacggtttacgttcggttcggttacgaccgtacggttaccggtaccgaacggacgaacgggaccggtaccgaaccgggaccgtacccgggtccccgttgggttcggtttccggtaccgttaacttaacgtacgtacggtaaccgtaaccggtaccccggtacccttacgggacggttacccgtaccgtaggtaccgtacgttaccttccgtccgggttacgtccctttaaccggtacggttccgggaaacctaacccggaccggtacccctacccgtaactaccggttaccaaccgtacccgtaacggggtcgggaccgggaacggggtccggtaacggtacgggaacccggcctaacggttaccgtacggttcggtacggtacgggtttcggttaaccgtacttaccgtaaccgtcgttacgtattacggtacggtttcggggtaccgggttcgtacggggaccggaccggttacgngtccggttaaccggtccttaacggtaccgtaccggacggttaacccgcggtacccgtacccggtaccccgtgtacccttaccgg

SEQ ID NO: 132625 - DNA, 751 bp, Homo sapiens
  misc_feature: GYAE6OF02FWGB9.10.39.D06.1.454.CMB.1.raw
  modified_base (157)..(157): a, c, t, g, unknown or other
  misc_feature (157)..(157): n is a, c, g, or t
tcagcatagtagtgcacgaccggtgctcgatttagtgacatctcgcagttcttgggctgggcctaaggaagcagcactggtggtgcctcagccatggcctggaccgttctcctcctcggcctcctctctcacctgcacagactctgtgacctcctangcgctcgactcacgcccaccctcggtgtcacgtcggcccgaggacacggcggccacgctacgacctggtgggggactaacactaagttggaagtaacgtcgtgtgctactcggtaccagcagacggccaggcccgacggtcccctggtcggttgtcgtactagtaactgtaacgtaaccggacccggcccttacgaacggggtacttacccgtaggtacggacggttacttccgtcgttcgggtccttaccgtaaacggtttccgggaacgtaaacccgccgggtaaccccacccgttacacgtaccactaccgaccggtagggtccggacggggtccgggatacggggacccgtaccgaccgttaccgtccgttcgtacggtaagggtacggttcggttaacgtttccgaaaccgttgttacggtacttacggtaggtttcggggtccgggttaccgttacggggaccggggtaacggttacccgaagggtacccgtaccgggtaaccggttacccggtaaacggttccgaacccggtacccggtaacgggtccccgtacccggtcccccgttaccgggtacccttaacccgg

SEQ ID NO: 132626 - DNA, 759 bp, Homo sapiens
  misc_feature: GYAE6OF02IHMA5.10.39.D06.1.454.CMB.1.raw
  modified_base (230)..(230): a, c, t, g, unknown or other
  misc_feature (230)..(230): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatcgcgctgacctcacgccctacccgtcggtctcacgtcggacccgaggacacgacgccacgctcgacctggnggggactacgataacgtaggaagtagtcgtgtcgactacgtacgtaccgagacgaggacggaccgacggaccgacggtccccgtggttcggttgtccgtactaacttagtagtacgtaaccggacccgtcctacggaacgggtcttccgaggacgaccggtacttccgtcgttcggacctttaccggaacggtttccgggaaccaaccggtacccgggaccctacccgttaacaccggttacctaaccgttaccgaacccggtacggggttacccggacggggtacccggggtagtaccggggtaaccgacccggtacgtaaacccgtacgttacggtaccggtaaggtacggttaccggtaatttacccgaggttacctagtacgtacctaaggttcgggttacgggtccgtacgggtacgggaaccgtacggtacggaccggtttacggacccggtttacctaacgggttaccgaccggttacccgaacggtccttacccggccccgttacggacccgtttacccgg

SEQ ID NO: 132627 - DNA, 657 bp, Homo sapiens
  misc_feature: GYAE6OF02G5DPB.10.39.D06.1.454.CMB.1.raw
  modified_base (232)..(232): a, c, t, g, unknown or other
  misc_feature (232)..(232): n is a, c, g, or t
  modified_base (373)..(373): a, c, t, g, unknown or other
  misc_feature (373)..(373): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagcatagtagtgcacgaccggtgctcgatttagtgacatctcgcagttctttggggctgggctaaggaagcagcactgggtggtgcctcagccatggcctggaccgttctcctcctcggcctcctctctcactgcacagactctgtcgacctcctatgcgctgactcacgccctacccgtcggtcgtctacgtcggccccaggacacggaccggccacgctcgacgtggnggggactacgactagtacggaagtaagtcgtgtgctacgtcggtaccagcgaggacggccgacggccgacggtcccgtggttggttcgtcgtctaagttagtagacgtaaccggaccggcccgtacgacgggacttccggngacgcgtattctcgtcgtactacctacgttcggaacaccgacgcctaacccncacncacgtaccacggagggtccgaggggcggaagtcgacggccacgtactacgtcgacgtagggtcgtacgggttctttaaccacggttacgtacggtatcggtaggtttacggggtcggggttcgtacggggcgggaacgggaccaacggtcggtaccgtaacggttaccgtaacgaccgtacgtaacccggtaggtacccgtcccggtaccccttcggtccctaaccgg

SEQ ID NO: 132628 - DNA, 654 bp, Homo sapiens
  misc_feature: GYAE6OF02HTM8T.10.39.D06.1.454.CMB.1.raw
  modified_base (256)..(256): a, c, t, g, unknown or other
  misc_feature (256)..(256): n is a, c, g, or t
  modified_base (377)..(377): a, c, t, g, unknown or other
  misc_feature (377)..(377): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccacctcggtgtcagtcggcccaggaccaggacgccacgctcgacctggtaggggactacactaagttggaagtaatcgtagtcgnacgttggtaccagcgagacggccgaacggccgtaacggcccttagtcggttacgtcgtactactaatcgactaaccggacccgtcctacgagggaacctccgagacggtctacttaccgtntcggacctacgtaagttaccgggactaaacgacccggtccaacccgtcgtactcaactccgaccgtacgggtccggacgggtccggggatcggacggaccgacgtactacgtcgtacgacggttgtagggtactttacgacgttacgtgtacgtacgtagttcgggtcgggttcgtccgggaggtaccggtacgaaaggtcgacggttaccgtaccgtaacgtacccgtacggacccgtaacggcccgtaccggtaccccgttccggtacctacccg

SEQ ID NO: 132629 - DNA, 865 bp, Homo sapiens
  misc_feature: GYAE6OF02I5V2F.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctgactcacgccacccgtcggtgtcaggtcggccccaggacaggaccggccacgctagaccgtgggtacgggggatacgaacttaaagttgggtaaagtaacgtcggttgtcgctaacgtggtaacccaggcgacggacggccacgggcccgtaaccggtcccccgttggggttacgggtttcgttccggttacttaacgtaagtaggtaaaccggttaaccggaccccggtcccgttaacgggaacgggtacccttaccccggtaagggaccggtaccggttaccgtttccggtaccgttccggggtacccttacccggttaaacgggtttaccccgggaacgtaaaacccggtaccccggggaacccctaccccggttccgtaaccttacccgtaacgttacccgaaacccggggttacgggggtaccggggaaccgggggcccgggggttaatcggggaaccggtacccggtacttaacccggtagttccggtacgtggggttcggttacgggttactttaccgtaaccgttacgttactcggttacgttagggttaccgggggttcgggggtttaccgtacgggggtacggggtaaccgggtaacgaccgggtctaaccggggttacccttaacggtaacggtaccgaccggtaccggtacgtaccgttccccggtacccgttccggtaccgttacccg

SEQ ID NO: 132630 - DNA, 787 bp, Homo sapiens
  misc_feature: GYAE6OF02FOOH7.10.39.D06.1.454.CMB.1.raw
  modified_base (283)..(283): a, c, t, g, unknown or other
  misc_feature (283)..(283): n is a, c, g, or t
  modified_base (664)..(664): a, c, t, g, unknown or other
  misc_feature (664)..(664): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcccctctcactgcacagactctgtgacctcctatcgcgcttgactcacgcccaccctcggtcgttcacggtccggaccccaggacaggaccggacctaccgctcgaccgtggtagggggactacgtaactaagttaggaacgtaacgttacgtggtacncacgtacggtaccagcgaagacggcaggtcgacggtcccgtgttacggttcgtcgtactagtaacgtcgaacgtacggacccgcccgtagacgggtacctccgtacgcggtactacttcgtacggttagtccaaaggtttcccggaaccaaacggccgtaaccccgtaaccttacccactttaccaacgttcccgtaacgggtaacggggacccggtaacggggtaccggggaaggtcggtaaaccgggtccaaccggtttaaccgacgtttcggacgtaggggttacggtacgggttacttaccggtacttacgtaacggtaccttagtaccgggtttagggtcggggtttaccggtcgggacccgggtaggtaacccgnggttacccgaccggttacccgtttaaacggaaccggttacccgttaaccgggccccgttaaacgggtcccctaccggttccccccggttaaccgtaccgtaccccgttccgtttaaccccccg

SEQ ID NO: 132631 - DNA, 803 bp, Homo sapiens
  misc_feature: GYAE6OF02HI427.10.39.D06.1.454.CMB.1.raw
tcagcatagtagtgcacgaccggtgctcgatttagtgacatctcgcagttctttggggctgggcctaaggaagcagcacgtggtggtgcctcagccatggcctggaccgttctcctcctcggcctcctctctacactgcacagactctgtgacctcctatgcgctgactcacgccaccgtcggtgtcagtcgacccgagacagacgccacgctgaccgtggtacggggatacgactaagttaggaagtaagtcgtagtcgtacacgttacggtaaccagacgaacggacggacccgaacgggtacccaacgggtccccttaggggttcgggtttcggtaccggttacttaagtaactacggtaaacgtaacccggacccggacccgtacgaacggggtacctcccggtaaggacgaccgttaacgttccgtacgttaccgggacctacccgtaacggtttacccgggacctaaaccggtaccccggaccccttaaccccgtaccgtaactaccgttaacctacccggtaaaccggtaaccggggttaccgggaaccgggggtacccgggggaacggttacgggaaccgggtacccgtaaaccgttacgttaaccgtacgggttacgaacggggtttcgggtaaggttactttaccggaacgttacgtagtacgtacggtagtacggggttcgggttacggtacggggacggaacggggactaacggtcggtaaccggaccgttaagtaaccggtaccaggtacccgaacggtcccgtacccggtacccgtccggtacctaccg

SEQ ID NO: 132632 - DNA, 855 bp, Homo sapiens
  misc_feature: GYAE6OF02HKZUP.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatgcgctcgactcacgcccacccgttcggtcgtcacggtcggccccgaggaccgacggaccggccgacgccgtacggaccgttgggtacggggggtactaacaacgtaagttagggaacggtaagtccggtggtgacgtacgtacggtaaccgagcgtaaggacggaccgaacggccgacgggccccttaggttggttcggttccgttacttaacgtaatacggaacggttaaacccgacccgggtacccctacggaaccgggtacttacccggtagtaggtaccgtacgttccgttccgtcgtaaccgtaccgttaaacggtttccgggaacctaaacccgaccggtacccctaccccgtactacgtaccaagttaccccgacgggtaaccgggtcgggaacggggtaccggggatcggggaacgggacccgttaacgttaccgttacggttacggtaccggttggggttacgttacggggtaccttttaacgaaccttaaggtttcggaactttacggtaagttcggggggttagggggtttcccgttggggggacccgggaaacggggttacccgtaacgggttccggtaaccggttaaccccgggtttaacgtaccgggtacccgtaaccgggaccccgtaagggttccccgtacccccgggttaacccccgtcggttaaaccccttccccggg

SEQ ID NO: 132633 - DNA, 772 bp, Homo sapiens
  misc_feature: GYAE6OF02GM2RQ.10.39.D06.1.454.CMB.1.raw
  modified_base (281)..(281): a, c, t, g, unknown or other
  misc_feature (281)..(281): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacaggctctgtgacctcctatgcgctgactcacgccaccctcggtgtcagtcggcccaggacagacggccacgctgaccgtggtcgggggatacactaagttaggaaagtaagtcggtgtacgcacgtggtaaccagacgaggnggaccaggccacggtccctggtcggttcgtcgtcgtaataagtgtaacgtaaccgaccggccctacggacggtacctccgtaggtacgtcgtacttcgtacgtcggtccttacgtaacggttcggaactaaccgtaacccggacccgtaacccctacgtacgtaccaacgttaccgaaccgggtacggggtaccggtacgggggacccggggttaacgtacgggtaacccgggtacccgaaccggtttaaccgttaaccgtcggttaaccgggtagggggttttacggggtagggttttaaacccgtttacccgtaaacgttaaccgttacggtaactaccgggtttaagttcgggggtttaccgggggttccgtttaacggggacgggtaacgggaccgtacggtaccggtacggtacccgttaccggtaacgtaccggtaacccgcccgtaaggtcccgtaccggttccccgtaggttaccctacccgg

SEQ ID NO: 132634 - DNA, 786 bp, Homo sapiens
  misc_feature: GYAE6OF02F7XOD.10.39.D06.1.454.CMB.1.raw
tcagcatagtagtgcacgaccggtgctcgatttagtgacatctcgcagttctttggggctgggcctaaggaagcagcactggtggtgtctcagccatggcctggaccgttctcctcctcggcctcctctctcactgcacagactctgtgacctcctatgcgctgactcacgccaccctcggtgtcagtcggcccgaggacaggaccggccacgctcgaccgtgggtagggggactacaacgtaagttagggaaagttaagtcggttgtgctacgtcggtaaccaggcgaaggacggaccgacgggcccacggtccccgttgggttcgggttcggttccgttactaagttaaagtgtaaacgtaacccggacccggtcccctacggacgggtactcccggtggacgcgtacttccgtcgtcggtccctacgtaacgttccgggaaccaacccgacccggaccctacccgtacacctactacgtaccgaccggtaacggggtaccggacggggtcccggggtaatacggggaaccggtacccggtaaccgttaccgttaacgttccgtaacggtagggttcggtttacgggtacttttacgtacgttacgtacgtacgttcgtaggttacggggttcggggtttaccggtcgggggtaccggggtaacgggtaccggtaacggtaccggttaacccggtacccggttaccgtaaacgggttcccgaacccggacccggtaacgggttcccccgtcccggtacccccggttccggtacccttaccccgg

SEQ ID NO: 132635 - DNA, 842 bp, Homo sapiens
  misc_feature: GYAE6OF02H4O6J.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgtttctcctcctcggcctcctctctcactgcacacgactcctgtcgaccctctagtcgcgctcgactccgacgcccacccgtcggtcgtacgacggtccggcccgaggaccacggaccggccgaccgtctacggaccgtcgggtacgggggtaactaacgacgaagttacgggtaaagttaagttccgttgtccggtacgtaacgttacggtaacccgacgtaccgaagggtaccgggcccggtaacggacccggaccggtccccgttagggttcgggtttcggtaccggtttactaattaacgtacgaacgttaacccggaccccggtcccgtacggacggtacctcccggtagacgtaccggtacttccgtacgtcggtacctaccgtaacgtccgggactaacccgccggaccctaccgtactactaccgtacctacccgaaccggtacggggtacgggtaacgggccggggtagacgggacgggtacccgtaacgtaccgtaacggttcggtacggtacgggttcgggttacggtacgttttcgaaccttaacgttagaacgttacggtacgggtttgggggtttccgggttacgggttaccggggaacgggttaccgggaccgtaacggtaccggttaaccgtacccggttaacgtaacggtaccggaaccgtacccgggtaacggtccccggtcccgggtacccccggtttacggtacccgttaccccg

SEQ ID NO: 132636 - DNA, 866 bp, Homo sapiens
  misc_feature: GYAE6OF02IXJR0.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctagtgcgctgactcagccaccgtcggtgtcagtcggcccgaggacagacggccacgctcgaccgtggtagggggactacgacaagttaggaagtaacgtcggtgtcgacgtacgtacggtaaccagaccgaggacggaccgacgggccgaccggccccgtggttcgggtttcggttccgtacgtaagttaaagtacggtaaccgaaacccggaccccggtccccgttaacggacggggtaaaccttcccggttagggaccgtaccggtacgtttccgttacgggttacgtacccgttaacccgtaaaacggtttcccggggaaccgtaaaacccgtaccccgggaacccctaacccctacgtaacgtaccgtacctaacccggaacccggtaacgggggtacccgggaaacgggggcccgggggtaacgttacggggaacccggtacccggtaaccgtaaaccgtttaacgtccgggttaacggtacgggttacggggttacgggttaacctttacggtaaaccgttacgtacgtaacgttacggttgggttacgggggttcgggggtttacccggtacggggggtaccggtaacggggtaccccgtaaggttccgtacccgggtaaacccgttaccggtaaccgttaccggacccggttaacccggaacgggtcctcccccgggtacccgttacgggtaccctacccgg

SEQ ID NO: 132637 - DNA, 901 bp, Homo sapiens
  misc_feature: GYAE6OF02GBOAM.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgaccctctatgcgctgactcacgaccctaccccgtcggtcgtcgacggtccggacccccgaaggaccgacggaccggacccgacgccgtcgaccgttgggacgggggtactaaccgaacgtaaggttagggtaaagttaacgttcggttacggtcgtaccgacgttacggtaacccgaaggtaccgacggaccggaccgaaccggcccgtaccgggtccccgttgggttacggtttcggtaccgttacttaaagtaacgtacgtaaccgtaaaccggccccggtaccctacgggaacggtcccttaccggaggtaccggtacgtttacgttaccgttcgtcggttaccctaccggtaacggttccggaaacccgtaacccggtaccccgaacccctaccccgtacctacctacctaaccggtacccgtaacccgggtagggggtaccccggggaacgggggtaccgggtaacggtaccggggtaaccgggtaccccgtaaaccgtttaccggttaaggtaccggtttacggggtacgggttaggggtttaccggtttacctttaaccggtaaacgtcgtaaccgttccgtacggttacggggtttcggggtaccgggttcgggtaccgggaccggggaaccgtacggtaccgtacgggttacccgtaaccggttaaccgtccggtaacccaaccggtacccccggacgttccccggtacccggttcccccggttacgtccccggttaccccg

SEQ ID NO: 132638 - DNA, 886 bp, Homo sapiens
  misc_feature: GYAE6OF02FXT2E.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctccgtcggcctcctctctcactgcacagactcgtgtcgacctcctagtgcgtcgtacgactcacgcccacccgttggtcgtcgacggtccggccccaggacgacggacggcccacgtcgtacggtaccgtgggtaggggactaccacgtaagttaggaaagtacgtcggtgtcgactacgtaggtaaccagcgacggacggccgaacggccaccggtcccttaggttcggttacgttcgtacttaagtaagtacgaacgtaaccgggccccgccgtttacgggaacgggtaccttcccgtagggtaccgtacggttaactttccggtacggttccggtaccctttaccggtaacgggtttccgggaaccgtaaccgggtacccgggacccccttaacccggtactaacctaccgttaacgtacccggtaaacccgggttacgggggaaccgggtaaccgggggccggggttaaacgttagggggtaaacccggttaccggtaaacccgtttacgttaaaccgggttcgtacgggttaacgggttacggggttaccgttttaacgttaccgaaccggtttacgttacggaacgtttacggtacggggtttacggggtttccgggttaccggttacgggggtaaccgggggaaccgtttaccgtaaggtcccgggttaaccgtaacccggttaccgggaaaccgtttaccggaccggtaacccggcggtttacccccgtcccgggtacccccggttacggtaccccttacccgg

SEQ ID NO: 132639 - DNA, 666 bp, Homo sapiens
  misc_feature: GYAE6OF02FT1BP.10.39.D06.1.454.CMB.1.raw
tcagcatagtagtgcacgaccggtgctcgatttagtgacatctcgcagttctttgggggctgggcctaaggaagcagcactggtggtgcctcagccatggcctggaccgttctcctcctcggcctcctctctcactgcacagactctgtgacctcctatgcgctgactcacgccaccctcggtgtcagtcggccccaggacacgacggccacgctcgacctggtgggggatacacaagttggaagtaatcggtgtgcacgtggtaaccagcaggacggccacggccgacggcccctggtcggttgtcgtctataatgaataccggccgcctgagggactcccgtggagcgtattctcgtcggactccgtagttccggactaaccgacccggcccaacccgttcaacgtctactaccgaccggaacggggtcggacggggcccggggtagtacgggacgggtacccgacttaaccgtacgtcgttacgagggttcgggtacggtatttcgaaccttacgtggtactcgtagtggggttcgggggttccgttcgggggacggtaacgggaccgaacggtccggttcggtaacccggttaccgttaacgtccgaaccggtaccccgaacgggtcccgacccgggtacccccgtcggtacccttacccgg

SEQ ID NO: 132640 - DNA, 739 bp, Homo sapiens
  misc_feature: GYAE6OF02GBA27.10.39.D06.1.454.CMB.1.raw
  modified_base (468)..(468): a, c, t, g, unknown or other
  misc_feature (468)..(468): n is a, c, g, or t
  modified_base (702)..(702): a, c, t, g, unknown or other
  misc_feature (702)..(702): n is a, c, g, or t
tcagcatagtagtgcacgaccggtgctcgatttagtgacatctcgcagttctttgggctgggcctaaggaagcagcactggtggtgcctcagccatggcctggaccgttctcctccgtcggcctcctctctcactgcacacgactcgtgtcacctctatgcgctgactcgacgccctacccgtcggtcgtcgacggtccggaccccgtaaggacacggaccggcccacgcgtacggtacgtggggttacggggactaccgaacgtaagttaggaagttaacgttcgtcgtgaccgtacgtacggtaccgagtcgaggacgtaccacggtccgacggtcctggtcggttacgcgtagtactaagtacgtacgtacgacccgtcgtacgcggtactccgagtacgtccgttacgtccgtcgtcggtacctaccgtaacggtacccggactaaacccggcccggttacccncccgtttacgaactaccgtaccgtaacgtaaccggaccgggggtaccggaaccgggggacgggtaccgtacgggaccgggtaccctaaacggtttaccggtactacggggttaacgtcgggttaacggtacgggtttactaccgttacgaacgtcgtgttaccggtagggtttcggacgggttcgtacgggcgggttacccgatacggtccggtacgtactaccgtaaggtccncggtaccggctaccgtcccggccgtacgttactccgg

SEQ ID NO: 132641 - DNA, 771 bp, Homo sapiens
  misc_feature: GYAE6OF02FNZWC.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcacgcccacccgtcgggtgtcgaggtcggaccccgaggaccacggacggcccacgctacggaccgtggtagggggactacgactaagttagggaagtagtcgtggtcgactacgtcggtaacacgacgaaggacggccgacggcccgacggtccccgttagggttcgggttacgtcgttacgtaacttaagtacggtaacgtaaccggacccggtacccgtacggacgggtacctacccgtggacgtccgttattccgtcgtacggtccgtaaccgtaggttacccgggactaaacccgtacccggacccctacccgtactacgtaccgtaaccgtacccgtaaccgggtacggggtaccggacgggggtacccgggtagtacggtacccgggaccggtaacctaccgttacgacggttacgtaggggtgttaccgggttactttaaccgtacgttacgtacgtagttaccggtagggttcggggttcggggtacgtttaccggggacgggtaaccggtaccgacggtccggtaaccggaccgttaccggaacgtaccggtacgtacccgacggttccgtacccggtccgttccgacttcccgg

SEQ ID NO: 132642 - DNA, 747 bp, Homo sapiens
  misc_feature: GYAE6OF02JUNUY.10.39.D06.1.454.CMB.1.raw
  modified_base (149)..(149): a, c, t, g, unknown or other
  misc_feature (149)..(149): n is a, c, g, or t
  modified_base (157)..(157): a, c, t, g, unknown or other
  misc_feature (157)..(157): n is a, c, g, or t
  modified_base (161)..(161): a, c, t, g, unknown or other
  misc_feature (161)..(161): n is a, c, g, or t
  modified_base (628)..(628): a, c, t, g, unknown or other
  misc_feature (628)..(628): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgcncctacctntgcncgtgactcgacgccctacccgtcggtgtacacggtcggccccgaggacacggacggccacgctacgaccgtgggtagggggtaactacaacgaagttacggaaagtaacttcgtggtacgtaccgtaccgttggtaaccgacgccgaagggaccgggacccgaacgggtccgaccggtccccgttagggttcggttcgttacggtactaacgttaagtcgaacgtaaccgcccggtccgtacggacggtaaccttcccggaggacgacgttacgttccgtacgtcggtaccttacgtaacgttccggggaactaacccgaccggtaccctacccgtctaagttaccgacacccggtacgggtacgggttccgggaacgggtccgggagtacggccggtaaccgtaccttacgttacgtacgtacggtacgggttcggtacggttcgtttcaaccgtttgacgttacnccggtagttcgggttagggttccgtaacgggcgggaaccggtagtaccgtacggcggttacccgacgttacgtaccgaccgtacccggcgttacccgccgtccccgtaggtcctaccgg

SEQ ID NO: 132643 - DNA, 704 bp, Homo sapiens
  misc_feature: GYAE6OF02HBMGZ.10.39.D06.1.454.CMB.1.raw
  modified_base (465)..(465): a, c, t, g, unknown or other
  misc_feature (465)..(465): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactcgtgtcgacctctagtgcgctgacctcacgacccacccgtcggtcgtcaggtcggaccccgaggaccgacggaccggccacgcgtcggaccgtgggtaggggactaacgacgtaagttacggaagtatacggtgtgctacgtacggtaacacggcgaacggaggacccgacgggaccgacggtaccccgttggggttacggttacgttccgtaacgtaagtaagtacggtaacgaaaccggtacccggcccgtacggaacgggtacctaccgagaccgacgtactcgtacgtcggacctaacgtacgtaccggactaaccnccgggtaccctacgtacacttccgacgtaccgaacggaacgggtccggaacggggccgggtaagtacggacgggaaccgaccttaccggtacgtcggtaagtacgggtgtacgggtacttacgtaactacgtagacttggtagttcggggttgggtacgtcgggacggacggactggacgtacggaccttacgacgtacgaccgtacgtacgccttaccgcccggttacgacctaccgg

SEQ ID NO: 132644 - DNA, 706 bp, Homo sapiens
  misc_feature: GYAE6OF02JIBMQ.10.39.D06.1.454.CMB.1.raw
  modified_base (664)..(664): a, c, t, g, unknown or other
  misc_feature (664)..(664): n is a, c, g, or t
  modified_base (698)..(698): a, c, t, g, unknown or other
  misc_feature (698)..(698): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctagtgcgtctgactcgacgccaccctggtcgtcaggtccggccccaaggacgacggccgccacgcgtcgaccgtggtaggggactaccgacaagttaggaaagtaactcgtgtcgacacgtcggtaaccagaccgtaggacggccgacggaccgaccggtcccgtggtcggttcgttcgtactaacgtaacgtagtaaccgtaacggacccgtcccgtacggtacgggtaacctccggtacggacgtaccgtacgttccgtcggtccgtaccgtacgttaaccggtacggacctaaaccggacccgtaccctaacccgttactaacttaccgacgttaaacccggaccggtagggacccgggaagggtaccggacgtacgggaccggtccggtaacttacggacgttcggacgttaggtcggtagttacgtacgtataccgatcgagtacgttacgggtcgggtaccgttgggaacggtacggaccgtgtaccggttccgaaccgttntaaccggcaaccggcgacgtccaccgtcccggtnaccctccg

SEQ ID NO: 132645 - DNA, 749 bp, Homo sapiens
  misc_feature: GYAE6OF02JHUBL.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgacacagactctgtcgacctcctatgcgctcgactcacgcctaccgtcggtgtctaggtcggacccgacggaacgacggaccggaccaccgctcggtaccgtgggtagggggaactacaataacgttaggaaattaacgtcggtagtgacgtacgtacggtaaccgagacgaggacggccgaacggtaccgacggtacccgttggttggttacgtacgttacgtaacttaagtagaaaccgtaaccggacccggtaccgtacgaacgggtacctcccggtacggtaacgtcgttactacgttacgtcgtaccgtaacgtaacggttaccggaaccaaccggtacccggaccctaacccgtcgactaccaaccgtaaccggaaccgggtaacggggtcgggaaaccggggcgggtaacgtcgggaacggtaaccctacgttaaccgtacggtagtacggaagggttcgtacgtacttcgacttagctaacgtgtaacggttgggtacgggggttccgtaacgggacgggttacggacccgaaggttccgaacgggttacctaacgtaacggtccgaaacgtccggacggttcctacccgcccgttagtcctaccg

SEQ ID NO: 132646 - DNA, 669 bp, Homo sapiens
  misc_feature: GYAE6OF02F8YPB.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagcccaccctcggtgtcagtcggccccaggacaggacggccacgctgaccgtggtggggatacactaagttaggaagtagtcggtgtgctacgtcggtaccagcgaggacggccgaggccacggccctggtggttcgtcgtctaatatgaactaaccgaccggtcctacggacgggactcccgaggacgcgtacttctcgtcggtctaccgtaagttccgggactaaccgcccggtacccacccgtcactactataccgaccggtacgggtacgggacgggtacccggggtagtcgggaccggacccggtaaccttacgttaccgtacggtcggtaggttcgggtggtttaacgttcctacgttacgtgtacgtagtaggttggggttcgggttcgttcggggacgggtacgggaccaacggtcggttaccgaccggttaacctacggtccgaaccggtaccggacggtcccgtacccgtccccgttaccggccttacccg

SEQ ID NO: 132647 - DNA, 811 bp, Homo sapiens
  misc_feature: GYAE6OF02GDAJT.10.39.D06.1.454.CMB.1.raw
  modified_base (353)..(353): a, c, t, g, unknown or other
  misc_feature (353)..(353): n is a, c, g, or t
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtcgacctcctatcgcgctgacctcacgcccacccgttcggtgtcaggtcggccccaggacacggaccgccacgcgtcgtaccgtgggtgggggactacaactaagttagggtaaattaacgtcgtagtcgactacgtacggtaaccagacgaaggcggccgacggccgaccggtcccgtggtacggttcgtaccgtataagttaanagaacgtaaccggacccggtcccgtacggaacgggtaccttcccgagtaccggtactacgttccgtcgtcggtaccgtaacccgttacggttccgggaaccaacccggtaccccggtacccctacccgtactaacgttaccgaccgttaaccgaccgggtaacggggtacccggggtaccggggtaccggggtacgtaccggggaccgggtaccctaaccgttaacgttacgtcggtacggtacgggttggttacgggtttacttacgtacgttacgtacgtacttacggttacggggttcggggttacggggttccggtaccggggacgggggtaaacccgtaccggtaacggtccgggttaacggtaaccccgtttaccgggtaacgtacccggaacgtaccccgggtacggttcccggtcccccggtaccccggttaccggtcccgttaccccgg

SEQ ID NO: 132648 - DNA, 702 bp, Homo sapiens
  misc_feature: GYAE6OF02GG5DY.10.39.D06.1.454.CMB.1.raw
tcagcatagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgactgactcacgccaccgtcggtcgtcagtcgcccgaggatagacgccacgctcgacctggtggggatacgaacaagttggaagtaatcggtggtagcctagtcggtaaccagaccgaggacggaccgacggccgacggccccgttggtcggttcggtcgtacttaagtaatacgaagtaaccggaccgtccctagacggactcccgtgacggcgtattcgtctcggcttaccgtaggtcggtaacaccgaccgacccctacctccaacgtacacctaccgtacgtacggggccggaccggggcgggtaacgtacgggaccgtaccggtacctaccttacggtacgtggtacggggttagtacgggtttcttacgacttacgtacgtacggttcgtagttacggggtttcggggtcggttaccgggaacggggacggtaccgtaggtaccggtcccggttaaccggtacccggtaacgttaccggacccgtaaccggtaccggtacccggtccccggtcccccgttaaggccctttaacccg

SEQ ID NO: 132649 - DNA, 257 bp, Homo sapiens
  misc_feature: GYAE6OF01COZCG.44.13.B02.1.454.CMB.1.raw
  modified_base (139)..(139): a, c, t, g, unknown or other
  misc_feature (139)..(139): n is a, c, g, or t
  modified_base (243)..(243): a, c, t, g, unknown or other
  misc_feature (243)..(243): n is a, c, g, or t
  modified_base (250)..(257): a, c, t, g, unknown or other
  misc_feature (250)..(257): n is a, c, g, or t
tcagacagtatatacacgaccggtgctcgatttagtctagcgactttggatttgggacgagaattcgctctcaccatcagcagcctgcagcctgatgattttgcaacttattactgccaacaatataatagtttttcgnggacgttcggccaagggactaaggtggaagtcaaacgactgtggctgcaccatctgtcttcatctccgcatctgatatatactgtctgagcgggctggcaggcncataagnnnnnnnn

SEQ ID NO: 132650 - DNA, 251 bp, Homo sapiens
  misc_feature: GYAE6OF01AXCTM.44.13.B02.1.454.CMB.1.raw
  modified_base (250)..(251): a, c, t, g, unknown or other
  misc_feature (250)..(251): n is a, c, g, or t
tcagacagtatatacacgaccggtgctcgatttagtctagcgactttggatttgggacagaattcgctctcaccatcagcagcctgcagcctgatgattttgcaacttattactgtcaaaagtacaacagtgcccctcacactttcggccctgggaccaaagtggatatcaaacgactgtggctgcaccatctgtcttcatcttccgcatctgatatatactgtctgagcgggctggcaaggcgcatagnn

SEQ ID NO: 132651 - DNA, 256 bp, Homo sapiens
  misc_feature: GYAE6OF02GNTOK.44.13.B02.1.454.CMB.1.raw
  modified_base (253)..(256): a, c, t, g, unknown or other
  misc_feature (253)..(256): n is a, c, g, or t
tcagacagtatatacacgaccggtgctcgatttagtctagcgactttggatttgggacagaattcgctctcaccatcagcagcctgcagcctgatgattttgcaacttattactgccaacaatataatagtttttcgtggacgttcggccaagggactaaggtggaagtcaaacgaactgtggctgcaccatctgtcttcatcttcccgccatctgatatatactgtctgagcgggctggcaaggcgcatagnnnn

SEQ ID NO: 132652 - DNA, 268 bp, Homo sapiens
  misc_feature: GYAE6OF02JDN1C.44.13.B02.1.454.CMB.1.raw
  modified_base (248)..(248): a, c, t, g, unknown or other
  misc_feature (248)..(248): n is a, c, g, or t
  modified_base (254)..(268): a, c, t, g, unknown or other
  misc_feature (254)..(268): n is a, c, g, or t
tcagacagtatatacacgaccggtgctcgatttagtctagcgactttggatttgggacagaattcgctctcaccatcagcagcctgcagcctgatgattttgcaacttattactgccaacaatataatagtttttcgtggacgttcggccaagggactaaggtggaagtacaaacgaactgtggctgcactatcctgtcttcatcttccgcatctgaatatatactgtactgagcggctggacagcgnagtagnnnnnnnnnnnnnnn

SEQ ID NO: 132653 - DNA, 408 bp, Homo sapiens
  misc_feature: GYAE6OF01EN4AH.37.30.C08.1.454.CMB.1.raw
  modified_base (266)..(266): a, c, t, g, unknown or other
  misc_feature (266)..(266): n is a, c, g, or t
  modified_base (402)..(408): a, c, t, g, unknown or other
  misc_feature (402)..(408): n is a, c, g, or t
tcagtagtgtagatcacgaccggtgctcgatttagtctgacgtcaaagggaaagagccaccctctcctgcagggccagtcagagtgttagcagcagctacttagcctggtaccagcagaaacctggccaggctcccaggctcctcatctatggttcatcctcaagggccactggcatccccgacaggttcagtggtcgtgggtctgggacagacttcactctcaccatcagcagactagagccggaagactctgcagtgtatttcngtcagcagtatggcagctcacctcgacgttcggccaagggaccaaggtggaaatcaaaacgaactgtggctgcaccatctgtcttcatcttcccgcatctgaatctacactctgagcggctggcaaggcgcatagnnnnnnn

SEQ ID NO: 132654 - DNA, 409 bp, Homo sapiens
  misc_feature: GYAE6OF01D50RN.37.30.C08.1.454.CMB.1.raw
  modified_base (403)..(409): a, c, t, g, unknown or other
  misc_feature (403)..(409): n is a, c, g, or t
tcagtagtgtagatcacgaccggtgctcgatttagtctgacgtcaaaggggaaagggccaccctctcctgcagggccagtcagagtgttagcagcagctacttagcctggtaccagcagaaacctggccaggctcccaggctcctcatctatggttcatcctcaagggccactggcatccccgacaggttcagtggtcgtgggtctgggacagacttcactctcaccatcagcagactagagccggaagactctgcagtgtatttctgtcagcagtatggcagctcacctcgacgttcggccaagggaccaaggtggaaatcaaacgactgtggctgcaccatctgtcttcatcttcccgcatctgaatctacactactgagcgggctggcaaggcgcatagnnnnnnn

SEQ ID NO: 132655 - DNA, 549 bp, Homo sapiens
  misc_feature: GYAE6OF01BRX7E.37.30.C08.1.454.CMB.1.raw
  modified_base (186)..(186): a, c, t, g, unknown or other
  misc_feature (186)..(186): n is a, c, g, or t
  modified_base (278)..(278): a, c, t, g, unknown or other
  misc_feature (278)..(278): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (532)..(533): a, c, t, g, unknown or other
  misc_feature (532)..(533): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
tcagtagtgtagatcacgaccggtgctcgatttagtctgacgtcaaagggaaaggagccaccctctcctgcgaggccagtcagagtgttagcagctagctacttagcctggtaccagcagaaacctggccaggctccaggctccgtcatctatggttcatcctcaagggccactggcatccccganaggttcagtggtcgtgggtactggggacagactttcacgtctcaccatccaggccagactaggacgtccggaagactctgcagtgtatttcngtcagcctagtagtggacagctcaccgtcgtacgttacggacgtaaagggccaagggtggaaactcgaaaacgtactgtacggctagacacatctagtacttacactccttacccgctaattctaaggtaacttccgtaacacttactaggaacgcgggtactacgggacctaaagggccggtaactaacgttaaggctacagtacatacagtacgntanacgagagacagtcgatagtagtagcgtatatacnngagtcgngagcntgtn

SEQ ID NO: 132656 - DNA, 487 bp, Homo sapiens
  misc_feature: GYAE6OF01ELECP.37.30.C08.1.454.CMB.1.raw
  modified_base (193)..(193): a, c, t, g, unknown or other
  misc_feature (193)..(193): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (454)..(487): a, c, t, g, unknown or other
  misc_feature (454)..(487): n is a, c, g, or t
tcagtagtgtagatcacgaccggtgctcgattttagtctgacgtcaaagggaaaggagccaccctctcctgcgagggcccagtccagagttgtagcagctagctacttagcctggtaccagcagaaacctggccaggctccaggcttccgtcatctatggtttcattcctctaagggccatggcatccccganaggttcagtggtcgtgggtctggggacagactttcacgtctcaccatccaggccagactagacgccggaagctcngcagtgtatttcngtcagcagtatggcagcgtcaccgtcgacgttcggacgaagggcaagggtgaatcaaagactgaggctagactaacgatcgtagtaccttacacgttccttacccggactagttacgtaaggaacttactaacactactagacgcgggactaggaccaaggacgacagtacgnnnnnnnnnnnnnnnnnnnnnnnnnnnnnnnnnn

SEQ ID NO: 132657 - DNA, 607 bp, Homo sapiens
  misc_feature: GYAE6OF01CVRD5.37.30.C08.1.454.CMB.1.raw
  modified_base (555)..(555): a, c, t, g, unknown or other
  misc_feature (555)..(555): n is a, c, g, or t
  modified_base (571)..(571): a, c, t, g, unknown or other
  misc_feature (571)..(571): n is a, c, g, or t
  modified_base (579)..(579): a, c, t, g, unknown or other
  misc_feature (579)..(579): n is a, c, g, or t
tcagtagtgtagatcacgaccggtgctcgatttagtctgacgtcaaagggtaaggtaggccaccctcgtcctggcagggccagtcaggagtgttagcgacgcagctacttacgccgtggtacccagcagaaacctgggccacggcgtcccacggctcctcatcctatggttcatcctaccaaggggtccacctggccacttccccgacagggttccaacggtgggtcgtgggtctgggacagacttcactctcgaccatcagcagactagagtaccggaagactctagacagtagtaagtttccgcgttacagtacctaagttactggtcagctcaacctccgacgtttcggacaaagggaccgtaacgtagaactacgaaacgacgtggtgctggacaccgagtctggtctttcacttccttcccgacctaattccgtagtaaacttcccgtaacgaaccttaacgtaggaaacggttcgggttacttacgggacttaacggtccgtacgtaacgttaagacgtactatagtacgttccgataggactcactanaacttacagtgtgtgnacactatntctctactactctaccactactgtgtac

SEQ ID NO: 132658 - DNA, 460 bp, Homo sapiens
  misc_feature: GYAE6OF01BZP4C.37.30.C08.1.454.CMB.1.raw
  modified_base (405)..(405): a, c, t, g, unknown or other
  misc_feature (405)..(405): n is a, c, g, or t
  modified_base (429)..(432): a, c, t, g, unknown or other
  misc_feature (429)..(432): n is a, c, g, or t
  modified_base (434)..(460): a, c, t, g, unknown or other
  misc_feature (434)..(460): n is a, c, g, or t
tcagtagtgtagatcacgaccggtgctcgatttagtctgacgtcaaaaggggaaagtagccaccctctcctgcagggccagtcagagtgttagcaagcagctacttagcctggtaccagcagaaacctggccaggctcccaggcctcctcatctatggttcatcctcgaagggccacgtggcatcccccgacagggttcagtggtccgtgggtcctggggacagtacttcacgtctcaccatcagcagactagagccggaagactctcgcgaggtgtatttctgtcaggcagtatggcaggctcacctccgacgttcggcccaacgggccaaggtggaaatcaaaacgactgtgctgaccaccatctgtccttcactccttcccgcatctagactctacactacngacgcggctggcaggcgtcagtgnnnngnnnnnnnnnnnnnnnnnnnnnnnnnnn

SEQ ID NO: 132659 - DNA, 450 bp, Homo sapiens
  misc_feature: GYAE6OF01B1GCM.37.30.C08.1.454.CMB.1.raw
  modified_base (186)..(186): a, c, t, g, unknown or other
  misc_feature (186)..(186): n is a, c, g, or t
  modified_base (262)..(262): a, c, t, g, unknown or other
  misc_feature (262)..(262): n is a, c, g, or t
  modified_base (334)..(334): a, c, t, g, unknown or other
  misc_feature (334)..(334): n is a, c, g, or t
  modified_base (430)..(450): a, c, t, g, unknown or other
  misc_feature (430)..(450): n is a, c, g, or t
tcagtagtgtagatcacgaccggtgctcgatttagtctgacgtcaaagggggaaagggccaccctctcctgcagggccagtcagagtgttagcagcagctacttagcctggtaccagcagaaacctggccaggctcccaggctcctcatctatggttcatcctcaagggccactggcatccccganaggttcagtggtcgtgggtctgggacagacttcactctcaccatcagcagactagagccggaagactctgcagttntatttctgtcagcagtatggcagctcacctcgacgttcggaccaagggaccaaggtgaaatcaaacgactgnggctgaccacatctgtcttcacttccttcccgctatctagaacttcctaacactactggaacggccgggtactacgggacaacggcacgtagtagnnnnnnnnnnnnnnnnnnnnn

SEQ ID NO: 132660 - DNA, 491 bp, Homo sapiens
  misc_feature: GYAE6OF01DRP4I.37.30.C08.1.454.CMB.1.raw
  modified_base (186)..(186): a, c, t, g, unknown or other
  misc_feature (186)..(186): n is a, c, g, or t
  modified_base (252)..(252): a, c, t, g, unknown or other
  misc_feature (252)..(252): n is a, c, g, or t
  modified_base (359)..(359): a, c, t, g, unknown or other
  misc_feature (359)..(359): n is a, c, g, or t
  modified_base (462)..(491): a, c, t, g, unknown or other
  misc_feature (462)..(491): n is a, c, g, or t
tcagtagtgtagatcacgaccggtgctcgatttagtctgacgtcaaaggggaaagggccaccctctcctgcagggccagtcagagtgttagcagcagctacttagcctggtaccagcagaaacctggccaggctcccaggctcctcatctatggttcatcctcaagggccactggcactccccganaggttcaggtggtcgtgggtctgggacagacttcactctcaccatcagcagactaggagccggaanactctgcagtgtatttctgtcagcaggtatggcagtcctccaacctccgaccggttcggaccgtaacgggaccaaagggtaggaaatcgaaaacgactgtacggctnccgactatcttgtccttcaccgttccttccccgctagttcctagacttactaacctacttacgtcgaggtcgggtcgtacgggctaacggcgacagtgcatgnnnnnnnnnnnnnnnnnnnnnnnnnnnnnn

SEQ ID NO: 132661 - DNA, 506 bp, Homo sapiens
  misc_feature: GYAE6OF01B1XI3.37.30.C08.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (408)..(408): a, c, t, g, unknown or other
  misc_feature (408)..(408): n is a, c, g, or t
  modified_base (472)..(472): a, c, t, g, unknown or other
  misc_feature (472)..(472): n is a, c, g, or t
  modified_base (476)..(491): a, c, t, g, unknown or other
  misc_feature (476)..(491): n is a, c, g, or t
  modified_base (493)..(506): a, c, t, g, unknown or other
  misc_feature (493)..(506): n is a, c, g, or t
tcagtagtgtagatcacgaccggtgctcgatttagtctgacgtcaaagggaaagagccaccctctcctgcaggccagtcagagtgttagcagcagctacttagcctggtaccagcagaaacctggccaggctcccaggctcctcatctatggttcatcctcaagggccactggcactcccccgatacgggttcaggttgggtcgtggggtctgggacagtacttcactctcaccatcagcagactagacgaccggaagacctcgtgctagtcgttatttcngtcctagactaggtacgnggcagcctcgaccctcggtacggtccggaccgaagggacctaaggtacgaaactacgaaacgtacgtcggtgactcggaccacctatcgtacgtcttcacttcctcccnctactctagtactactaacgacgtacagggacgtacggcgtaggaccgtaggactcagtagctnctcnnnnnnnnnnnnnnnngnnnnnnnnnnnnnn

SEQ ID NO: 132662 - DNA, 579 bp, Homo sapiens
  misc_feature: GYAE6OF01D0ET1.37.30.C08.1.454.CMB.1.raw
  modified_base (184)..(184): a, c, t, g, unknown or other
  misc_feature (184)..(184): n is a, c, g, or t
  modified_base (544)..(544): a, c, t, g, unknown or other
  misc_feature (544)..(544): n is a, c, g, or t
  modified_base (549)..(552): a, c, t, g, unknown or other
  misc_feature (549)..(552): n is a, c, g, or t
  modified_base (554)..(579): a, c, t, g, unknown or other
  misc_feature (554)..(579): n is a, c, g, or t
tcagtagtgtagatcacgaccggtgctcgatttagtctgacgtcaaagggaaagagccaccctctcctgcagggccagtcagagtgttagcagcagctacttagcctggtaccagcagaaacctggccaggcctcccaggctctcatctatggttcatcctcaagggccactggcatccccganaggttcagtggtcgtgggtctgggacagacttcactctcaccatcagcagactagacgaccggaagactctgctagttcgttatttcgtgtacagactagtatcgggactacgccttccgacccgttccggtaccggtttccgggaacccgtaaacggggaacccgtaaagggtaagggaaaacttaacccgaaaaacggtaacgttcggtacggtacctcggacccaaccctagttcctttaggttcctttacaccgtttcccgttccccgacctattacctagtaactttccctaactaacttacgtacggacgggttcgggacgttagggacctaacgggccaacgtagtacagtcnctagnnnngnnnnnnnnnnnnnnnnnnnnnnnnnn

SEQ ID NO: 132663 - DNA, 435 bp, Homo sapiens
  misc_feature: GYAE6OF02GV0GJ.37.30.C08.1.454.CMB.1.raw
  modified_base (193)..(193): a, c, t, g, unknown or other
  misc_feature (193)..(193): n is a, c, g, or t
  modified_base (276)..(276): a, c, t, g, unknown or other
  misc_feature (276)..(276): n is a, c, g, or t
  modified_base (404)..(404): a, c, t, g, unknown or other
  misc_feature (404)..(404): n is a, c, g, or t
  modified_base (410)..(435): a, c, t, g, unknown or other
  misc_feature (410)..(435): n is a, c, g, or t
tcagtagtgtagatcacgaccggtgctcgatttagtctgacgtcaaagggaaggaggcccaaccctctccctgcgagggccacgtcagagtgttagcagcagctacttagcctggtaccagcagaaacccttggccaggctcccaggctcctcatctactggttcatcctcaagggccactggcatccccganaggttcagtggtcgtgggtctgggacagacttcactctcaccatcagcagactagagtccggaagactctgcagtgtatttcngtcagccaggtatggcagctcacctcgacgttcggccaagggccaaggtgaaatcaaacgactgtggctgcaccatctgtcttcatctccgcatctgactctacactactgagcgggctggcaaggcncatagnnnnnnnnnnnnnnnnnnnnnnnnnn

SEQ ID NO: 132664 - DNA, 417 bp, Homo sapiens
  misc_feature: GYAE6OF02FSVWD.37.30.C08.1.454.CMB.1.raw
  modified_base (406)..(417): a, c, t, g, unknown or other
  misc_feature (406)..(417): n is a, c, g, or t
tcagtagtgtagatcacgaccggtgctcgatttagtctgacgtcaaaggggaaagggccaccctctcctgcagggccagtcagagtgttagcagcagctacttagcctggtaccagcagaaacctggccaggctcccaggctcctcatctatggttcatcctcaagggccactggcatccccgacaggttcagtggtcgtgggtctgggacagacttcactctcaccatcagcagactagagccggaagactctgcagtgtatttctgtcagcagtatggcagctcacctccgacgttcggccaagggaccaaggtggaaatcaaacgaactgtggctgcaccatctgtcttcatcttcccgcatctgaatctacactactgagcgggctgggcaaggcgcatagnnnnnnnnnnnn

SEQ ID NO: 132665 - DNA, 416 bp, Homo sapiens
  misc_feature: GYAE6OF02IYK51.37.30.C08.1.454.CMB.1.raw
  modified_base (184)..(184): a, c, t, g, unknown or other
  misc_feature (184)..(184): n is a, c, g, or t
  modified_base (266)..(266): a, c, t, g, unknown or other
  misc_feature (266)..(266): n is a, c, g, or t
  modified_base (333)..(333): a, c, t, g, unknown or other
  misc_feature (333)..(333): n is a, c, g, or t
  modified_base (400)..(400): a, c, t, g, unknown or other
  misc_feature (400)..(400): n is a, c, g, or t
  modified_base (407)..(416): a, c, t, g, unknown or other
  misc_feature (407)..(416): n is a, c, g, or t
tcagtagtgtagatcacgaccggtgctcgatttagtctgacgtcaaagggaaagagccaccctctcctgcagggccagtcagagtgttagcagcagctacttagcctggtaccagcagaaacctggccaggctcccaggctcctcatctatggttcatcctcaagggccactggcatccccganaggttcagtggtcgtgggtctgggacagacttcactctcaccatcagcagactagagccggaagactctgcagtgtatttcngtcagcagtatggcagctcacctccgacgttcggccaagggaccaaggtggaaatcaaaacgactgnggctgcacatctgtctcatcttcccgctatctagaatctacactactgagcgggctgggcaagggcncagtagnnnnnnnnnn

SEQ ID NO: 132666 - DNA, 408 bp, Homo sapiens
  misc_feature: GYAE6OF02IKODL.37.30.C08.1.454.CMB.1.raw
  modified_base (397)..(397): a, c, t, g, unknown or other
  misc_feature (397)..(397): n is a, c, g, or t
  modified_base (402)..(408): a, c, t, g, unknown or other
  misc_feature (402)..(408): n is a, c, g, or t
tcagtagtgtagatcacgaccggtgctcgatttagtctgacgtcaaaagggaaagagccaccctctcctgcagggccagtcagagtgttagcagcagctacttagcctggtaccagcagaaacctggccaggctcccaggctcctcatctatggttcatcctcaagggccactggcatcccccgacaggttcagtggtcgtgggtctgggacagacttcactctcaccatcagcagactagagccggaagactctgcagtgtatttctgtcagcagtatggcagctcacctccgacgttcggccaagggaccaagggtgaaatcaaacgactgtggctgcaccatctgtctcatcctccgcatctagtactctacactactgagcggctggcaggcncatgnnnnnnn

SEQ ID NO: 132667 - DNA, 424 bp, Homo sapiens
  misc_feature: GYAE6OF02IJTXF.37.30.C08.1.454.CMB.1.raw
  modified_base (417)..(424): a, c, t, g, unknown or other
  misc_feature (417)..(424): n is a, c, g, or t
tcagtagtgtagatcacgaccggtgctcgatttagtctgacgtcaaaggggaaagggccaccctctcctgcagggccagtcagagtgttagcagcagctacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgctagttttatttctgtcagcagtataattactggcctcctacgtggacgttcggccaagggaccaaggtggaaatcaaaacgactgtgctgcaccatctgtcttcattccttcccgctatctagaatctacactactgagcgggctggcaaggcgcatagnnnnnnnn

SEQ ID NO: 132668 - DNA, 590 bp, Homo sapiens
  misc_feature: GYAE6OF02I4A08.37.30.C08.1.454.CMB.1.raw
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (547)..(547): a, c, t, g, unknown or other
  misc_feature (547)..(547): n is a, c, g, or t
  modified_base (551)..(552): a, c, t, g, unknown or other
  misc_feature (551)..(552): n is a, c, g, or t
  modified_base (558)..(558): a, c, t, g, unknown or other
  misc_feature (558)..(558): n is a, c, g, or t
  modified_base (567)..(568): a, c, t, g, unknown or other
  misc_feature (567)..(568): n is a, c, g, or t
  modified_base (571)..(572): a, c, t, g, unknown or other
  misc_feature (571)..(572): n is a, c, g, or t
  modified_base (574)..(574): a, c, t, g, unknown or other
  misc_feature (574)..(574): n is a, c, g, or t
  modified_base (577)..(578): a, c, t, g, unknown or other
  misc_feature (577)..(578): n is a, c, g, or t
  modified_base (582)..(585): a, c, t, g, unknown or other
  misc_feature (582)..(585): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
tcagtagtgtagatcacgaccggtgctcgatttagtctgacgtcaaaggggaaagggccaccctctcctgcagggccagtcagagtgttagcagcagctacttagcctggtaccagcagaaacctggccaggctcccaggcctcctcatctatggttcatcctcaagggccactggcactccccgacaggttcaggtggtcgtgggtctgggacagacttcactctcaccatcagcagactagacgccgaagactntgcagtgttactttcngtcagcagtatggcaggtccttacgacccgtccggaccggttccggaccgaaacggggacctaaagggtacggaaaacttaccggaaaaacggaacgtgggttacggccttaggaccctaacctacttcgtcgttaccttttcctaacgttcccgtttacccccgacttaacgttccgtacgtaaacttaccctaacctaccttacggtacggacgggtcccggtcgtacgggtaaccgacgggtcgaaccgttaactcggatcggnacgtnagnacgnnagcgcngcgtcgtannacnncnagnnagcnnnnanntn

SEQ ID NO: 132669 - DNA, 155 bp, Homo sapiens
  misc_feature: GYAE6OF01ETF2U.44.24.C02.1.454.CMB.1.raw
  modified_base (154)..(155): a, c, t, g, unknown or other
  misc_feature (154)..(155): n is a, c, g, or t
tcagacagtatatacacgaccggtgctcgatttagtacagatcgttagggcaagggaccaaggtggagatcaaacgaactgtggctgcaccatctgtcttcatcttcccgccatctgatatatactgtctgagcgggctggcaaggcgcatagnn

SEQ ID NO: 132670 - DNA, 661 bp, Homo sapiens
  misc_feature: GYAE6OF01B1O0Q.44.24.C02.1.454.CMB.1.raw
tcagacagtatatacacgaccggtgctcgatttagtacagatcgttagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggttcagctggtggagtcgtgggggagcgtggtccagcctgggacgtccctgagactctcctgtgttgcgtccggactcagtttcagtgactctgccatgcacgtcgggtccgccaggcctccgaggcgaaggggctgggagtgggtgcagtcatcgtggtctgagtggaaagtaagatacgtaagtacggaaactcggtaggaacggtccgtattccgtccgtactaccgaaggacgtaactaacgttacccaaacgaaccaccgttagtactactaacaaatacgaaactaagtttaggagaacggaccggaacggtaccgtacgggtaccttccttacgttaatttacgttaccgtaaccggtaccgtacccctaagttcccggtttaccgtaccgggttacggggacccgacggggtacctccccggttacggtacccgttacccggtccttcccgtccgtaacccg

SEQ ID NO: 132671 - DNA, 630 bp, Homo sapiens
  misc_feature: GYAE6OF01E0JYK.44.24.C02.1.454.CMB.1.raw
  modified_base (312)..(312): a, c, t, g, unknown or other
  misc_feature (312)..(312): n is a, c, g, or t
tcagacagtatatacacgaccggtgctcgatttagtacagatcgttagggaaaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggacggtccctggagactctcctgtgcagcctctggacttcactttcagttagttatgctatcgctacgtcggggtcccnccgacggcctccgaggcgaaggggctgggaggtgggtggactagttatatcatatgagtaggaatatgaatacgtacgcaagtactacggtagaacgggtccatccacctatcctaccgaagaacgacctaacttaccgaaagtaacctacgttgtttacgtttcgtagaacctaaagtcgaaacgtacggtacccttagggaacgtaggaccgttagggaacggtaaccgacgggtacgtaaggttagttaagttaccggttaggtacggacggtaacgggaaccgaccggacccgtaaaggaacccgtaaaaccgg

SEQ ID NO: 132672 - DNA, 782 bp, Homo sapiens
  misc_feature: GYAE6OF01EDJGU.44.24.C02.1.454.CMB.1.raw
  modified_base (181)..(181): a, c, t, g, unknown or other
  misc_feature (181)..(181): n is a, c, g, or t
  modified_base (767)..(767): a, c, t, g, unknown or other
  misc_feature (767)..(767): n is a, c, g, or t
tcagacagtatatacacgaccggtgctcgatttagtacagatcgttagggaaagggctgggagacgagcccagcactggaagtcgccggtgtttccattcggtgatcatcactgaacacagaggactcaccatggagtttgggctgagtcttgggttttcctcgttgtcttcttttaaagnggtgtccagtgtcaggtgcagctggtggagtcgtgggggagcgtggtccagccgtgggacgtccctgagtctctccgtgtgcacgtccttcgtaggtactttccgtacttttcgtaaggttacgtttatcggtacttacgtcggtacctacggtccgggggttccccgacccggtaacgggtccctacccgggaggaccgggaaagggggtccgttgggacgggttggggtagggacttaaggtttaatacgtacctaagtttaaggtaggtaagtttagggtaaaaagttaacgtagtaaaacctaacgttaaccggacgtaaaggtacccgttaccgggtaaggaaccgggtacccgtattaccccgaacctaagttcccgtaaccgaaggtaaacccgtaaccttaaacctttaaacccgaaaacggttaacctacggttttacggttttaccgtttaccgaacggtaaacttaaaaccgtaggaacccgtaagtccgtaaggacgtacggccgtaaggacggtaccgaagggtacgtaggttacgttaactttacgcggtcgacgaacggacgaccaaccgngtaacccgtaaacgg

SEQ ID NO: 132673 - DNA, 808 bp, Homo sapiens
  misc_feature: GYAE6OF01BEDGN.44.24.C02.1.454.CMB.1.raw
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (264)..(264): a, c, t, g, unknown or other
  misc_feature (264)..(264): n is a, c, g, or t
tcagacagtatatacacgaccggtgctcgatttagtacagatcgttagggaaaggggctgggagacgagcccagcactggaagtcgccggtgtttccattcggtgatcatcactgaacacagaggactcaccatggagtttgggctgagctgggttttccngttgcttcttttaagnggtgtccagtgtcaggtncagtctggtggagtcgtggggggagcgtggtcccaggccgtggggacgtccctgagacctctccgtggngccacgtcccttgtggtactttctactttcgaagtaaccgtccgttaggacttcggaccgttcggggtcccgaccgtacgggtccgtaccgggaaggggggtaacggggccgttgggggaacgggtttgggggtttaccgggaccgttaaaggttaaaccggaaaaccgtaaacggtcggttaacggaccgggggttacgggaacctaacgggactaaccgggtaaccgtaaccggccgttaacggacccggtaaccccggtaaaggaaaccgggtcctaagtacccttaccgaaacccgttagttacccttaaacggaaagtacgttaagttacgtaactttaaacgtaaaaaggttccgttaacgggtcgttaccttacgtgaactacggtaagttacggaaaccacggtacccgtaagaaaccgacccggaacgacctaacggccgtaccgttaccttaagttcccggtggttaccggtagggttacttcggtttaacgtccggttaccggggaaccgtacccgggtacccgtggtacccc

SEQ ID NO: 132674 - DNA, 892 bp, Homo sapiens
  misc_feature: GYAE6OF01BJP7L.44.24.C02.1.454.CMB.1.raw
  modified_base (185)..(185): a, c, t, g, unknown or other
  misc_feature (185)..(185): n is a, c, g, or t
tcagacagtatatacacgaccggtgctcgatttagtacagatcgttagggaaaggggctgggagacgagcccagcactggaagtcgccggtgtttccattcggtgatcatcgactgaacacagagactcaccagtggtagttggctgagtcgtggtttcctcgttgtcttacgtttaagtaggtntaccaggttgtcgaggtgacgtagtcgtaggtggtacggtcggtagggggacgtcgttcggtccagggtccgtagggaccggtccctgaccgtacctcgttcgtcggtgaccgcgtcccgtagtacggttactttaccgacttttacgacggtttagtttactggtacttagccggtactaaccggggtcggggtaccccgtacggtaccggtaccgtacgggacggggttaaccggacggggggttacctaggggtacgggttggtaacgggttacgttaacgttaaggtaacgttcgtaagtacgggttcgtaaggttcggtaaaaggtacctaagtaaacctcggttaacgacggtaaccgttaccggtaccgggttaacggaccggttacccgtacgttaccgtaaccgtcttacccgtaacgaagggtaaccctaagttaacccgttaacaaacgttacgtaacgtttacgttacgtacgtaacgtaacgttaaactacgggaaccgtacgtaccggttaaggaacggttacgtaaaccgggaccgggttaacgtaccgggaaaaccggttacggttaaacggtttaaccgggtttaacggttaccggtttaccgggtaaccggtaaacgggggtaaaccggtttaacccggtaaccccgggggtaaaacgaacccgggttaaaacccggttaaacccgggg

SEQ ID NO: 132675 - DNA, 643 bp, Homo sapiens
  misc_feature: GYAE6OF01D65IP.44.24.C02.1.454.CMB.1.raw
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
  modified_base (573)..(573): a, c, t, g, unknown or other
  misc_feature (573)..(573): n is a, c, g, or t
tcagacagtatatacacgaccggtgctcgatttagtacagatcgttagggaaagggctgggagaggagcccagcactagaagtcggcggtgtttccattcggtgatcagcactgaacaaagaggactcaccatgggagtttgggctgagcttgggttttcctcgttgcttcttttaagaggtgtccactgtcaggtgcaccgtggtggagtcgtgggggagcgtggtccagccgtgggacgtccctgacgctctcctgtgacgtcctcgtggtattttgttcaggttggttcnggcctagtgcacgtgggtcccnccgagcctccgaggggccgaagggggccgaggttcggtggactagttatgactacntggaacgtggaagttctagtaattactaagcgactacgaccgttcggaggacggtccgtattccgacctacgtcctaccgaagtactaaccgtacgttacccggaatcgtttggtaacgttacgtaggaagttcggtacaggttccgaaggtaacggcgttacgggaaggtccttcggacttcttaagttnttacggngtanacgggtacgtaggttacgggtgtacggtttagttacggtaacggtcccgggatagtagtcggtaccgggg

SEQ ID NO: 132676 - DNA, 572 bp, Homo sapiens
  misc_feature: GYAE6OF02FY10V.44.24.C02.1.454.CMB.1.raw
  modified_base (175)..(175): a, c, t, g, unknown or other
  misc_feature (175)..(175): n is a, c, g, or t
  modified_base (300)..(300): a, c, t, g, unknown or other
  misc_feature (300)..(300): n is a, c, g, or t
  modified_base (484)..(484): a, c, t, g, unknown or other
  misc_feature (484)..(484): n is a, c, g, or t
tcagacagtatatacacgaccggtgctcgatttagtacagatcgttagggaaagggggggagaggagcccagcactagaagtcggcggtgtttccattcggtgatcagcactgaacacagaggactcaccatggagtttgggctgagctgggttttcctcgttgctcttttaagnggtgtccagtgtcaggttcagctggtggagtctgggggagcgtggtccagcctgggactccctgagactctcctgtgttgcgtccggactctagtttcagtgactctgccatgcacgtgggtccnccaggcctccgaggcgaagggggctgggaggtgggtggcaggtcatctggtctgagtggaaataagaatactagtaggaaactcggagaacgggctattcgtccgtctccagacgaactaacttaccaaacgactaccgtagtactactaacaatagaactaattgagacgcgagactcgactntctattacttgacgactcctattccgttctacggtcgggtacgtacgggtaccgtccgtacggtccgtacccgtcctaccgtctaccg

SEQ ID NO: 132677 - DNA, 570 bp, Homo sapiens
  misc_feature: GYAE6OF01B7F0G.13.88.H11.1.454.CMB.1.raw
tcagtcacgtactacacgaccggtgctcgatttagcgacagcgagaacacacaaagggggggagaggagccccagccctgggattcccaagtgttttcattcagtgatcaggactgaacacagaggactcaccatggagtttgggctgagctggattttccttggtgttttttaaaaggtgtccactgtgagctgcagctggtggagtctggggggggcttggtaaagcctggggggtcccttacactctcctgtgtagcctctaaaatcactttcaacgacgcctggatgagctgggtccgccaggcgccgagggaggggactggagtgggttggccgtaattaaaaggcgaggccgagtgggtgggacagcagacttcgctgccaccgtgcaagccagacttcaccctctacaagacatgatttagagtaatactgtagttatttgactaaatgaacagtacttagaacaacgaggacgcgaggtcgtttattactgtcgaccgtagtacgtccaccgtggcctactcttcttcttgacttcgcgggaccacgggtaccctggtcccg

SEQ ID NO: 132678 - DNA, 618 bp, Homo sapiens
  misc_feature: GYAE6OF01CWX27.13.88.H11.1.454.CMB.1.raw
  modified_base (410)..(410): a, c, t, g, unknown or other
  misc_feature (410)..(410): n is a, c, g, or t
tcagtcacgtactacacgaccggtgctcgatttagcgacagcgagaacacacaaagggggggagaggagccccagccctgggattcccaagtgttttcattcagtgatcaggactgaacacagaggactcaccatggagtttgggctgagctggattttccttggtgttttttaaaaggtgtccactgtgagctgcagctggtggagtcgtggggggggcttgggtaaaggccgtgggggtcccttacactctcctgtgtagcctctaaaatcactttcaacgacgcctggatgagcgtgggtccgccaggccgcgaggggaggggactggagtgggtggccgtataaagcgaggccgatgggtggacagcgagacttcgctgcacccgtgcaagccagacttcaccctncaagacatgtattagagaattactgtagttatttgactaaaatgaacagtacttaggaaccgtaaccggaaggaacgaccgtagggtacgtttattacgtggtacgaccgtaagttaccgtccgtacccgtacggccccttagttccttacctttctttacgaccctttcggtcggggtacccgacgggtaccccgtgggtaccccgg

SEQ ID NO: 132679 - DNA, 564 bp, Homo sapiens
  misc_feature: GYAE6OF01BS7BY.13.88.H11.1.454.CMB.1.raw
  modified_base (410)..(410): a, c, t, g, unknown or other
  misc_feature (410)..(410): n is a, c, g, or t
  modified_base (436)..(436): a, c, t, g, unknown or other
  misc_feature (436)..(436): n is a, c, g, or t
  modified_base (490)..(490): a, c, t, g, unknown or other
  misc_feature (490)..(490): n is a, c, g, or t
tcagtcacgtactacacgaccggtgctcgatttagcgacagcgagaacacacaaagggggggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttcctctgacgcctggttgagctgggtcccgccaggcctccggggaaggggctgggagtggggttggccgtattaaagggtagaagacatgggtcgacaacagactacagtgttcccgtagaaaggcaagattcactatctacaagagatgactanaaaagaatgatatatctagacaaatnaaacaacctagaaaacgcgaaggacacgaggcgtagtattacagtaaccagagngtgggaccagatgacaaagtggccgcgacgaggtcgactacgtcgggggcccggaagcccgtagcgaggtcccg

SEQ ID NO: 132680 - DNA, 566 bp, Homo sapiens
  misc_feature: GYAE6OF01BS0ZR.13.88.H11.1.454.CMB.1.raw
  modified_base (216)..(216): a, c, t, g, unknown or other
  misc_feature (216)..(216): n is a, c, g, or t
  modified_base (550)..(550): a, c, t, g, unknown or other
  misc_feature (550)..(550): n is a, c, g, or t
tcagtcacgtactacacgaccggtgctcgatttagcgacagcgagaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanacgccaccctctcctgcagggccagtcagacagttagcaacaacgtagcctggtaccagcagaaacgtggccaggctccgaggcctcctcgatctagtggtgcactccgaccgagggccaacgtggtactcccgaggtacccggttcaggtcgggactaggtgggtcctgggacaggtacttcgactctcaccatcagcagtctcgctagtctagtaagtatttagtctagtttattactgtactacgtacgtagtattaataacgtacgtcctaccgtacgtactagtacgtacgtttaggacgtacgggacctaacgtacggtacgtactanacgtacgtacgtacgg

SEQ ID NO: 132681 - DNA, 670 bp, Homo sapiens
  misc_feature: GYAE6OF01AW8M5.13.88.H11.1.454.CMB.1.raw
tcagtcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagcgtggatttccttggtgttttttaaaaggtgtcactgtgagctgcagctggtggagtcggtggggggggcttggtaagccgtggggggtcccttacgactctcctgtgtacgcctactaaaatcactttcaacgacgcctggatgagctggtccgcaggcgtccgaggggagggacgtggagtgggttggccgtaataaaggcgaggcgagtggtggacagcagtacttcggctcggctacccgtgccaagtccagtcttcaccctgtacagactatgaacgtttagacgtaattactggttacgttagttttagaaccttaaagttcgaaaccgtagtacgtttaccgggaaacaaccccgggtagggacgtaccgtagggtttaccgtttaacttaacgttggacgttaaccctagggttacctaccctacccggtggtcccctaagtttcccttacgtttctttacgggtaccctttcgggaccgggtaccccggtagggttaaccccgtccggg

SEQ ID NO: 132682 - DNA, 658 bp, Homo sapiens
  misc_feature: GYAE6OF01EUJXC.13.88.H11.1.454.CMB.1.raw
tcagtcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggtattttccttggttagttttttaaaaggtgtccactgtgagctgcagctggtggagtcggtggggggggcttggtaaggccgtgggggtcccttacgactctcctgtgtagcctataaaatctacttcaacgacgcctggatgagtcgtgggtcccgaccgaggccgaccgaggggacgggggactggggtaggtgggttaggccggttaaagttaaaaggccggagggccgagttgggtggggactaggcgagtaccgttcgctcgaccgacccgtgacaacgccagtacttccaaccctcgtacgaacgactatagtaactttaaggagtaaactacgtgttagtactttagactaaatgaactagtacttagaaccaacggaggaccgtacgtaggtcgtttaactcgtagttacgcgtacgttacgtccaccgtcggtaccctacgttcctactttcttcgtaccttcggtaccgggccgtaacgggcccttccgggg

SEQ ID NO: 132683 - DNA, 643 bp, Homo sapiens
  misc_feature: GYAE6OF01C0C0R.13.88.H11.1.454.CMB.1.raw
  modified_base (485)..(485): a, c, t, g, unknown or other
  misc_feature (485)..(485): n is a, c, g, or t
tcagtcacgtactacacgaccggtgctcgatttagcgacagcgagaacacacaaagggggggattcccaagtgttttcattcagtgatcaggactgaacacagaggactcaccatggagtttgggctgagctgggttttccttgttgctattttaaaaggtgtccagtgtgaggtgcagctggtagagtcgtgggggaggtgtgggtacggccgtggggggtccctcgagactctcctgtgcaacctctggattcagtattgatgagtatggcatacacgtcgggtcccgaccaaccgtccgaaggggaaggggcctggcgaggtcgggtctcgtaggtaactaaacgtggaatgggtcgaccagaccaacgtaacttagtgacgtagacgtcgtaggtaggaacggccgtattcatcgtatacctcgagagactaggtcgaccgtaataaccgtccgtaacactcgtagactaaagtcgaacgngttcgacggagtacgacggtaccgtacgtccgtttagtactttcgaggtcgtacggtaggttacgacgtagggttcggtacgttacggtaaccgttacggacgtaaggtcgggtaaccgtcggggtacgggaacccgaacggggccctcgggtccccg

SEQ ID NO: 132684 - DNA, 619 bp, Homo sapiens
  misc_feature: GYAE6OF01DZB0E.13.88.H11.1.454.CMB.1.raw
tcagtcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggattttccttggttgtttttttaaaaggtgtccactgtgagctgcagctggtggagtcgtggggggggcttggtaaagccgtggggggtcccttacactctcctgtgtagcctactaaatcactttcaacgacgcctggatgagctgggtccgccgaggcgccgaggggaggggacgtgggaggtggggttggccgtaagttaaaaggcgaggccgagtgggtgggacagcagacttcgctgcacccgtgacaagccagacttccaccctctcaagacatgtatttagataatactgtagttatttgactaaatgaacagtcttacgaacgaaccggaggaccgcgacggtcgttttattacgtgtacgccgtagttacgttcccaccgtcggaccctacttccttaccgtttctttacgtaaccgtttcggtacggggtccctaggggtacccccgttcgggg

SEQ ID NO: 132685 - DNA, 655 bp, Homo sapiens
  misc_feature: GYAE6OF01BRWXR.13.88.H11.1.454.CMB.1.raw
  modified_base (497)..(497): a, c, t, g, unknown or other
  misc_feature (497)..(497): n is a, c, g, or t
  modified_base (638)..(638): a, c, t, g, unknown or other
  misc_feature (638)..(638): n is a, c, g, or t
tcagtcacgtactacacgaccggtgctcgatttagcgacagcgagaacacacaaagggggggattcccaagtgttttcattcagtgatcaggactgaacacagaggactcaccatggagtttgggctgagctggattttccttggtgtttttttaaaaggtgtccactgtgagctgcagctggtggagtcgtggggggggcttggtaaagccgtgggggtcccttacactctcctgtgtagcctactaaaatcactttcaaccgacgcctggatgagcgtgggtcccgccgaggccgccgaggggaggggactgggaggtggggttggaccgtaagttaaaaggcggaggccgagtgggtgggacaggcagtacttcgctgccacccgtgacaagccagtacttccacccctctacaagtacatgtaatttaagagtaacttactgttagttatttgaactaaatgaaactgtccttagaaccgaaccggagaccgngtacggtcgttttaatcgtgtacgccctaggttaccgttcccaccgtcggaccctacgttccttacctttcgtttcgtaccgtttcggtcggggacccgtacggggtaaccccgttgggtccccgtccgttcctcccgtcnccgttcccgtaaccccg

SEQ ID NO: 132686 - DNA, 818 bp, Homo sapiens
  misc_feature: GYAE6OF01D98XT.13.88.H11.1.454.CMB.1.raw
tcagtcacgtactacacgaccggtgctcgatttagcgacagcgagaacacacaaagggggggattcccaagtgttttcattcagtgatcaggactgaacacagaggactcaccatggagtttgggctgagctggattttccttggttgtttttttaaaaggtgtccactgtgagctgcagctggtggagtcggtgggggggggcttgggtaaagccgtgggggtcccttacactctcctgtgtacgcctactaaatctacttacaacgacgcctggatgagcgtcgggtccgccgaggccgccgaggggaggggactgggaggttggggttcggaccgttaagttaaaaggtggacgtccgtggaggtggggtacgggaacaacgtaacggaacgtaccgctcggacccgacccggtaggaacgggcgaacgtaacttcccgaacctacttaccctaccgaaggtacgtagttacggtaaacgtttaccggaaaaacgggtaacccgtaacgttaacgggttttacgttttaccgtaaggtaacttaaaaacggttaccggtaaaccgtaacggtaccccgttacggtaacccgggttaccggggacccccggggtaaccgtaccggttacgggtacccgtttacggttacgtttaaccggtcggttccggaacccgtacggtaacgacggtacccgtaccggtacccgtacggtacccttaacgtttacttttacgtttttcgttaccgtttcgggtcgggacccggtaaccgggtaccccgtcggtaccccgtacccgtccttcccgtcgtacccg

SEQ ID NO: 132687 - DNA, 676 bp, Homo sapiens
  misc_feature: GYAE6OF01C909D.13.88.H11.1.454.CMB.1.raw
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
tcagtcacgtactacacgaccggtgctcgatttagcgacagcgagaacacacgaaagggggggattcccaagtgttttcattcagtgatcaggattgaacacagaggactcaccatggagtttgggctgagctggtattttccttggttgttttttaaaaggtgtccactgtgagctgcagctggtggagtcggtggggggggcttggtaaaggccgtgggggtccccttacgacctctcctgtgtacgcctactaaaatcactttcaacgacgcctggatgagcgtgggtcccgccgaggccgccgaggggagggactggagtgggtggccgtaataaaagcgaggccgagtggtggacagcagtacttcgctggccacccgtgacaagccagacttccaccctctacaagacatgtatttagataatactgtgttattgactaaatgaanagctaanacgaacaaccggaggaccgacgtaggtacgtttattacgtgtcgtaccgtaacggttccttacccgtacctccgggtaccctaaccgttccttaaccgtttctttacggttacccgttcccgggtacgggggtacccccgtaaccggggttaacccccgttcggggtaccccgttacccccgttacccttccccggtaccgtaccggttaccccccg

SEQ ID NO: 132688 - DNA, 652 bp, Homo sapiens
  misc_feature: GYAE6OF01CQQDZ.13.88.H11.1.454.CMB.1.raw
tcagtcacgtactacacgaccggtgctcgatttagcgacagcgagaacacacaaagggggggattcccaagtgttttcattcagtgatcaggactgaacacagaggactcaccatggagtttgggctgagctggattttccttggttgttttttaaaaggtgtccactgtgagctgcagctggtggagtcgtggggggggcttgggtaaagccgtgggggtcccttacactcctcctgtgtagcctctaaaatctactttcaacgacgcctggatgagcgtgggtccgcaggccgccgaggggaggggacgtgggaggtggggttcggccgtaagttaaaacggcggaggccgagtgggtgggacagcagacttcgctgccaccgtgacaagccagtacttccaccctctacaacgactatagtatttagaagtaacttacgtagttgttattgaactaaatgaaactgtcttacgaaccgtaaccggacggacgtacgtaggttcgtttattacgtgtacgtacgtaacgttcgtaccctaccgtcgaccctacttccgttacttccgtttgtaccgttcggcgggtacccgtacgggtaccccgtgggttcccgtcccggttcctccctacgccgtcccgttaaccccgg

SEQ ID NO: 132689 - DNA, 701 bp, Homo sapiens
  misc_feature: GYAE6OF01BPO02.13.88.H11.1.454.CMB.1.raw
tcagtcacgtactacacgaccggtgctcgatttagcgacagcgagaacacacaaagggggggattcccaagtgttttcattcagtgatcaggactgaacacagaggactcaccatggagtttgggctgagctggattttccttggtgtttttttaaaaggtgtccactgtgagctgcagctggtggagtcgtggggggggcttggtaagccgtgggggtcccttacgactctcctgtgtagcctactaaaatcactttcaaccgacgcctggatgagcgtgggtccgccgaggcgcccgagggggacgggactgggaggtggggttggacccgttagttaaaaggcgaggccgagtgggtggacagcagacttcgctgcacccgtgacaagccagtacttccaccctctacaagacagtgtaatttacgaagtaatacgtgttagttatttagactaaataggaactaggtcttacgaaccgtaaccggaaggacgacggtaacggttacgttttaattaccgtggtccgtacctaagggtttaccgtaccctaccgtccggtaccctacgtttccttaccgttttctttacggtacctttccgggtaccgggggtacccgtaaccgggggttaaccccttcgggtacccccgggttcccgttcccgttccccgtaccttaccggttcccgttaacccccg

SEQ ID NO: 132690 - DNA, 898 bp, Homo sapiens
  misc_feature: GYAE6OF01BMKXX.13.88.H11.1.454.CMB.1.raw
  modified_base (196)..(196): a, c, t, g, unknown or other
  misc_feature (196)..(196): n is a, c, g, or t
tcagtcacgtactacacgaccggtgctcgatttagcgacagcgagaacacacaaagggggggagaggagccccagccctgggattcccaagtgttttcattcagtgatcaggactgaacacagaggactcaccatggagtttgggctgagctggtattttccttggtttagttttttaaaaggtgtccactgtganctgcagctggtggaggtcggtggggggtcgttagggtaaggtccggtcgggggtcccttacactctcgtgtgtacgtcctactaaactcaccttacaacgacgctggatgagtcgtcggtccgcgacggcgcgaggggacgggacgtgggtaggttgggtacgtacgtaagtaaaggcggacggacggtaggtgggtaggacgaggcgtacgtacgttcggcgtcggacccaccgtcgaccgaacggaccaacgtaccttaccctaccccgtactaaccgaaacgtataacgttaaggtaagtttaaagaaacgttaacttaacgttaggtttaacgtttaaagtttaccggaaaacttaaaagttacggtaaaacctcggtttaaccgttaacggaaaaaccccggttaacccggggaacgggttaacccgtaacgggttaaacgggttttaaccccgtttttaaacgggttacccgtaagggttacccgtaaacccggttaacgggttttaacccccggttaacccgtaaacccgggttccccgggttaacccctttaaacccggttttacccggtttttaaccctttttaaccgggttttaccccgggttaaaccccgggttttccggggaaccccgggggttaaaccggtttaaccccccgggggtttaaacccccggggttcgggtttcccccccgg

SEQ ID NO: 132691 - DNA, 778 bp, Homo sapiens
  misc_feature: GYAE6OF01D0FDR.13.88.H11.1.454.CMB.1.raw
  modified_base (163)..(163): a, c, t, g, unknown or other
  misc_feature (163)..(163): n is a, c, g, or t
  modified_base (179)..(179): a, c, t, g, unknown or other
  misc_feature (179)..(179): n is a, c, g, or t
tcagtcacgtactacacgaccggtgctcgatttagcgacagcgagaacacacgaaaggggggattcccaagtgttttcattcagtgatcaggactgaacacagaggactcaccatggagtttgggctgagctggattttcctgttagtcttaattttaaaggngtcagtgtagagtgcngtcgtgggtgagtcggtggggagtcttggtacaggtccgtggcgtacggtcccgttagacgtaccttcgtccgtggtcgacctcggtcccttagtacggttactttaccgtaccgttttagtattagtaacttaacgtccgactacgtccgtaccggtacggttacgggccgtaacgaaccggttcccggtaggggaacggggtaccggttacggtacgggtaggttccggtacgtacggttaagtttagttaggtaagtacggtttggacgtacgtaggtacgtacgtagtacgtacggtacgtcgttaggacggtacggtaccgacgtttaccgacctacgtaccgtaaccgtacgaacgaaccaacgaccgaacgtaaccgtaccgtcgtacgtcaacgtaacaacgtacgaacgcgacctaggacgacgtacgtacgacgtaccgtacggtaccgtttagttagttaacgttacgtaccgtaaaccgttaacgtaaacccttaacccgttaacccgttacgtttaacggtttcgggttaacgtacgggtttaccgacgggtttaaccggaccggtcggtaaccgttcggtacccg

SEQ ID NO: 132692 - DNA, 741 bp, Homo sapiens
  misc_feature: GYAE6OF01E0P7E.13.88.H11.1.454.CMB.1.raw
  modified_base (248)..(248): a, c, t, g, unknown or other
  misc_feature (248)..(248): n is a, c, g, or t
tcagtcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggtattttccttggtgttttttaaaaggtgtccactgtgagctgcagctggtggagtcgtggggggggcttggtaagccgtgggggtccttacnctctcctgtgtagcctactaaaatctactttcaacgacgccgtggatgagtctgggtccgccgaggccgaccgagggggacggggacgtgggagggttggggttcggcccgttaagttaaaacggcggaggccgagtgggtgggacagcgagcttcgctgccaccgtgaccagccagtactccaccctcacaagactatagtaatttagaagtaattactgttagttatttcgaactaaattcgaaacgtacgtaccgttagaacccgtaaaccggaacgggtaaccgacggtacgggtttacgttttaacgtttacgttacggttaccgaccgttaaggtttacccgttaccccgttaaccggttcccgggtaaccccgttaacccgtttacccgtttaccgttttaacccgttttaccgttaaccccggtttttcggtaaccccgggggttaaccccgtaaccgggggtaaaccccccggtttcccggggg

SEQ ID NO: 132693 - DNA, 701 bp, Homo sapiens
  misc_feature: GYAE6OF01DUMLU.13.88.H11.1.454.CMB.1.raw
  modified_base (441)..(441): a, c, t, g, unknown or other
  misc_feature (441)..(441): n is a, c, g, or t
tcagtcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggattttccttggttagtttttttaaaaggtgtccactgtgagctgcagcgtgggtggaggtcggtgggggggggtcttagggtaaacggtccggttcgggggggtacccttaccgaccttccgttccgtggtgtacgcctactaaaatcctactttcaaccgaccgtccgtggatgacgcgttcgggtccgccgaggccgccgaggggcgggacgtgggaggtgggtcggacgtagttaaacggcgaggcgagtggtggacagcgagtacgttcgctcgctaccgngacaggccagtcttaccgacctcacgaacgtactagtagtatttaacggataacgtaacgttgtagttacgtttagaacctaaagacgtaagacgtacgtacgaacgaaaccgtgggaaccgtacgtaggttacgttttaatacgtacggtcgtaccgtaggttacctcccgtaaccgttcggacccttacttcccttacgttttctttccgtaccgtttacgggtccggggaacccgttcggggtaacccggttccggg

SEQ ID NO: 132694 - DNA, 821 bp, Homo sapiens
  misc_feature: GYAE6OF01A3P73.13.88.H11.1.454.CMB.1.raw
  modified_base (345)..(345): a, c, t, g, unknown or other
  misc_feature (345)..(345): n is a, c, g, or t
  modified_base (503)..(503): a, c, t, g, unknown or other
  misc_feature (503)..(503): n is a, c, g, or t
tcagtcacgtactacacgaccggtgctcgatttagcgacagcgagaacacacaaaggggggattcccaagtgtttcattcagtgatcaggactgaacacagaggactcaccagtggagtttgggctggagcgtggacttttccgtcgctcgacttaagttttaaaaggtgtaccgtagtggtcgaaggtgacgtaagtgggtggtacggtcggtggggggggtacttgggtaacggccggtcgggggtccctacgagtcctcgtccgtgtcggacctacctcgtagtacttcttacttttctcgtacggtccgtcgttggttgacgtcggtacggtcccgaccgnggtcccggtaccggggagggtcgtgggtaacggttcggggttacggaccgttaaggttaaacgggtagaacggacgtacgttgggaaccgaacgtaacgcgtaaccgttacgtagttcggtacccggtaaggaaacggtcaatcgttacacgttactntaacgaagtacgagttaacgaaccgtaagaaaaacgtgtaacgtagtttaactacgttataacggaaagtaaacgtaacgaaaccgaaaccgtaaaggtaaaccgggacgaaaccgggtaacaaccgggtaacgtcgggtttaaacccgtaagttacccgtttaacgaaaccccgttaaggtaacggaacggtcggtaaaccgtagtaacgtaacggacgtaccgggacgtaccccggtaaggtagtaccgggttaaacggcccggttaccggggacgggtacccggttaacggaccgttaacgccggtatccccggg

SEQ ID NO: 132695 - DNA, 955 bp, Homo sapiens
  misc_feature: GYAE6OF01BNZE7.13.88.H11.1.454.CMB.1.raw
tcagtcacgtactacacgaccggtgctcgatttagcgacagcgagaacacgacaaaggggccgggagaggagccccagccctgggattcccaagtgtttcattcagtcgatcaggactgaacacagaggactcaccatggtaggtttaggctgagcgtagggtactttttccgtttaggtttaggtttttttaaaaagggtcgttacccgtaacgttggtagtagtcgtcgacgagtcgtgggtggacggttcgggtggggggggtacttagggtaaacggtccggttacggggggtacccttacgacttcgtccgtggtagtacgtacctattaaaactcgtaacctttacgaaccgtacggtccgtaggtagtaggacggtcgtccggggtacccacggtcggaccgccgggaaggggacggggtacgtacggggtacggttcggggttcgtaaccggttaaaggttaaacggcgggtaacgggacccgtaagggttacgggtaagggtacgacgtaccgaacgtacgtccgtacgtacggtacccgaccggtacgaacgaaccggaccgtagttaaccgttaccccaacccgtttacgaaacccgaacggttaaccgtaaggttaacgtaagttttaaacgaaaccggtttaaacttccggtttaaggttaaccggttttaagttaaccgggaaactttaaaacgggtaacgtaaaccgttacggttaaaccgttaaccggaaacccggttaaaccgggagggtaacccggaggtttaaccgggtttactttaaacgttaccggtaccggttaacgacccgtttaaggtacccgtttaccccggaagggttccctacccgttaacgtttcccgttaacctttcggtttaacgttaaccccggttcggtaacccgggggtaccgtaaaccccggggtttccccggttaacggg

SEQ ID NO: 132696 - DNA, 596 bp, Homo sapiens
  misc_feature: GYAE6OF02GT4RL.13.88.H11.1.454.CMB.1.raw
tcagtcacgtactacacgaccggtgctcgatttagcgacagcgagaacacacaaagggggggattcccaagtgttttcattcagtgatcaggactgaacacagaggactcaccatggagtttgggctgagctggattttccttggtgttttttaaaaggtgtccactgtgagctgcagctggtggagtcgtgggggggggcttgggtaaagccgtggggggtcccttacactctcctgtgtagcctctaaaatcactttcaacgacgcctggatgagctgggtccgccaggccgccgaggggaggggactgggagtgggtggccgtataaaagcgaggccgatggtgggacagcagacttcgctgcaccgtgcaagccagacttcaccctctcaagacatgatttagagaatactgtgtatttgacaaatgaacagcttagaccaaccgaggacgcaggtacgtttattactgtagcctagttacgttccaccgtcggaccctactaccttacttctttgaccgtttcgtacggggtccctaagggtaaccccgttgggtcccgtccggttccttcccgtctacgtcccttacccg

SEQ ID NO: 132697 - DNA, 556 bp, Homo sapiens
  misc_feature: GYAE6OF02HKMR5.13.88.H11.1.454.CMB.1.raw
  modified_base (383)..(383): a, c, t, g, unknown or other
  misc_feature (383)..(383): n is a, c, g, or t
tcagtcacgtactacacgaccggtgctcgatttagcgacagcgagaacacacaaaggggggattcccaagtgttttcattcagtgatcaggactgaacacagaggactcaccatggagtttgggctgagctggattttccttggtgttttttaaaaggtgtccactgtgagctgcagctggtggagtctgggggggggcttgggtaaagccgtggggggtcccttacactctcctgtgtagcctctaaaatcactttcaacgacgcctggatgagctgggtccgccaggctccagggaagggctggagtgcgtctcttttatttatagtagtggtagtacatactccgcagactccgtgaggggccattcaccatctccaganacaattccaagaacacgctgtttctacaatgaacagcctgagagccgatgacacggcgtgtacttactgtgcgagagagtggggacccacgaacgttactacgctatggacgtcgtgggccgaagggaccacggtccaccgtcctcctcgacgccctccaccgacggtccccg

SEQ ID NO: 132698 - DNA, 578 bp, Homo sapiens
  misc_feature: GYAE6OF02G0AGN.13.88.H11.1.454.CMB.1.raw
  modified_base (387)..(387): a, c, t, g, unknown or other
  misc_feature (387)..(387): n is a, c, g, or t
  modified_base (431)..(431): a, c, t, g, unknown or other
  misc_feature (431)..(431): n is a, c, g, or t
tcagtcacgtactacacgaccggtgctcgatttagcgacagcgagaacacacaaagggggggattcccaagtgttttcattcagtgatcaggactgaacacagaggactcaccatggagtttgggctgagctggatttaccttggtgttttttaaacggtgtccactgtgagcgtgcagctggtggagtcgtggggggggcttggtaaagcctggggggtcccttacgactctcctgtgtagcctctaaaatcactttcaacgacgcctggatgagctgggtccgccaggcgccagggaggggactggagtgggttggccgtattaaaagcgaggccgatggtgggacagcagacttcgctgcaccgtgcaagccagattcaccctntcaagcatgatttagagtaatactgtgtatttgacaaatgaacngcttgacaacgaggacgcgagtcgtttatactgtcgccagttacgttccaccgttggccctacgtcttacctttctttcgaccgtttcgtcggggtcccacgggtaacccctgggtccgccgttcctccctctacgtccttaccccg

SEQ ID NO: 132699 - DNA, 672 bp, Homo sapiens
  misc_feature: GYAE6OF02F5QD3.13.88.H11.1.454.CMB.1.raw
tcagtcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggattttccttggtgtttttttaaaaggtgtccactgtgagctgcagctggtggagtctggggggggcttgggtaaagcctggggggtcccttacactctcctgtgtagcctctaaaatcactttcaacgacgcctggatgagctgggtccgccaggcgccaggggagggactggagtgggtggccgtattaaaaggcgaggccgagtggtggacagcagacttcgctgcacccgtgcaagccagtctccaccctcacaacgacagtagtattagaagtaactacgttagttagtttagttagaactaaagtacgaaacgtacgtacgttaacggaacccgaaccgggacggaccggacgtacgggttacgttttaacgttacgttggtaccgtaccgttaacggttaccgttacccgaccggttccggaccctaccgttacccgtttaccttttacgtttaccgttaccgtttccgggtaccggggtacccggtacccgggtaccccggttcccggg

SEQ ID NO: 132700 - DNA, 628 bp, Homo sapiens
  misc_feature: GYAE6OF02I4LA1.13.88.H11.1.454.CMB.1.raw
tcagtcacgtactacacgaccggtgctcgatttagcgacagcgagaacacacaaagggggggattcccaagtgttttcattcagtgatcaggactgaacacagaggactcaccatggagtttgggctgagctggattttccttggtgttttttaaaaggtgtccactgtgagctgcagctggtggagtcgtggggggggcttggtaaagccgtgggggtcccttacactctcctgtgtagcctctaaaatcacttcaacgacgcctggatgagctgggtccgccaggcgccaggggagggacgtggagtgggtggccgtaagttaaaagcgaggccgagtgggtggacagcagaccttcgctgccaccgtgcaagcccagacttcaccctctacaagacatcgtaatttacgaagaattactagttagttaatttgactaaagtgaaactagtccttagaaccgtaaacggaggaccgacgagggtacgtttaattacgtgtcgacctagttacgttccaccgtgccctaacgttcttaccgtttctttcgacgtttcggtacggggtacctaacgggtaccccgttgggtacccgtccggttacctccctacgtacgtccctacccg

SEQ ID NO: 132701 - DNA, 757 bp, Homo sapiens
  misc_feature: GYAE6OF02J0OJC.13.88.H11.1.454.CMB.1.raw
tcagtcacgtactacacgaccggtgctcgatttagcgacagcgagaacacacaaagggggggattcccaagtgttttcattcagtgatcaggactgaacacagaggactcaccatggagtttgggctgagctggattttccttggttgttttttaaaaggtgtccactgtgagctgcagctggtggagtcgtggggggggcttagggtaaagccgtgggggtcccttacgactctccgtgtgtacgcctactaaaatcactttcaacgacgcctggatgagcgtgggtccgaccaggccgccgaggggacggggacgtgggaggttggggttacggcccggtaagttaaaaacggcggaacgggcccggtaagtcggggtaggggaaccagggctaacgggtaccgtttcggccgttggaacccaccccggttagacccgaaacggccctaaaggtactttcccgaaccccttctacccgaaaggtacctaattacgtaagttttaacggaagttaaaacgtttaccgtaggttagttaagttttaggaacccttaaaagtagaaacgtagtccttaagaaacccgtaaaccgggacgggaaccgacgtaacgggttaccgttttaataacgtcggtacgaccgtaagttaccggttcccaccgtggtcccctactccgtttacttcgttactaccgtcgtacgggcctaacggggtaccctcgggtcgtcccgtcgtccgcgtaccgtcctacccg

SEQ ID NO: 132702 - DNA, 596 bp, Homo sapiens
  misc_feature: GYAE6OF02H9SNT.13.88.H11.1.454.CMB.1.raw
tcagtcacgtactacacgaccggtgctcgatttagcgacagcgagaacacacaaagggggggattcccaagtgttttcattcagtgatcaggactgaacacagaggactcaccatggagtttgggctgagctggattttccttggtgtttttttaaaaggtgtccactgtgagctgcagctggtggagtctggggggggcttggtaaagcctgggggtcccttacactctcctgtgtagcctctggattcacctttgatgattatgccatgcacttggggtccggcaagctccagggaagggcctggagttgggtctcagggttatttagttgggaataggtgggtagcaatagggcttaagtggcggactcgtagtggaaacggggccgatttcaccatctccagacgacaacgccaagaacctccctgtatctgacaaatagaacacgacctggaacgagctgaacggcaacggtcctttgttattacgtttgtcgacgaaaagtctacctaaacccttagtacgtttttggagttggttatacggtacggtgggtcccgagggacccttcgggtcctagtcgttcctcctacg

SEQ ID NO: 132703 - DNA, 548 bp, Homo sapiens
  misc_feature: GYAE6OF02IOHNT.13.88.H11.1.454.CMB.1.raw
  modified_base (368)..(368): a, c, t, g, unknown or other
  misc_feature (368)..(368): n is a, c, g, or t
  modified_base (524)..(524): a, c, t, g, unknown or other
  misc_feature (524)..(524): n is a, c, g, or t
tcagtcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggattttccttggtgtttttttaaaaggtgtccactgtgagctgcagctggtggagtcgtgggggggcttgggtaaagccgtggggggtcccttacgactctcctgtgtagcctctaaatcactttcaacgacgcctggatgagctgggtccgccaggcgccgaggggaggggctggaggtgggttggccgtattaaagcgaggccgagtgggnggacagcagctcgctgcacccgtgacacgccagacttcaccctctacaagacatgtattagaataatactgttgtatttgactaaatgaacagtactagacgaaccgagacgctaggtctttatctgtcgcagtctccacgtgccatctcttcttnacttgtcgggccacggtacctcgg

SEQ ID NO: 132704 - DNA, 768 bp, Homo sapiens
  misc_feature: GYAE6OF02IPHNN.13.88.H11.1.454.CMB.1.raw
  modified_base (573)..(573): a, c, t, g, unknown or other
  misc_feature (573)..(573): n is a, c, g, or t
tcagtcacgtactacacgaccggtgctcgattttagcgacagcgagaacacacaaaggggccgggagaggagccccagccctgggattcccaagtgttttcattcagtgatcaggactgaacacagaggactcaccatggagtttgggctgagctggattttcctggtgtttttttaaaggtgtccactgtgagctgcagctggtggagtcggtgggggggcttggtaagcgtgggggtcccttacactctcctgtgtacgcctactaaatctacttacgaacgacgtcctaggactggacgcgtcgggtcccgccgagggccgaccggaggggacgggggacgtggggagggttcggggttagggacccggttaaagtttaaaaacgggccgggaacgggtcccggtaagttcggggtaggggaccgaggccgtaaggtaccgttcgtcgtcggaccctaacccggtgaccgtaacgcccaaggtaacctttcccgaccccttcgaacgaacgacctaagtacgtaatttaaagaacgtaattacgttgttacggtttattaggaactaaanacgtaactacgtcttaacgaacgaaccggtacggaacgtacgaacggtttacgtttacgttaaccgtggttaccgtaaccgtaggtttacccgtacccgtaccggtcccggtaccttaacccgttcctttaaccgtttaccgttttagttaccgtttccggtacggggacccgttaccgggtaccccgttccggg

SEQ ID NO: 132705 - DNA, 601 bp, Homo sapiens
  misc_feature: GYAE6OF02FU409.13.88.H11.1.454.CMB.1.raw
tcagtcacgtactacacgaccggtgctcgatttagcgacagcgagaacacacaaagggggggagaggagccccagccctgggattcccaagtgttttcattcagtgatcaggactgaacacagaggactcaccatggagtttgggctgagctggattttccttggtgttttttaaaaggtgtccactgtgagctgcagctggtggagtcgtggggggggcttggtaaagccgtgggggtcccttacactctcctgtgtagcctctaaaatcactttcaacgacgcctggatgagcgtgggtccgccaggcgccgagggaggggactggaggtgggttggccgtattaaaggcgaggccgagtgggtggacagcagacttcgctgcacccgtgcaagccagacttccaccctctacaagacatgaatttaggagtaatactgtcgtaatttgactaaatgaacagtcttagaaccgaaccgaggaccgcgaggtacgtttagttacgtgtacgccgtagttacgtcccacgtcggtcccacgttcctacctttccttgtaccgtttcgtacgggggtccctaacggggtaccctgggtcccg

SEQ ID NO: 132706 - DNA, 810 bp, Homo sapiens
  misc_feature: GYAE6OF02HXOKV.13.88.H11.1.454.CMB.1.raw
tcagtcacgtactacacgaccggtgctcgatttagcgacagcgagaacacacaaagggggggagaggagccccagccctgggattcccaagtgttttcattcagtgatcaggactgaacacagaggactcaccatggagtttgggctgagtctggtattttccttgttgcttaattttaaaaggtgcccagtgtgaggtgcagcgtggtggagtctggaggaggtcttgatccgacggccggttcggggggtccctaggacgtacctcctccgtgtacgctacgtccttacgttcggttccaccgtctacgtaccaacctaaccctactagtaggacgtccgtcggggtcccgaccggtacggtccgtaccgggaacgggggaacgggcgtaggggtacgtggtccgtttacgtttagttttaacgttaagtagttacgggttacgttaagttacctaacgttacctccgacgtaacgtaccgttccggtacgggtacgggggtaccctacgtttacccgaaccgttaccgttacccgtaccgaaaggtaaccgtaacttaaacccgttaaccaaaacgtaaccgtaccggtaccttttaggttttaaccgtaaagttaaactacggtaacctacggtacctaggtaacgacggtaacccggtagttaccggacccggtaacgggttcccgtaggtttaaccgtttcgtaggtacgacggttaagggacggttaccggtaccgggtaaccctaacggtaaccgttacacggtaccgttaacggtcggttacccggtaggtaacccggggg

SEQ ID NO: 132707 - DNA, 958 bp, Homo sapiens
  misc_feature: GYAE6OF02HHB41.13.88.H11.1.454.CMB.1.raw
tcagtcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggattttccgttggttgtttttttaaaaggtgtccacttgtgagctgcagcgtgggtggtaggtcggtcggggggggtctttagggtaaaacggtccggttcgggggggttccccttaaccgtaccgttacccgttcccgttggttacggttaacgtcccttaaccgttaaaaaacgttcctaaccgtttttaccgaaacccggtaacccggtcccgtagggtaacgttcggaacggtccggtccgggggttccccggacccggacggggccccggaccccgggaaggggggtaacggggggtaaccgttcgggggtaacgggtttcgggggtttaccggggtaacccggtttaaaaggttttaaaaaccggggcgggtaaccgggtacccggtaagggtcggggttacggggaaccgtacggtaccgaacgttaacccgttcggaccgttccggaccccgtaccccggtacgaccgaaaccggtccgaacgttacttccccaacccctttcgtaaccgaaacgtacgtacgttaacgtaactttaaaggaacgtaaactttacgttggttagtttacgtttagaaactttaaacgtagtaaaccgtagtacccgttaggaacccgtaaccggaacggtaccgaacggtaacggtttaccgttttaaagttaccgttggtaacccgtcgtaacggttccttacccgtacccggtcggtaccctaacgtttcccgtttaccgtttacgttttccggttacggttccggtaccggggtaccccggtaccgggtacccggttccggg

SEQ ID NO: 132708 - DNA, 844 bp, Homo sapiens
  misc_feature: GYAE6OF02I7FH4.13.88.H11.1.454.CMB.1.raw
tcagtcacgtactacacgaccggtgctcgatttagcgacagcgagaacacacaaaggggggagaggagcccagccctgggattcccaagtgttttcattcagtgatcgagactgaacacagaggactcaccatggagtttgggctgagcgtggtattttccttggtttgttttttaaaaaggttgtcctacttgtgagtctgcgacgtcgtggtggacggttcggtggggggggtacgtttagggtaaaacggtcccgggttcgggggttacccgtttaaccgaccgttccgtccgttcgttcggtacgtacccttacgttaaaaacttaccgttaactttaccgtaaccgtaccggtccgttacggaagtggtaacgtcgttccggggtcccgaccgacggtccggaccggtaacgggggacggggtaccggtagggtaggttcggggttacggtaaccgttaaagtttaaacgggaccgggtaacggtaccggtaggtacgggggtagggaaccggacgtacgtaacgtaccgttccggtaccgtcgtaccgtaccccggtcgacggtaaccgacccgtacgtaaccgtaccctaaccccgtacgtaaccgaacgtacctaaagtaacggttatttaaacgaagtaaacgtttacgtagttcgtttaatacgaactaaagtacgaacacgttctaacggaacccaaaggtcggaacgtccgtagggttacccttagttaccgtcgacgttaccgagtttaacctccgaacgtcgtaaccctcttacttcctttacgttcgtaacgtttccggtaggtacccggtacggtacccgtggtcccg

SEQ ID NO: 132709 - DNA, 741 bp, Homo sapiens
  misc_feature: GYAE6OF02I0CON.13.88.H11.1.454.CMB.1.raw
  modified_base (393)..(393): a, c, t, g, unknown or other
  misc_feature (393)..(393): n is a, c, g, or t
tcagtcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggattttccttggttagtttttttaaaaggtgtccactgtgagctgcagctggtggagtcggtgggggggtcttaggtaagcgtgggggtcccttacgactctcctgtgtagcctactaaaatctacttcacgacgcctggatgagctggtccgcaggccgccggaggggagggacgtgggacgtggggttcggacccgttaagttaaaacggcgacggccggtagtaggggtcggganacgcgaaggtaccgtttacggcgttcgaccgtaccccggtgacccgtaaacggccgtaacgtaacgtttcccaccccctttacctacaacggactaagttacgtaagttttaggaaacgttaataccgttgttagttaagtttcgaaacttaaagtacgtaactagtctttacggaaccgtaaaccgggaacggaccgaccgtaagggttccgttttaacgttacgttacgttcgaccgttaggttacccgttccctaccggttcggtcccgtaactttcctttacctttccgtttttacgtaccgttttccggaccggggtacccgtaccgggtacccgttaccggg

SEQ ID NO: 132710 - DNA, 679 bp, Homo sapiens
  misc_feature: GYAE6OF02FP21C.13.88.H11.1.454.CMB.1.raw
  modified_base (374)..(374): a, c, t, g, unknown or other
  misc_feature (374)..(374): n is a, c, g, or t
tcagtcacgtactacacgaccggtgctcgatttagcgacagcgagaacacacaaagggggggattcccaagtgttttcattcagtgatcaggactgaacacagaggactcaccatggagtttgggctgagctggattttccttggtgttttttaaaaggtgtccactgtgagctgcagctggtggagtcgtggggggggcttggtaagccgtgggggtcccttacactctcctgtgtagcctctaaaatctactttcaacgacgcctggatgagctggtccgccaggcgccgaggggaggggactgggaggtggggttggccgtattaaaagcggaggccgagtggtgggacagcagacttcgctgccaccgtncaagccagacttccaccctcacaacgacatgtatttagagtaactatgtgttattgactaaatacgaacagcttacgaaccgaaaccggaggaccgaccgtacgggtcgttttaacgttacgtggttacgtacccgtaaggttaccgttaccctacccgttacggaccccttaacgttcccttaccgtttttccgtttaccggttaccgttttccggtccggggtaccccggtaaccggggtaaccccgttgggttccccggtcccgtttcccgtacccgtccgtaccggtcccttaacccccgg

SEQ ID NO: 132711 - DNA, 903 bp, Homo sapiens
  misc_feature: GYAE6OF02HQOAY.13.88.H11.1.454.CMB.1.raw
tcagtcacgtactacacgaccggtgctcgatttagcgacagcgagaacacacgaaagggggggagaggagccccagccctgggattcccaagtgttttcattcagtgatcaggactgaacacagaggactcacatggtagtttgggctgagcgtggtattttccgtttggtttaggtttttttaaaaggtcgtcctacttggtgagtctgcagcgtgggtggaggttcgggtgggggggtcttagggtaaacggtccgggttacgggggtcccttacgtaccttccgttccgtggttggtacgtacccttaacttaaaactccttaccgtttacgaaccggtccgtccgtaggagtacggacgtccggtacggggtcccgccgacgggtccggaccgggaagggggacggggtacgtggggtagggttcggggtacggtaccgttaaaggttaaacgggcggacgggtaccgtagggtacggggtacgggaaccgtaacggaccgtaacggtacccgttccggtaccgtccgggtaccccgtaacccggttacggaaccgtaaaccggtcccgtaaacgtttaacccgttaccccaacccccgttcgtaaccgaaaccggtacttaggtttacggttaaagtttaacgaaagtttaaacgttaccgttaggtttaaggttaacgtttacaaaacgttaaacgtaacgtaacgtacggttaaccttaaccggaaaccggaacgggtaaccggtaacggtacgttaacggttaaccgtttataccgttacggtacgtacgttacgttacccgtccctaccggtctacccttactttaccttaccgttttcgttaccgtaccggttcggggaccggtacccggtaccgggttcccgtcgttcccgg

SEQ ID NO: 132712 - DNA, 785 bp, Homo sapiens
  misc_feature: GYAE6OF02F5IGJ.13.88.H11.1.454.CMB.1.raw
  modified_base (446)..(446): a, c, t, g, unknown or other
  misc_feature (446)..(446): n is a, c, g, or t
  modified_base (606)..(606): a, c, t, g, unknown or other
  misc_feature (606)..(606): n is a, c, g, or t
  modified_base (710)..(710): a, c, t, g, unknown or other
  misc_feature (710)..(710): n is a, c, g, or t
tcagtcacgtactacacgaccggtgctcgatttagcgacagcgagaacacacaaagggggggagttcccgaagtgttttctattcagtgatcaggactgaacacagaggactcaccatggagttgggctgagctggtattttccgttggttagtttttttaaaaggttgttcctacgttggtggtagtcgtgaccagtccgtggtggaggtcggtgggggggggcttgggtaaaggccggtcgggggtccttacgactcgtcctggtagtaggtcctactaaaagtctactttaccaacggtacgcccgttaggtacgtgtacgcggttacgggccgtacccgagggccgacccgaagggggtacggggcgtcgggtaggtacggggttggacccggttagttaaaaacggccggaggtcccggtaagtggggtacggaggtaacncgtaacggtacgttcggccgtggtacccaccggttgaacccgagacccgtataccgttaccaccccgttcacgaacgtacgacttgggaaatttacgaggtaaactgtacggttgtaaagtttcggaataacgaagtaagctactaaggtaccgaaacgnggtacgacgagggttccttaagttactcgtacgtctaaacggttcgttcccgaacgttccggacctacgttacccttagttccgtttaaccgcgttttaccggngggtaccccggtaagtacccggttaacgggcccttacggtacccgttcctaccggttaacgccgtttaaccccgg

SEQ ID NO: 132713 - DNA, 390 bp, Homo sapiens
  misc_feature: GYAE6OF01CPQ25.9.34.D01.1.454.CMB.1.raw
  modified_base (383)..(390): a, c, t, g, unknown or other
  misc_feature (383)..(390): n is a, c, g, or t
tcagtgatacgtctcacgaccggtgctcgatttagatcgtctgtgttgggtttgggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtacatcgtcttcggaactgggacaaggtcaccgtcctgggtcagcccaaggcccaaccccatgtcactctcgttccccgccctcctcacgacgtatcactgagcggctggcaaggcgcatagnnnnnnnn

SEQ ID NO: 132714 - DNA, 172 bp, Homo sapiens
  misc_feature: GYAE6OF01BS02K.9.34.D01.1.454.CMB.1.raw
tcagtgatacgtctcacgaccggtgctcgatttagatcgtctgtgttgggtttgggggaagaggaagactgacggtcccccaggagttcaggtgctgggcacagcggccctgggctgcctggtcaaggactacttccagacgtatcactgagcgggctggcaaggcgcatag

SEQ ID NO: 132715 - DNA, 484 bp, Homo sapiens
  misc_feature: GYAE6OF01CP0I8.9.34.D01.1.454.CMB.1.raw
  modified_base (140)..(140): a, c, t, g, unknown or other
  misc_feature (140)..(140): n is a, c, g, or t
  modified_base (225)..(225): a, c, t, g, unknown or other
  misc_feature (225)..(225): n is a, c, g, or t
  modified_base (473)..(484): a, c, t, g, unknown or other
  misc_feature (473)..(484): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataacctgagaggcgaggacacggccatttattcngtgcgaaggaggcatatgggaagtacgattttcgatccctccgcagtcgacacttgattacgtggggccgggacctggtcgccgtctcctcagcctccaccaggcccagtccgtccttccccgtggccacccgtctaccaagacgcacctcgtcggggcacgaggccggccctggggcctggcccgtggtaccaaaggtactacttccaggacgtaatccactgagcgggctggcaaggcgcatacgnnnnnnnnnnnn

SEQ ID NO: 132716 - DNA, 711 bp, Homo sapiens
  misc_feature: GYAE6OF01CKCJZ.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgacggtccgtcggcccagtctgttctgacgcacgcccgccctcagtcgtcggtccggggaccccgagggcgaggacgggtccacctatccgtcggtcgaccacgtaggaagtacgcctaccaactacggtcggggactaacgttatgatcgtacacgtacggtaaccaaactaaccttccgaacggaacaccgaaccccaaagtcatactaatttatacgaacaacagtagaacgccgccctacggacgggtccctacgaccgtacttccgtccggcctaccgtaagtcgtcggaccaactactaccgacgtcccctcccgtcggaccctactaccacggtcggggtccctacccggacgggtccgtagggaacgggtacgttacggggaacggtaccgtacgtaaccgtttaacgttaccgtaccgtaccgtacggttacgttagtacgaaccgtagggtaccggtaaccttaaaaggtaacctacgttaccgttaccggttaaccgggtaaaccggtaccgggaaaccgtaacgggtcccgtaacccggttcccggg

SEQ ID NO: 132717 - DNA, 473 bp, Homo sapiens
  misc_feature: GYAE6OF01BOBNM.9.34.D01.1.454.CMB.1.raw
  modified_base (454)..(455): a, c, t, g, unknown or other
  misc_feature (454)..(455): n is a, c, g, or t
  modified_base (457)..(473): a, c, t, g, unknown or other
  misc_feature (457)..(473): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccgggaaccctggtcgccgtctcctcagcctccaccaagggcccatcggtcttccccctggcaccctcctccaagagcacctctggggcacagcggccctgggctgcctggtcaaggactacttccagacgtatcactgagcgggctggcaaggcgcatagnngnnnnnnnnnnnnnnnnn

SEQ ID NO: 132718 - DNA, 395 bp, Homo sapiens
  misc_feature: GYAE6OF01EUVVE.9.34.D01.1.454.CMB.1.raw
  modified_base (308)..(308): a, c, t, g, unknown or other
  misc_feature (308)..(308): n is a, c, g, or t
  modified_base (391)..(395): a, c, t, g, unknown or other
  misc_feature (391)..(395): n is a, c, g, or t
tcagtgatacgtctcacgaccggtgctcgatttagatcgtctgtgttgggtttgggggcacgttatgatgtacactggtaccaacaacttccaggaacagccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctggtcagcccnaaacggccaaacccccgactgtcacttcctgttccccaccctcctcagacgtatcactgagcgggctgggcaaggcgcatagnnnnn

SEQ ID NO: 132719 - DNA, 623 bp, Homo sapiens
  misc_feature: GYAE6OF01CKHQD.9.34.D01.1.454.CMB.1.raw
  modified_base (235)..(235): a, c, t, g, unknown or other
  misc_feature (235)..(235): n is a, c, g, or t
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctgggtggcggtcatgacacattctacgcaaaactccgtggaggggccncttcatcatctccagagacaattcccagaacatactgtctctgcaactcaataacctgagaggcgaggacacggccagtttattctgtgcgaaaggaggcagtagnggaatacgatttcgatccctccgnagtcgactactttgacttacgtcgggggacccgggaacctggtaccgccgtactcctcacgcctccaccgaaagggcccaagtccggtccttcccccgtgggccctacccgtcctacccgaacgtacgcctaaccgttcgtacgggggcctaacgacgggcccgggccccgttggggcccttcgggcccgttaggggtacccgaaacggggtacccttaacccgttcccgaaggtaccgtaacgtcccaacgtacggg

SEQ ID NO: 132720 - DNA, 173 bp, Homo sapiens
  misc_feature: GYAE6OF01EQWUN.9.34.D01.1.454.CMB.1.raw
  modified_base (173)..(173): a, c, t, g, unknown or other
  misc_feature (173)..(173): n is a, c, g, or t
tcagtgatacgtctcacgaccggtgctcgatttagatcgtctgtgttgggtttgggggaagaggaagactgacggtcccccaggagttcaggtgctgggcacagcggccctgggctgcctggtcaaggactacttccagacgtatcactgagcgggctggcaaggcgcatagn

SEQ ID NO: 132721 - DNA, 531 bp, Homo sapiens
  misc_feature: GYAE6OF01A6MXQ.9.34.D01.1.454.CMB.1.raw
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacacgccccaagtcatcatttangacaacatgaagcggccctcgagggtccctgaccgattccnccggctccagtctggcacatcacgcccttccctggcccatccacgtcgggcctccgaggctgaggatggaggctgacttattactgccagtcgtatcgacaggtcggacctaagtaactcttcggtacgttaccgggaacgttcgggaaccctaagggtcccacccggtccgg

SEQ ID NO: 132722 - DNA, 510 bp, Homo sapiens
  misc_feature: GYAE6OF01CX59H.9.34.D01.1.454.CMB.1.raw
  modified_base (143)..(143): a, c, t, g, unknown or other
  misc_feature (143)..(143): n is a, c, g, or t
  modified_base (500)..(510): a, c, t, g, unknown or other
  misc_feature (500)..(510): n is a, c, g, or t
tcagtgatacgtctcacgaccggtgctcgatttagatcgtctgtgttgggtttgggattcacgttgcagatgtagggtcgtgggtcgcaggcatccgctggtggcggtcatgacacattctacgcaaactccgtgaggggccncttcatcatctccagagacaattcccagaacatactgtctctgcaactcaataacctgagaggcgaggacacggccatttattctgtgcgaaggaggcatatggaagtacgattttcgatccctccgcagtcgacactttgattacgtgggccgggaaccctggtcgccgtctcctcagcctccaccaacgggcccatccggtcttccccctggccaccctcctcccaacgacgccaccctcgtcgggggccacgacggccggccccgtcgggccttcggcccgttcgggtacaacggacctaccgtttccaacgtaccgttaatccactgacgcgggctgggcaaggcgcagtagnnnnnnnnnnn

SEQ ID NO: 132723 - DNA, 427 bp, Homo sapiens
  misc_feature: GYAE6OF01E3WH2.9.34.D01.1.454.CMB.1.raw
  modified_base (423)..(427): a, c, t, g, unknown or other
  misc_feature (423)..(427): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtctgggtcagcccaaggcccaaccccactgtcactctcgttccccaccctcctcagacgtatcactgagcgggctggcaaggcgcatagnnnnn

SEQ ID NO: 132724 - DNA, 174 bp, Homo sapiens
  misc_feature: GYAE6OF01EZESS.9.34.D01.1.454.CMB.1.raw
  modified_base (174)..(174): a, c, t, g, unknown or other
  misc_feature (174)..(174): n is a, c, g, or t
tcagtgatacgtctcacgaccggtgctcgatttagatcgtctgtgttgggtttgggggaagaggaagactgaccggtcccccaggagttcaggtgctgggcacagcggccctgggctgcctggtcaaggactacttccagacgtatcactgagcgggctggcaaggcgcatagn

SEQ ID NO: 132725 - DNA, 466 bp, Homo sapiens
  misc_feature: GYAE6OF01AW8NZ.9.34.D01.1.454.CMB.1.raw
  modified_base (457)..(466): a, c, t, g, unknown or other
  misc_feature (457)..(466): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggcaccctcctccaagagcacctcgtgggggcacacgcggccctgggctgcctggtcaaggactactccagacgtatcactgagcgggctggcaaggcgcatagnnnnnnnnnn

SEQ ID NO: 132726 - DNA, 494 bp, Homo sapiens
  misc_feature: GYAE6OF01ETEX8.9.34.D01.1.454.CMB.1.raw
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
  modified_base (459)..(459): a, c, t, g, unknown or other
  misc_feature (459)..(459): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtcccctgaccgattctccggctccaagtctggcacatcagcctccctgccatcactggctccagctgagntgagctgactattacngccagtcgtatgacagtggcctaagtaacntcgtcttacggaactgggaccaaggtcaccgtccg

SEQ ID NO: 132727 - DNA, 529 bp, Homo sapiens
  misc_feature: GYAE6OF01COH67.9.34.D01.1.454.CMB.1.raw
  modified_base (304)..(304): a, c, t, g, unknown or other
  misc_feature (304)..(304): n is a, c, g, or t
  modified_base (442)..(442): a, c, t, g, unknown or other
  misc_feature (442)..(442): n is a, c, g, or t
  modified_base (500)..(500): a, c, t, g, unknown or other
  misc_feature (500)..(500): n is a, c, g, or t
  modified_base (522)..(522): a, c, t, g, unknown or other
  misc_feature (522)..(522): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggcccccagggcaggagggtcaccatctcgtgcacgtggaaagtagctccaacatcggggcacgttatgatgtacactggtaaccaacaacttccaggaacacgcccccaaagtcatcatttangacaacatgaagcggccctcgacgggtccctagaccgattcctccggctccaagtctcggcacactcagccctcctggccatcaacgtgggcctccgaggctggaggatgaggctagacttagtactgccagtcgtangacagtcgacctaagtaacatcgtcttacgaaccgtgggaaccaggtccaccggtcgnggtcacgcccaagcccaacccngcgtacc

SEQ ID NO: 132728 - DNA, 239 bp, Homo sapiens
  misc_feature: GYAE6OF01BES16.9.34.D01.1.454.CMB.1.raw
  modified_base (212)..(239): a, c, t, g, unknown or other
  misc_feature (212)..(239): n is a, c, g, or t
tcagtgatacgtctcacgaccggtgctcgatttagatcgtctgtgttgggtttgggctgactattactgccagtcgtatgacagtggcctaagtaacatcgtcttcggaactgggaccaaggtcaccgtcctgggtcagcccaaggccaacccactgtcactctgttcccacctctcagacgtatcactgagcggctggcaaggcgcatagnnnnnnnnnnnnnnnnnnnnnnnnnnnn

SEQ ID NO: 132729 - DNA, 513 bp, Homo sapiens
  misc_feature: GYAE6OF01AEJ5V.9.34.D01.1.454.CMB.1.raw
  modified_base (318)..(318): a, c, t, g, unknown or other
  misc_feature (318)..(318): n is a, c, g, or t
  modified_base (475)..(475): a, c, t, g, unknown or other
  misc_feature (475)..(475): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttangacaacatgaagcgccctcgaggggtccctgaccgattctccggctccaagtctggcacatcacgccctccctggccatccacgtgggcctcccgaggcctggaggatggagctgacttattactgccagtcgtatgacagtcggacctaagtaacngtccgtcgttacggaacgtgggaccaggtccaccgtcg

SEQ ID NO: 132730 - DNA, 217 bp, Homo sapiens
  misc_feature: GYAE6OF01D2REB.9.34.D01.1.454.CMB.1.raw
  modified_base (177)..(217): a, c, t, g, unknown or other
  misc_feature (177)..(217): n is a, c, g, or t
tcagtgatacgtctcacgaccggtgctcgatttagatcgtctgtgttggggtttggggggaagaggaagactgacggtcccccaggagttcaggtgctcgggcacagcggccctgggctgcctggtcaaggctacttccagacgtatcactgagcgggcttggcaaggcgcatagcnnnnnnnnnnnnnnnnnnnnnnnnnnnnnnnnnnnnnnnnn

SEQ ID NO: 132731 - DNA, 611 bp, Homo sapiens
  misc_feature: GYAE6OF01CI5AP.9.34.D01.1.454.CMB.1.raw
  modified_base (246)..(246): a, c, t, g, unknown or other
  misc_feature (246)..(246): n is a, c, g, or t
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
tcagtgatacgtctcacgaccggtgctcgatttagatcgtctgtgttgggtctgggggaggcttggtccagcctggggagtccctgcgacctctcctgtgtgcctctggattcacctttgagacctatcgccttgacctgggtcccgccaggctccgagggggaggactggagtgggcgcaggcatcgctgggtggcggtcatcgacacattcacgacaaactcgtggagggcctcttcatcatcncgagagacaactccaagaacatactgtctctgcaactcaataactgacgaggcgagacacgctatttactcngtgacgaaggngcagtagtggaatacgtntttcgactccctcgcacgtcactacgtttgagtttacggcggggaccgggtaacctggtaccgtccgttctccgtacgtacgtccctacgaaccgtaacggccctacgtccgtacccttccccgtgacccctacccgtccgtaccgaacggaccgtaccgaccgttcggtacggggaccaacgacggtcccggcccgtgggcctcggccgtacggtacaacggtaccttaccgtacccgaagtacccttactccgtacggtcgg

SEQ ID NO: 132732 - DNA, 528 bp, Homo sapiens
  misc_feature: GYAE6OF01BHZT7.9.34.D01.1.454.CMB.1.raw
  modified_base (423)..(423): a, c, t, g, unknown or other
  misc_feature (423)..(423): n is a, c, g, or t
  modified_base (520)..(520): a, c, t, g, unknown or other
  misc_feature (520)..(520): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggcccccagggcagagggtcaccatctcgtgcactggaagtagctccaacatcggggcacgttatgatgtacactggtaccaacaacttccaggaacagcccccaaagtcatcatttatgacaacatgaagccgccctcgacggggtccctgaccgattcgtccggctccaagtctggcacatcacgccctccctggcccatccactgggcctccgaggctgaggatgaggctgactattacngaccagtcgtatgacgagtgaccttaagtacagttcgtcttacggactcggaccaggtccaccggtcgtgggtcacgacccaacggacccaaccccngtcgtacc

SEQ ID NO: 132733 - DNA, 461 bp, Homo sapiens
  misc_feature: GYAE6OF01DRQBS.9.34.D01.1.454.CMB.1.raw
  modified_base (453)..(461): a, c, t, g, unknown or other
  misc_feature (453)..(461): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctcaccaagggcccatcgtctccccctggcaccctcctccaagacgcacctctggggcacagcgccctgggctgcctggtcaaggactacttcccagacgtatcactgagcgggctggcaggcgcatagnnnnnnnnn

SEQ ID NO: 132734 - DNA, 469 bp, Homo sapiens
  misc_feature: GYAE6OF01A69GS.9.34.D01.1.454.CMB.1.raw
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (460)..(469): a, c, t, g, unknown or other
  misc_feature (460)..(469): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattcngtgcgaaggngcatatggaagtacgattttcgatccctccgcagtcgacactttgattactggggccggggaaccctggtcgccgtctcctcagcctccaccaacgggcccatcggtcttccccctcggcaccctcctcccaagagcacctctcgggggcacgagcggcccgtgggctgcctggtcaaggactacttccagacgtatcactgagcgggctggcaaggcgcatagnnnnnnnnnn

SEQ ID NO: 132735 - DNA, 535 bp, Homo sapiens
  misc_feature: GYAE6OF01ER5AY.9.34.D01.1.454.CMB.1.raw
  modified_base (528)..(528): a, c, t, g, unknown or other
  misc_feature (528)..(528): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctcgcagtcgacactttgattacgtgggccggggaacctggtccgccgtctcctcagcctccaccaagggcccatcgtcttcccctggccaccctcctcccaagacgccaccctcgtcggggcacacgcggccctgggcctcgcctggcaacggactacttccagacgtatcnctgacgg

SEQ ID NO: 132736 - DNA, 595 bp, Homo sapiens
  misc_feature: GYAE6OF01CK9PB.9.34.D01.1.454.CMB.1.raw
  modified_base (225)..(225): a, c, t, g, unknown or other
  misc_feature (225)..(225): n is a, c, g, or t
  modified_base (565)..(565): a, c, t, g, unknown or other
  misc_feature (565)..(565): n is a, c, g, or t
  modified_base (569)..(569): a, c, t, g, unknown or other
  misc_feature (569)..(569): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(586): a, c, t, g, unknown or other
  misc_feature (584)..(586): n is a, c, g, or t
  modified_base (588)..(592): a, c, t, g, unknown or other
  misc_feature (588)..(592): n is a, c, g, or t
  modified_base (594)..(595): a, c, t, g, unknown or other
  misc_feature (594)..(595): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgagggccgcttcatcatctccagagacaattcccagaacatactgtctctgcaactcaataacctgagaggcgaggacacggccagtttattcngtgcgaaggaggcatatggaagtacgattttcgatcctcgcagtcgacacttgattacgtgggccgggaacctggtcgccgtctcctcagcctccaccgaacgggcccagtccggtccttcccccgtggccctaccctcctaccaaacgtacgccacccgtcgtcgggggccacgacggccggtacccgtgggccttcggccgttcgggtacccgaaacgggtaccttaaccgtttcccgaacggtaccggtttaactacccgaaccgtttggaaaccgggtccggggccgttacggggaccgtaaacggggcccggaccgtaaagttaccggctacgcncgcncgcgngngcgncncnnncnnnnngnn

SEQ ID NO: 132737 - DNA, 487 bp, Homo sapiens
  misc_feature: GYAE6OF01B9L7N.9.34.D01.1.454.CMB.1.raw
  modified_base (476)..(487): a, c, t, g, unknown or other
  misc_feature (476)..(487): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccgggaaccctggtccgccgtctcctcagcctccaccagggcccatccggtccttccccctggccacccctcctcccaagacgccacctcgtgggggccacgacgccggccctggggcctgccctggtaccaaggcctacttccagtacgtatccactgacgcgggctggcaaggcgacatagnnnnnnnnnnnn

SEQ ID NO: 132738 - DNA, 506 bp, Homo sapiens
  misc_feature: GYAE6OF01C4ZSS.9.34.D01.1.454.CMB.1.raw
  modified_base (140)..(140): a, c, t, g, unknown or other
  misc_feature (140)..(140): n is a, c, g, or t
  modified_base (493)..(506): a, c, t, g, unknown or other
  misc_feature (493)..(506): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataacctgagaggcgaggacacggccattttatttctgtgcgaaggaggcatatgggaagtacgattttcgatccctccgcagtcgacactttgattactggggccggggaaccctggtcgccgtctcctcagcctccaccaagggcccatccggtccttcccccgtggccacccctcctccaagcgccacctcgtcgggggccacgacggccgggcccctggggcctcggccctgggtacaacgggacttaccgttcccagaccggtatccactggacggcgggctgggcaaggcgcatagnnnnnnnnnnnnnn

SEQ ID NO: 132739 - DNA, 490 bp, Homo sapiens
  misc_feature: GYAE6OF01EH79E.9.34.D01.1.454.CMB.1.raw
  modified_base (474)..(474): a, c, t, g, unknown or other
  misc_feature (474)..(474): n is a, c, g, or t
  modified_base (479)..(490): a, c, t, g, unknown or other
  misc_feature (479)..(490): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgatttttcgatccctccgcagtcgacactttgattacgtggggccggggaaccctggtcgccgtctcctcagcctccaccaacgggcccatccggtccttcccccgtcggccacccctcctcccaagacgcaccctcgtcgggggccacgacggccggcccgtgggcctgccctggtcaaggactacttccagacgtatcactgagcgggctggcaaggcgnatagnnnnnnnnnnnn

SEQ ID NO: 132740 - DNA, 474 bp, Homo sapiens
  misc_feature: GYAE6OF01DS3XI.9.34.D01.1.454.CMB.1.raw
  modified_base (228)..(228): a, c, t, g, unknown or other
  misc_feature (228)..(228): n is a, c, g, or t
  modified_base (461)..(474): a, c, t, g, unknown or other
  misc_feature (461)..(474): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaaataacctgagaggcgaggacacggccattttatttcngtgcgaaggaggcatatggaagtacgattttcgatccctccgcagtcgacactttgattacgtggggccggggaaccctggtcgccgtctcctcagcctccaccaaggcccatcgtctcccctgcaccctcctccaagacgcacctcgtcggggcacgacgcggcccgtgggcctgcctggtacaaggactacttccagacgtatcactgagcgggctggacaggcgcatagnnnnnnnnnnnnnn

SEQ ID NO: 132741 - DNA, 601 bp, Homo sapiens
  misc_feature: GYAE6OF01CHQLT.9.34.D01.1.454.CMB.1.raw
  modified_base (316)..(316): a, c, t, g, unknown or other
  misc_feature (316)..(316): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattctacgcaaactccgtgaggggccgcttcatcatctccagagacaattcccagaacatactgtctctgcaactcaataacctgagagcgagacacgctatttattcngtgacgaaggagcatagtgggaagtacgtatttcgactccctcgcagtcgactactttgattacgtcggggaccgggaaccgtcggtccgccgtctcctcgacgccctaccaccgaacgggcccacgtccggtcccttcccccgtggccctacccctccctaccgaacgacgacctacccgtcggtcgggggccacgacggccggcccgtcggggcgtcggtcccgtgggtaaccgaaacggtaccttaccgttaccgaacggtaactagtaccacgtggacggg

SEQ ID NO: 132742 - DNA, 630 bp, Homo sapiens
  misc_feature: GYAE6OF01CL4WL.9.34.D01.1.454.CMB.1.raw
  modified_base (234)..(234): a, c, t, g, unknown or other
  misc_feature (234)..(234): n is a, c, g, or t
  modified_base (615)..(615): a, c, t, g, unknown or other
  misc_feature (615)..(615): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattctacgcaaactccgtgaggggccncttcatcatctccagagacaattcccagaacatactgtctctgacaactacaaactaacctgagaggcgaaggacacgcctatttatttctgtgacgaaggaggcagtagtgggaaagtacgtattttcgactcccgtcgctagtcgactcttttgattacggcgggggacccgggtaacccgtcgggtcgcccgttctcccgtcaccgtcctacccgaaccgaaccgggccctacgttcccggttcccttcccccgtcggccctacccctcccgtaccaacgtacgcctacccgtcggtcggggccaccgacggccggtcccgtcgggtcctcggtccggtaggtacgaacggtacctaccgttaccgacgtaccgtacnctacgtggtaccggg

SEQ ID NO: 132743 - DNA, 618 bp, Homo sapiens
  misc_feature: GYAE6OF01B7IL6.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccaagaacatactgtctctgcaactcaataacctgagaggcgaggacacggcctatttatttctgtgacgaaggaggcagtagtggaaagtacgtatttcgactccctcgcagtcgactactttgattacgtggggaccgggacctggtcgccgtctcctcacgcctccaccgaacgggtcccacgtccggtcccttcccccgtcggccctaccccgtccctacccgaacgtaccgacctacccgtcggtcgggggaccaccggacggtcccggtccccgtcggggtcctcgggacccgttcgggtccgaaacgggtacccttaccgttacccgaaggtaaccgttactccgtaacgtacgg

SEQ ID NO: 132744 - DNA, 515 bp, Homo sapiens
  misc_feature: GYAE6OF01BSA7I.9.34.D01.1.454.CMB.1.raw
  modified_base (494)..(515): a, c, t, g, unknown or other
  misc_feature (494)..(515): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccattttattctgtgcgaaggaggcatatgggaagtacgattttcgatccctccgcagtcgacactttgattacgtggggccgggaaccctggtcgccgtctcctcagcctcaccaacggcccatccggtccttcccccgtggccaccctcctccaagacgcacctcgtggggcacgagccggcccgtgggcctcggccgtgggtaccgaacgggtactaccgttcccgagaccgttactcacgttgacggcgggactgggaccaagggcgacagtagcnnnnnnnnnnnnnnnnnnnnnn

SEQ ID NO: 132745 - DNA, 463 bp, Homo sapiens
  misc_feature: GYAE6OF01BDZG9.9.34.D01.1.454.CMB.1.raw
  modified_base (455)..(463): a, c, t, g, unknown or other
  misc_feature (455)..(463): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaaggcccatcggtcttccccctggcaccctcctccaagagcacctctgggggcacagcggcctgggctgcctggtcaaggactacttccagacgtatcactgagcgggctggcaaggcgcatagnnnnnnnnn

SEQ ID NO: 132746 - DNA, 484 bp, Homo sapiens
  misc_feature: GYAE6OF01D8P0N.9.34.D01.1.454.CMB.1.raw
  modified_base (472)..(484): a, c, t, g, unknown or other
  misc_feature (472)..(484): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccgggaaccctggtcgccgtctcctcagccctccaccaagggcccatcggtccttccccctggccaccctcctccaaacgacgccacctcgtgggggccacgacgccggccctgggcctgccgtggtcaaggactacttccagacgtatcactgagcgggctggcaaggcgcagtagnnnnnnnnnnnnn

SEQ ID NO: 132747 - DNA, 708 bp, Homo sapiens
  misc_feature: GYAE6OF01DFKO1.9.34.D01.1.454.CMB.1.raw
tcagtgatacgtctcacgaccggtgctcgatttagatcgtctgtgttgggtttggggacaagaggcagcactcaggaccaatctccagcctatgcctggtctcctctcctcctcactctcctcgctcactgcacgagggtccgtgggcccagtcgttgttctgacgctagccgccctcagtgtcgtggggccccagggtcaggagggtccgaccgacttcgtcgtgcctacggtcggaagtacgccttccaacagtcgggcacgttctgacttcgtacacgtggtaccaacgtaacttccgaaggtaaccacgaccccaaagtccactacgtaagtttactgaacaacgatacgaacgccgtaccctacgaacgggtccctaggaacccgtagtttcccgtaccggtccttaccgaacgttcgtaggccaacgtacttccgaacgtcccttcccgtacggccctaagtccgaacgtcgggtacctaccgacggtcgtaggaacgtactacggaacggtcgtaacgtaaccttactttaccgcggtacctacggttcgtaagtccgaacgtacgttcggtaaccttaaacgtactcgtaccggttacttacgggtaacgtacgggaaaccgtaggttcccgtaacccggttcgtacgggtaccgaccggtaccccgaaacggtcccccaaaccccgtgtccgttacccg

SEQ ID NO: 132748 - DNA, 500 bp, Homo sapiens
  misc_feature: GYAE6OF01DTJBY.9.34.D01.1.454.CMB.1.raw
  modified_base (480)..(480): a, c, t, g, unknown or other
  misc_feature (480)..(480): n is a, c, g, or t
  modified_base (487)..(500): a, c, t, g, unknown or other
  misc_feature (487)..(500): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattacgtgggggccgggaaccctggtcgccgtctcctcagcctccaccaacgggcccatccggtccttccccctggcccacccctccccaagacgccaccctcgtcgggggccacgacggccggcccgtgggcctggcccgtgggtaccaaagggtacctacttccagtacgtatccactgagcggctgggcaaggcncatacgnnnnnnnnnnnnnn

SEQ ID NO: 132749 - DNA, 461 bp, Homo sapiens
  misc_feature: GYAE6OF01ELEDJ.9.34.D01.1.454.CMB.1.raw
  modified_base (420)..(420): a, c, t, g, unknown or other
  misc_feature (420)..(420): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (447)..(461): a, c, t, g, unknown or other
  misc_feature (447)..(461): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctcgcagtcgacactttgattactgggggccgggaacctggtcgccgtctcctcagcctccacaaggccatcgtctcccctgcaccctctccaagacgcacctcgtggggcacagccggccctgggctgcctggtcaaggactacttccagacgtancactgagcggntggcaaggcncatagnnnnnnnnnnnnnnn

SEQ ID NO: 132750 - DNA, 612 bp, Homo sapiens
  misc_feature: GYAE6OF01DKV6P.9.34.D01.1.454.CMB.1.raw
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattcacgcaaactcgtgagggccnttcatcatcncaganacaattcccagaacatactgtctctgacaactcaataacctgagagcgagacacgctatttattcngtgcgaaggnggcatagtggaatacgtatttcgactccctcgcagtcgactactttgatttacggcggggccgggaaccctgggtccgccgtctcctcacgccctaccaaccgaacgggccctacgtccggttcccttcccccgtcggcccaccccgtcctacccgaacgtacgacctacccgtcgggtacggggaccaaccgacggcccggtcccgtggggccgtcggtcccgttacgggtaccgaaacgggtacccttaccgttacccgaacggtaaccgttacgtcccgacgtacggg

SEQ ID NO: 132751 - DNA, 455 bp, Homo sapiens
  misc_feature: GYAE6OF01BJX1E.9.34.D01.1.454.CMB.1.raw
  modified_base (158)..(158): a, c, t, g, unknown or other
  misc_feature (158)..(158): n is a, c, g, or t
  modified_base (275)..(275): a, c, t, g, unknown or other
  misc_feature (275)..(275): n is a, c, g, or t
  modified_base (420)..(420): a, c, t, g, unknown or other
  misc_feature (420)..(420): n is a, c, g, or t
  modified_base (441)..(455): a, c, t, g, unknown or other
  misc_feature (441)..(455): n is a, c, g, or t
tcagtgatacgtctcacgaccggtgctcgatttagatcgtctgtgttgggtttggggtcaccatctcgtgcactggaagtagctccaacatctgggcacgttatgatgtacactggtaccaacaacttccaggaacagcccccaaagtcatcatttangacaacatgaagcggccctcgaggggtccctgaccgattctccggctccaagtctggcacatcagcctcctggccatcacgtgggcctccaggctgaggatggaggctgattatacngcctactcctatgacagcagcctgagaagtgtggtagttcgggcgggaggaccaaggctacgaccgtcgtaggtcacgccaaggctcgcccctggcctacgtcctcgttccccgcctcctcgacgacgtactccgtgacggcggngtcggacaaggcgacatagcnnnnnnnnnnnnnnn

SEQ ID NO: 132752 - DNA, 498 bp, Homo sapiens
  misc_feature: GYAE6OF01CCYKP.9.34.D01.1.454.CMB.1.raw
  modified_base (447)..(447): a, c, t, g, unknown or other
  misc_feature (447)..(447): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtcccctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccagctgaggatgaggctgactattactgccagtcgtatgacngtcgctaagtaacatcgtcttcggaactggaccaaggtcaccgtcgtcggg

SEQ ID NO: 132753 - DNA, 549 bp, Homo sapiens
  misc_feature: GYAE6OF01BNJN8.9.34.D01.1.454.CMB.1.raw
  modified_base (140)..(140): a, c, t, g, unknown or other
  misc_feature (140)..(140): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (357)..(357): a, c, t, g, unknown or other
  misc_feature (357)..(357): n is a, c, g, or t
  modified_base (524)..(524): a, c, t, g, unknown or other
  misc_feature (524)..(524): n is a, c, g, or t
  modified_base (527)..(528): a, c, t, g, unknown or other
  misc_feature (527)..(528): n is a, c, g, or t
  modified_base (530)..(534): a, c, t, g, unknown or other
  misc_feature (530)..(534): n is a, c, g, or t
  modified_base (536)..(549): a, c, t, g, unknown or other
  misc_feature (536)..(549): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataacctgagaggcgaggacacggcctatttatttcngtgcgaaggngcatatggaagtacgattttcgatccctcgcagtcgacactttgattacgtggggaccgggaacctggtccgccgtctcctcacgcctccaccgaacggcccagtccggtcttcccccgnggcccaccctcctaccgaagcgccacctcgtcggggccacgacgccgcccgtgggctcgccgtggtaccgaacggtactaccgttccgaacgtccggttaactccgtaacgtcgggaacggccggggtacctcgggaaccgaaacggggtcccgacgtaattacggngcnngnnnnngnnnnnnnnnnnnnn

SEQ ID NO: 132754 - DNA, 693 bp, Homo sapiens
  misc_feature: GYAE6OF01CQGNY.9.34.D01.1.454.CMB.1.raw
  modified_base (235)..(235): a, c, t, g, unknown or other
  misc_feature (235)..(235): n is a, c, g, or t
  modified_base (327)..(327): a, c, t, g, unknown or other
  misc_feature (327)..(327): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattctacgcaaactccgtgacggggccncttcatcatctccagagacaactccagaacatactgtctctgacaactacaataacctgagaggacgaaggacacggacctattttatttcngtagacgaaggagcatagtaggaagtacgtatttcgactccctcgcagtcgactacgtttagacgtttacggtcggggaccggggtaaccctgggtccgtacccggtctcccgtcgaccgtccctacccgaaccgaaccggggtcccctaacgttccccggttacccttttcccccccgtacgggtcccctaacccccgttcccgttaacccgaacggtaccgacccgtaaccgtccggtacgggggacctaccgacggtccccgggtacccgtcggggccttcgggacccgttgggaaccgaaacgggttacccttaaccgttacccgaacggttaaccgttactccgtaacgtcggaaccgggg

SEQ ID NO: 132755 - DNA, 587 bp, Homo sapiens
  misc_feature: GYAE6OF01BN0P6.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatggaagtacgattttcgatccctcgcagtcgactactttgattacgtggggccgggaacccgtggtccgccgtctccctcacgcctccaccaacgggcccacgtccggtccttccccctcggcctacccctccctaccaacgacgccacccgtcgtcgggggccacgacggccggcccgtgggccgtcggcccgttcgggtccaaacgggtaccttaccgttcccgaacggtaccgttactccgacgtacggg

SEQ ID NO: 132756 - DNA, 567 bp, Homo sapiens
  misc_feature: GYAE6OF01CZ4LQ.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccagggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatggaagtacgtatttcgatccctcgcagtcgacactttgattacgtggggccgggaaccgtggtcgccgtctcctcacgcctccaccaacggcccagtccgtccttccccctggccaccctcctaccaagacgcacctcgtcggggcacgacgccggcccgtgggcctcggcccgttggtccgaaacggtaccttaccgttacccgacgtaccgttaactccgtacgtacgg

SEQ ID NO: 132757 - DNA, 592 bp, Homo sapiens
  misc_feature: GYAE6OF01BWGI5.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatagtggaagtacgattttcgatccctcgcagtcgactactttgattacgtggggccgggacctggtcgccgtctcctcacgcctccaccgaacgggcccagtccggtccttcccccgtggcccaccctcctacccaagacgccacccgtcgtcgggggccaccgacggcccggtcccgtggggccgtcggcccgttgggtcccgaaacgggaccctttaacctttccccgaacggtaacccgttactccgaaccgtacggg

SEQ ID NO: 132758 - DNA, 572 bp, Homo sapiens
  misc_feature: GYAE6OF01A7BOV.9.34.D01.1.454.CMB.1.raw
  modified_base (248)..(248): a, c, t, g, unknown or other
  misc_feature (248)..(248): n is a, c, g, or t
tcagtgatacgtctcacgaccggtgctcgatttagatcgtctgtgttgggtttggggacaagagggcagcacgtcaggacaatctccagcatggcctggtctcctctcctcctcactctcctcgctcactgcacagggtcctgggcccagtctgttcttgacgcagccgtccctcagtgtctggggccccagggcagagggtcaccgatcgtcgtgcactggagtagctccaacatcgggcacgttangatgtacactggtaccaacaccttccaaggaactacgcccccaaagtcactcatttatgacaacgatgaagcggccctcgacgggtccctgaccgattccgcggctacgaagtctggacacactcgagccctcccgtcggccatcactcgggcctccgaggctagaggatgacgtctgaacttattactgcctagtcgtagtgtacgaggtcgaccttaagtactagttcgttcgttacggaacgtcggggaaacacggttcaccggttccgtacgggtacacgtaccccgtaacggtaccccaaaccccgtagtccggtaccc

SEQ ID NO: 132759 - DNA, 452 bp, Homo sapiens
  misc_feature: GYAE6OF01BIMD7.9.34.D01.1.454.CMB.1.raw
  modified_base (443)..(452): a, c, t, g, unknown or other
  misc_feature (443)..(452): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgagggccgcttcatcatctccagagacaattcccagaacatactgtctctgcaactcaataacctgagaggcaggacacggccatttattctgtgcgaaggaggcatatggaagtacgattttcgatcctccgcagtcgacactttgattactggggccggggaaccctggtcgccgtctcctcagcctccaccaagggcccatcggtcttcccctggcaccctcctccaagagcacctctggggcacagcgcctgggctgcctgtcaaggctacttcagactatcactgagcggctggcaaggcgcatagnnnnnnnnnn

SEQ ID NO: 132760 - DNA, 472 bp, Homo sapiens
  misc_feature: GYAE6OF01A1Q15.9.34.D01.1.454.CMB.1.raw
  modified_base (455)..(472): a, c, t, g, unknown or other
  misc_feature (455)..(472): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccattttatttctgtgcgaaggaggcatatgggaagtacgattttcgatccctccgcagtcgacactttgattactggggccggggaaccctggtcgccgtctcctcagcctccaccagggcccatcggtcttccccctggcaccctcctccagagcacctctggggcacagcggccctgggctgcctggtcaaggctacttccagacgtatcactgagcgggctggcaaggcgcagtagnnnnnnnnnnnnnnnnnn

SEQ ID NO: 132761 - DNA, 560 bp, Homo sapiens
  misc_feature: GYAE6OF01A1ZMX.9.34.D01.1.454.CMB.1.raw
  modified_base (550)..(550): a, c, t, g, unknown or other
  misc_feature (550)..(550): n is a, c, g, or t
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggagcatatgggaagtacgatttcgatccctcgcagtcgactactttgattacgtggggccgggaaccgtggtccgccgtctcctcacgcctccaccaacgggcccacgtccggtccttcccccgtcggccaccctccctaccaacgacgccacctcgtcggggcacgacgcggcccgtgggccgtcgcctcggtccaacggacctaccgttcccgagtacgtntcgacgtcgg

SEQ ID NO: 132762 - DNA, 856 bp, Homo sapiens
  misc_feature: GYAE6OF01DJVOD.9.34.D01.1.454.CMB.1.raw
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (848)..(848): a, c, t, g, unknown or other
  misc_feature (848)..(848): n is a, c, g, or t
  modified_base (850)..(850): a, c, t, g, unknown or other
  misc_feature (850)..(850): n is a, c, g, or t
tcagtgatacgtctcacgaccggtgctcgatttagatcgtctgtgttgggtttgggattcacgttgcaggatgtacggtctggggtcgcaggtcatcgctgggtggcggtcagtgacacgagttcacgcaaactccgtgacgggccgcttcgactcatcctccgagagacaattcccagaacatactgtctctgcaactcaataccngagagcgaggacacgggtccatttacttcgngtgacggaagggaggctaagtagtaggggtaacgtaacgtagtttttacgtaacttccccgttaccggtaccgtaacggttaccggtaacctaaccgttttacggaacgtttaaccggttaccgggggggtacccccggggggtaaaccccggttcggggtccccggtaccccggtttcccgttaccccgtaccgtaacggtacccccgttacccgaaccccgtaaaaccggggtcccctaacgtaccggggttaccccgtttaccccccggttacggggtacccctaaccccccgttcccgtaacccgtaaacggaaccggtacccgtaacccgttacccgggtacgggggggtacccaaccggtaaccggtacccggggtaccccggttacgggggcccgttaccgggtacccgtttacggggtacccgtaaacgggtaacttaaaccggttaccgtaacgtaaccgttaacgtaccggtaccggttacgggtaccggtaccgggtacgttccgggaccgtaacggggcccggtaaccgtacggttaacggtcgtacgacgtacgtcacgcaccgacgacgacgcgtcgacgtctccgtcgacgaccncncgcgcg

SEQ ID NO: 132763 - DNA, 443 bp, Homo sapiens
  misc_feature: GYAE6OF01DJF6D.9.34.D01.1.454.CMB.1.raw
  modified_base (364)..(364): a, c, t, g, unknown or other
  misc_feature (364)..(364): n is a, c, g, or t
  modified_base (422)..(422): a, c, t, g, unknown or other
  misc_feature (422)..(422): n is a, c, g, or t
  modified_base (427)..(443): a, c, t, g, unknown or other
  misc_feature (427)..(443): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctgacacatcagcctccctggccatcactgggctccaggctgagatgaggctgactattactgccagtcgtatgacagtggacctaagtaacatcgtcttcggaactgggaccaaggtccaccgtcctgggtcacgccccaaggcccaaccccntcgtcactctcgttccccacctctcagcgtactcactgagcgggctggacaaggccgnatagnnnnnnnnnnnnnnnnn

SEQ ID NO: 132764 - DNA, 466 bp, Homo sapiens
  misc_feature: GYAE6OF01CK81E.9.34.D01.1.454.CMB.1.raw
  modified_base (457)..(466): a, c, t, g, unknown or other
  misc_feature (457)..(466): n is a, c, g, or t
tcagtgatacgtctcacgaccggtgctcgatttagatcgtctgtgttgggtttgggattcacgtttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattacgtggggccggggaaccctggtcgccgtctcctcagcctccaccaagggcccatcggtcttcccctggcaccctcctccaacgagcacctctgggggcacacgcggccctgggctgcctggtcaaggactactcagacgtatcactgagcgggctggcaaggcgcatagnnnnnnnnnn

SEQ ID NO: 132765 - DNA, 580 bp, Homo sapiens
  misc_feature: GYAE6OF01DV0LH.9.34.D01.1.454.CMB.1.raw
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactgggagtgggtcgcaggcatcgctggtggcggtcatgacacattctacgcaaactccgtgaggggccncttcatcatctccaganacaattcccagaacatactgtctctgcaactcaataacctgagaggcgaggacacggccattttattctgtgacgaaggaggcatatgggaagtacgtatttcgatccctcgcagtcgactactttgatttagttcggggaccgggtaaccgtggtccgtccgtctccctcacgcctccaccgaacggcccagtccgtcccttcccctcggccctaccctccctaccaacgacgccaccgtcgtcggggccacgacggccggcccgtcgggctcggccctcggtaccgaacggtaccttaccgttccgaacgtacgtactcgtacgtcgg

SEQ ID NO: 132766 - DNA, 562 bp, Homo sapiens
  misc_feature: GYAE6OF01ADSAV.9.34.D01.1.454.CMB.1.raw
  modified_base (139)..(139): a, c, t, g, unknown or other
  misc_feature (139)..(139): n is a, c, g, or t
  modified_base (225)..(225): a, c, t, g, unknown or other
  misc_feature (225)..(225): n is a, c, g, or t
  modified_base (543)..(562): a, c, t, g, unknown or other
  misc_feature (543)..(562): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgagggccncttcatcatctccagagacaattcccagaacatactgtctctgcaactcaataacctgagaggcgaggacacggcctatttattcngtgcgaaggaggcagtatgggaagtacgtattttcgactcctccgcagtcgactactttgacttacgtcggggaccgggaacctggtcgccgtctccctcacgccctccgaccgaacgggcccacgtccggtcccttcccccgtcggcccacccctcctaccaacgacgccaccgttcgcggggccacgacggccggccctgggactcgaccgtgggtaccaaaaggtacccttaaccttacccaaggtaaccgttacgtaccaacgtcggaacgggtccgggacgttacgggaccgaaacgggtccgactaagtagnnnnnnnnnnnnnnnnnnnn

SEQ ID NO: 132767 - DNA, 464 bp, Homo sapiens
  misc_feature: GYAE6OF01DRZDE.9.34.D01.1.454.CMB.1.raw
  modified_base (140)..(140): a, c, t, g, unknown or other
  misc_feature (140)..(140): n is a, c, g, or t
  modified_base (459)..(464): a, c, t, g, unknown or other
  misc_feature (459)..(464): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagccacctctggggcacagcggccctgggctgcctggtcaaggactacttccagacgtatcactgaggcgggctggcaaggccgcatagnnnnnn

SEQ ID NO: 132768 - DNA, 599 bp, Homo sapiens
  misc_feature: GYAE6OF01B7AD6.9.34.D01.1.454.CMB.1.raw
  modified_base (233)..(233): a, c, t, g, unknown or other
  misc_feature (233)..(233): n is a, c, g, or t
  modified_base (586)..(586): a, c, t, g, unknown or other
  misc_feature (586)..(586): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccagggggagggactggagtgggtcgcaggcatcgctggtggcggtcatgacacattctacacaaactccgtgaggggccncttcatcatctccagagacaattcccagaacatactgtctctgcaactcaataacctgagaggcgaggacacggcctattttatttctgtgcgaaggaggcatagtggggaagtacgtattttcgactccctcgcagtcgactactttgattacgtcgggggacccgggtaacccgtgggtccgccgttctcctcacgcctaccaccgacgggccctagtccggtcccttcccccgtggccctaccctccaccaacgacgcctaccgtcgtcggggaccacgacggccggcccgtgggccttcggcccgttagggtacaacgggtaccttaccgttcccgaacgtaccgttanccgcgtggacggg

SEQ ID NO: 132769 - DNA, 588 bp, Homo sapiens
  misc_feature: GYAE6OF01BGT0N.9.34.D01.1.454.CMB.1.raw
  modified_base (574)..(574): a, c, t, g, unknown or other
  misc_feature (574)..(574): n is a, c, g, or t
tcagtgatacgtctcacgaccggtgctcgatttagatcgtctgtgttgggttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatggggaagtacgtattttcgatccctccgcagtcgactactttgattacgtcggggccggggaacccgtggtcgccgtctcctcagcctccaccgacgggcccagtccggtccttccccctggccctaccccgtcctcccaacgacgcctacccgtcgtcggggccacgacggccgggcccgtcggggcctcggccgttgggtaccgaacgggtacctaccgttcccgaacggaccgttancctacgtggacggg

SEQ ID NO: 132770 - DNA, 682 bp, Homo sapiens
  misc_feature: GYAE6OF01CYA3O.9.34.D01.1.454.CMB.1.raw
  modified_base (344)..(344): a, c, t, g, unknown or other
  misc_feature (344)..(344): n is a, c, g, or t
tcagtgatacgtctcacgaccggtgctcgatttagatcgtctgtgttggggtttgggggaggcttggtccagcctggggagtcccgtcgcgactctcctgtggtggcctctggattcacctttgagacctatgccttgacctgggtccgccaggctccgaggggacgggactggagtgggtcgcaggcatcgctggtggcggtcatgacacattctacgcaaacgtccggtagaaggggccgcttcatcatctaccaagtagacaattccaagaacatactgtctctgcaactcaaatactagagaggtcgagacacggtccagtttattctgtgacggaaggngcagtagtagggagtacgtagtttacgacttcccgtcgacacgtcgactactttgtaactttcggtcggggacccggggtaaccgttcgggtccgtccggttccttacccggtactacggtcccttaccgaacccgaaccgggaccctaagttcccggttacccctttccccgtacggtcccctaccccgtcctacccgaacgtaccgtaccctaccgtacggtacggggtccaccggaacggtcccgggtacccggtgggcctcggtccgtaggttacccgtaaggttacccttaccgttaccgaacggtaccgttactaccgtacgttcggacggg

SEQ ID NO: 132771 - DNA, 730 bp, Homo sapiens
  misc_feature: GYAE6OF01DJESN.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcctattttatttctgtgacggaaggaggcaagtagtaggggaaagttacgtattttcgacttcccctccgctacgtcgactacgtttgaactttacggtcgggggacccggggtaacccttcgggtccgtcccgtccttcccgtcgacgtcccctacccgaaccgaaccgggcccctaacgttcccggttaccctttccccccgtcggtaccctaccccctccctacccgaaacggtaccgtacccgtaacccgttccgggttcgggggacccaccggaccgggccccgggtccccgtacgggggtcccttaccggggccccgtttaggggtacccgtaaaccggggttaaccctttaacccgtttaccccggtaaacggtacccggttaaccttacccggtaaccgtcggggtaacccgggg

SEQ ID NO: 132772 - DNA, 470 bp, Homo sapiens
  misc_feature: GYAE6OF01DFV3Z.9.34.D01.1.454.CMB.1.raw
  modified_base (353)..(353): a, c, t, g, unknown or other
  misc_feature (353)..(353): n is a, c, g, or t
  modified_base (449)..(470): a, c, t, g, unknown or other
  misc_feature (449)..(470): n is a, c, g, or t
tcagtgatacgtctcacgaccggtgctcgatttagatcgtctgtgttggggtttggggggggcacgttatgatgtatactggtaccaacaacttccaggaacagccccaaagtcatcatttatgacaacatgaagcggccctcgaggggtccctgaccgattctccggctccaagtctggcacatcagccctccctggccatcactgggctccaggctgaggatgaggctgactattactgccagtcgtatgacaggtggacctaaagtaacattcgtcgttacggaacgtgggaaccaacggtccaccggttcccgtggggtccaacggccccaaaggcccctaaaccccgntcgtcctactccgttccgttcccccgccctcctacgacgtacgtatccgaacgttggacgggccgggtcgtagggaccaaacgggccgataagtgnnnnnnnnnnnnnnnnnnnnnn

SEQ ID NO: 132773 - DNA, 559 bp, Homo sapiens
  misc_feature: GYAE6OF01CDV1B.9.34.D01.1.454.CMB.1.raw
  modified_base (189)..(189): a, c, t, g, unknown or other
  misc_feature (189)..(189): n is a, c, g, or t
  modified_base (279)..(279): a, c, t, g, unknown or other
  misc_feature (279)..(279): n is a, c, g, or t
tcagtgatacgtctcacgaccggtgctcgatttagatcgtctgtgttggggtttgggcatgtgtgagttttgtcacaagatttgggctcaactttctgtccaccttggtccagcctggggagtccctgcgactctcctgtgtgcctctggattcacctttgagacctatcgccttgacctggggtcccnccaggctccgagggggagggactgggagtgggtcgccaggcagtcgctggtggcgtcatgacacattcacgcaaactccgtgaggggccncttcatcatctccagagacaattcccagaacatactgtctctgacaactcaataacctgagaggcgaggacacggccattttattctgtgcgtaaggagcatagtcggaagtacgattttcgactccctcgcagtcgatacttgattacgtcgggaccgggaacctggtccgccgtctccgtcgacgccctccaccgtaacgggcccagtccggtacctccccgtgccctaccctccgtacccgagacgccaccgtcgacggggccacgcggcggtcccg

SEQ ID NO: 132774 - DNA, 625 bp, Homo sapiens
  misc_feature: GYAE6OF01BFNL0.9.34.D01.1.454.CMB.1.raw
  modified_base (232)..(232): a, c, t, g, unknown or other
  misc_feature (232)..(232): n is a, c, g, or t
  modified_base (330)..(330): a, c, t, g, unknown or other
  misc_feature (330)..(330): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctattttattctgtgacgaaggnggacatagtgggaatacgtattttcgactccctcgcagtcgactactttgattacgtcggggacccgggtaaccgtgggtccgccgtctccgtcacgtccctaccgaacccgaacgggcccctacgttcccggtcccttcccccgtcggcccctaccccgtccctacccgaacgcgaccctacccgtcggtcgggggaccacgaccggcccggtcccgtgggtcctcggcccgttcgggtaccgaacgggacccttaccgttaccgaacgtaccgttaatccgacgtggaccggg

SEQ ID NO: 132775 - DNA, 779 bp, Homo sapiens
  misc_feature: GYAE6OF01EAYV6.9.34.D01.1.454.CMB.1.raw
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggtctttttctcgtggcttagttttaaaaggtgtccagtgtgaggttcaatgttggagtcgtgggggagcttggccagccgtggggagtccctgcgactctcctgtgtggcctctggattccactttgacgacctatcgccttgaccgtggggtcccgccgacggtcctaccggagggggaacgggcgtgggtaggtcggggtcgcgaggccagtcgcgtgggtcggtccggtcagtcgactactactttccgtaacgacctaaaacgtcccggtagggaaccgggggtcccgtacctttaccgaacgttcctaacttcccgttaacccaacggtaaaccgtaaaccgtaaaaccgtttacccccgaaaggtaaaacccttacttaacccgttaccggttcctttacccgtaggtaacccttaaacctacctaaaaccgtttaacccgtaagggaacggaacggggacggaacgggaaccgtaaccgggtaccctttaattttacgttttcgttacggtacggaacccgggtaaagggaaggtaccgtaaagttaacgggtaaggggtaaacgtttaaccggtttaaggtttttaccccgacccgtttccccgtccggttaacccgg

SEQ ID NO: 132776 - DNA, 536 bp, Homo sapiens
  misc_feature: GYAE6OF01DC4OT.9.34.D01.1.454.CMB.1.raw
  modified_base (140)..(140): a, c, t, g, unknown or other
  misc_feature (140)..(140): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (515)..(516): a, c, t, g, unknown or other
  misc_feature (515)..(516): n is a, c, g, or t
  modified_base (518)..(536): a, c, t, g, unknown or other
  misc_feature (518)..(536): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccaagaacatactgtctctgcaactcaataacctgagaggcgaggacacggcctattttattcngtgacgaaggnggcatagtagggaagtacgtattttcgatcccgtccgcagtcgactacttgattacgtggggccgggaacccgtggtcgccgtctcctcacgccctccaccgacggcccagtcgtccttccccgtggccaccctccctaccaacgcgccaccgtcggtcgggggcacgaggccggcccgtcgggctcgccgtcgggtaccaacggtaccttaaccttcccgacggtaccgtactccacgtggacggccggggactgggaccgaaggcgacagtagnngnnnnnnnnnnnnnnnnnnn

SEQ ID NO: 132777 - DNA, 568 bp, Homo sapiens
  misc_feature: GYAE6OF01BFC38.9.34.D01.1.454.CMB.1.raw
  modified_base (233)..(233): a, c, t, g, unknown or other
  misc_feature (233)..(233): n is a, c, g, or t
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggccatttattctgtgcgaaggaggcatatgggaatacgattttcgatccctcgcagtcgacactttgattacgtggggccgggaaccctggtcgccgtctcctcacgcctccaccaacgggcccagtccggtccttcccccgtggccaccctcctcccaagacgccacctcgtcgggggccaccgaggccggccctggggcctcggccctcgggtccaaacgggtaccttaccgttcccgaggtaccgtactcgacgtacgg

SEQ ID NO: 132778 - DNA, 460 bp, Homo sapiens
  misc_feature: GYAE6OF01C3K10.9.34.D01.1.454.CMB.1.raw
  modified_base (226)..(226): a, c, t, g, unknown or other
  misc_feature (226)..(226): n is a, c, g, or t
  modified_base (275)..(275): a, c, t, g, unknown or other
  misc_feature (275)..(275): n is a, c, g, or t
  modified_base (454)..(460): a, c, t, g, unknown or other
  misc_feature (454)..(460): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttcngtgcgaaggaggcatatggaagtacgatttcgatccctccgcagtcganacttgattactgggccggggaaccctggtcgccgtctctcagcctcaccaaagggcccatcggtcttccccctggcaccctcctccaagagcacctctgggggcacagcggccctggggctgcctggtcaaggactaacttccagacgtatcactgagcgggctggcaaggcgcatagnnnnnnn

SEQ ID NO: 132779 - DNA, 581 bp, Homo sapiens
  misc_feature: GYAE6OF01AVSCR.9.34.D01.1.454.CMB.1.raw
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggnggcatangggaagtacgattttcgatccctccgcagtcgacactttgattacgtggggccgggaaccctgggtcgccgtctcctcagcctccacccaagggcccagtccggtccttcccccgtggcccacccctccctaccaacgacgccaaccctcgtcgggggccacgacgccggccccgtggggcctcggcccgtgggtcccaagggacccttaaccgtttcccgacggaaccgttactccgactacggg

SEQ ID NO: 132780 - DNA, 569 bp, Homo sapiens
  misc_feature: GYAE6OF01CVJCV.9.34.D01.1.454.CMB.1.raw
  modified_base (240)..(240): a, c, t, g, unknown or other
  misc_feature (240)..(240): n is a, c, g, or t
  modified_base (544)..(544): a, c, t, g, unknown or other
  misc_feature (544)..(544): n is a, c, g, or t
  modified_base (548)..(549): a, c, t, g, unknown or other
  misc_feature (548)..(549): n is a, c, g, or t
  modified_base (551)..(569): a, c, t, g, unknown or other
  misc_feature (551)..(569): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtggaggggccgcttcatcatctccagagacaattcccagaacatactgtctctgcaactcaataacctgagaggcgaaggacacggcctattttattctgtgacgaaggnggcatagtgggaagtacgatttcgatccctcgcagtcgactacgtttgactttacgtcggggaccggggaacccgtggtccgccggttctccctcgacgccctcccaccgaacgggcccacgttccggtccttccccccgtcgggaccctaccccttaccctacccgaacggacgccacctccgtcgggggccacgacgccggcccgtcgggctcgccgtggtacaacggtacctacttccgaacgtacgtatccgtacgtggacggcgggccgtacgggacgtaacgggccgacgaagtacgngacnncnnnnnnnnnnnnnnnnnnn

SEQ ID NO: 132781 - DNA, 593 bp, Homo sapiens
  misc_feature: GYAE6OF01ECLLS.9.34.D01.1.454.CMB.1.raw
  modified_base (233)..(233): a, c, t, g, unknown or other
  misc_feature (233)..(233): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttatttctgtgcgaaggaggcagtagtggaagtacgtatttcgatccctcgcagtcgactatttgattacgtcggggaccggtacctggtccgccgtctccctcgacgccctaccgaccgaacgggccctacgtccggtcccttcccccgtggcccaccccttccctaccgaacgacgccctaccgtcggtcggggaccacgaccggccggtcccgtgggccgtcggcccgtggtccgaaacggtaccttaccgtccgaacgtacgttactccgacgtcgg

SEQ ID NO: 132782 - DNA, 522 bp, Homo sapiens
  misc_feature: GYAE6OF01EJGCB.9.34.D01.1.454.CMB.1.raw
  modified_base (300)..(300): a, c, t, g, unknown or other
  misc_feature (300)..(300): n is a, c, g, or t
  modified_base (484)..(484): a, c, t, g, unknown or other
  misc_feature (484)..(484): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggcccccagggcagagggtcaccatctcgtgcactggaagtagctccaacatcggggcacgttatgatgtacactggtaccaacaacttccaggaacacgcccccaaagtcatcatttangacaacatgaagcgccctcgacggggtccctgaccgattctccggctccaagtctggcacatcagcctcctgccatcacgtggctcgagctgagatgagctgactatactgcctagtcgtatgacagtcggacctaagtaacagttcgtcttacggaacgtgggaaccaaggtccaccggtcgngggtccacgacccgaacggaccccaaccctgtcgtacc

SEQ ID NO: 132783 - DNA, 557 bp, Homo sapiens
  misc_feature: GYAE6OF01CWOKN.9.34.D01.1.454.CMB.1.raw
  modified_base (531)..(531): a, c, t, g, unknown or other
  misc_feature (531)..(531): n is a, c, g, or t
  modified_base (534)..(535): a, c, t, g, unknown or other
  misc_feature (534)..(535): n is a, c, g, or t
  modified_base (537)..(541): a, c, t, g, unknown or other
  misc_feature (537)..(541): n is a, c, g, or t
  modified_base (544)..(555): a, c, t, g, unknown or other
  misc_feature (544)..(555): n is a, c, g, or t
  modified_base (557)..(557): a, c, t, g, unknown or other
  misc_feature (557)..(557): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccattttatttctgtgcgaagggaggcatagtgggaagtacgtattttcgatccctccgcagtcgacactttgattacgtggggccgggaaccctggtccgccgtctcctcagcctccaccaagggcccatccggtccttcccccctggcccaccctccctaccgaagcgcaccctcgtcgggggcacgaggccggcccgtgggcctcgccgtcgggtaccaaacggtacccttaccttacccgaacggtaccgtatccgaccgtaggtacggcggggaccttcgggaccgaacggggccgtacgaacgttaacggncgnngnnnnngcnnnnnnnnnnnngn

SEQ ID NO: 132784 - DNA, 507 bp, Homo sapiens
  misc_feature: GYAE6OF01AZZUA.9.34.D01.1.454.CMB.1.raw
  modified_base (284)..(284): a, c, t, g, unknown or other
  misc_feature (284)..(284): n is a, c, g, or t
  modified_base (316)..(316): a, c, t, g, unknown or other
  misc_feature (316)..(316): n is a, c, g, or t
  modified_base (383)..(383): a, c, t, g, unknown or other
  misc_feature (383)..(383): n is a, c, g, or t
  modified_base (427)..(427): a, c, t, g, unknown or other
  misc_feature (427)..(427): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
  modified_base (501)..(501): a, c, t, g, unknown or other
  misc_feature (501)..(501): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgccctcagtgtctggggccccagggcaggagggtcaccatctcgtgcactggaagtagctccaacatcggggcacgttatgatgtacactggtaccanaacttcagaacagccccaaagtcatcatttangacaacatagaagcggcccctcgacggggtcccctgacccgattccgtccgctccaagtctggcacntcagccctccctggccatccacgtcgggcctccaggcctggagngtgagctgacttattactgcctagtctagngacagtcgcctaagtacntcgtctacggactcggaacacggtcncgtccg

SEQ ID NO: 132785 - DNA, 624 bp, Homo sapiens
  misc_feature: GYAE6OF01CC7RJ.9.34.D01.1.454.CMB.1.raw
  modified_base (235)..(235): a, c, t, g, unknown or other
  misc_feature (235)..(235): n is a, c, g, or t
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccagggggagggactggagtgggtcgcaggcatcgctgggtggcggtcatgacacattctacgcaaactccgtgaggggccncttcatcatctccagagacaattcccagaacatactgtctctgcaactcaataacctgagaggcgaggacacggcctattttattctgtgcgaaggagcatagtggaatacgtatttcgactccctcgcagtcactactttgattacgtcgggggcccgggtaaccgtcggtccgtccgtcctcctcgacgtccctccaccgaacgggccctacgtcccggtccttcccccgtggtaccctacccctcccgtacccaacgaccgtacccaccgttcggtcgggggccaccggtaccggcccgggccccgtcgggcccgtcggtcccgttcggtaccgaaaccgggtacccttacccgttccgaacggtaaccgttactccgcgtacggg

SEQ ID NO: 132786 - DNA, 577 bp, Homo sapiens
  misc_feature: GYAE6OF01CZ95J.9.34.D01.1.454.CMB.1.raw
  modified_base (555)..(555): a, c, t, g, unknown or other
  misc_feature (555)..(555): n is a, c, g, or t
  modified_base (557)..(577): a, c, t, g, unknown or other
  misc_feature (557)..(577): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtggaggggccgcttcatcatctccagagacaattcccagaacatactgtctctgcaactcaataacctgagaggcgaggacacggcctatttattctgtgacggaaggaggcagtagtagggaagtacgtatttacgactccctccgcagtcgactacttagtattacggtcggggaccgggtaccctggtccgccgtctcctcacgtccctaccgaaccgacgggccctacgtccggttcccttcccccgtcggaccctaccctccctacccaacggacacccgtacccgtcggtcggggacaccgacggccggcccgtgggcctcgccgtacggtacgaaacggtctaccttacgaacgtaccggtactccgaacgttggaccggtacgggccgtagggaccgaacgggccgataacgtagcncnnnnnnnnnnnnnnnnnnnnn

SEQ ID NO: 132787 - DNA, 676 bp, Homo sapiens
  misc_feature: GYAE6OF01CPXO4.9.34.D01.1.454.CMB.1.raw
  modified_base (242)..(242): a, c, t, g, unknown or other
  misc_feature (242)..(242): n is a, c, g, or t
  modified_base (356)..(356): a, c, t, g, unknown or other
  misc_feature (356)..(356): n is a, c, g, or t
tcagtgatacgtctcacgaccggtgctcgatttagatcgtctgtgttgggtttgggggaggcttggtccagcctggggagtccctgcgactctcctgtgtggcctctggattctacctttgagacctatgccttgaccgtcgggtccgccgaggctccgagggggagggactggaggtgggtcgcaggcatcgctgggtggcggtcatgacacattcacgacaaactcggtggacggggccncttcatcatctcagagacactccaagaacatactgtctctcgacaactactaaactacctagaggaggacgaaggaccgacggtcctaagttttactttctgtgacggaaaggnggacagtagtagggaagttacgtattttcgacttcccgtccgacgacgtaccactacgtttagtaacgttacggtcgggggacccgggtaaccgttcgggtccgtccgtccttcccgtcacgtccctaccgaaccgacgggccctacgttcccgtcccttccccgtcggaccctacccttcccgtaaccaacggacgaccctacccgtcggtacggggacctaccgcggcccggccggtcgggtccgtcggtcccgttggtacgtaaacggtaccttaaccgttaccgaacgtaaccgttataccggtggcggtccgggg

SEQ ID NO: 132788 - DNA, 581 bp, Homo sapiens
  misc_feature: GYAE6OF01CLVYW.9.34.D01.1.454.CMB.1.raw
  modified_base (141)..(141): a, c, t, g, unknown or other
  misc_feature (141)..(141): n is a, c, g, or t
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
  modified_base (373)..(373): a, c, t, g, unknown or other
  misc_feature (373)..(373): n is a, c, g, or t
  modified_base (559)..(581): a, c, t, g, unknown or other
  misc_feature (559)..(581): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtggaggggccncttcatcatctccagagacaattcccagaacatactgtctctgcaactacaataaccngagagcgagacacggcctatttattcngtgacgaaaggaggcataagtagggaagtaacgtattttcgatcccctccgcagtcgactacttgattacggnggggacccggggaacctggtcgccgtcctcctcacgcctccaccgaacgggcccatccggtcccttccccccgnggtacccacccctccctaccgaaacgacgcccaccgtcgtcgggggacaaccgacgcccgggacccgtgggcctcggtacccgttcgggactaaacggtaaccttaaccgttccgaacgtaaccggttacaccgtaccgtcggaaggtcccggggactcgggaacgtaaacgggcgacctaatagnnnnnnnnnnnnnnnnnnnnnnn

SEQ ID NO: 132789 - DNA, 431 bp, Homo sapiens
  misc_feature: GYAE6OF01E2XCG.9.34.D01.1.454.CMB.1.raw
  modified_base (425)..(431): a, c, t, g, unknown or other
  misc_feature (425)..(431): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctctggctccaagtctggcacctcagcctccctggccatcactgggcttcaggctgaggatgaggctgattattactgccactccctatgacagcagcctgagaagtgtggtattcgggcggagggaccaagctgaccgtcctaggtcagcccaaggctcgcccctcggtcactctcgttcccaccctcctcacgacgtatcactgacgcgggctggcagggcgcatgnnnnnnn

SEQ ID NO: 132790 - DNA, 586 bp, Homo sapiens
  misc_feature: GYAE6OF01A58G3.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaactaacctgagaggcgaggacacgccatttattctgtgcgaaggaggcagtagtgggaagtacgtattttcgactccctcgcagtcgactactttgattacgtcggggccgggtaacctggtcgccgtctcctcacgccctccaccgacgggccctacgtccggttcccttcccccgtggccctacccctcctcccgaacgacgccacccgtcgtcggggccacgacggccggcccgtcgggcctcggcccgtggtacgaacgggtaccttaccgttccgacgtacgtatccgacgtggacggg

SEQ ID NO: 132791 - DNA, 578 bp, Homo sapiens
  misc_feature: GYAE6OF01DZEQX.9.34.D01.1.454.CMB.1.raw
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (275)..(275): a, c, t, g, unknown or other
  misc_feature (275)..(275): n is a, c, g, or t
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (558)..(559): a, c, t, g, unknown or other
  misc_feature (558)..(559): n is a, c, g, or t
  modified_base (561)..(561): a, c, t, g, unknown or other
  misc_feature (561)..(561): n is a, c, g, or t
  modified_base (565)..(570): a, c, t, g, unknown or other
  misc_feature (565)..(570): n is a, c, g, or t
  modified_base (572)..(578): a, c, t, g, unknown or other
  misc_feature (572)..(578): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaaactccgtgaggggccgcttcatcatctccagagacaattcccagaacatactgtctctgcaactcaataacctgagaggcgaggacacggcctattttatttcngtgcgaaggnggcatagtgggaagtacgattttcgactccctccgnagtcgactactttgattacgtcgggggcccgggtaacctggtccgccgtctcctcacgccctccaccgaacgggcccagtccggtccttcccccgtggccctacccctcctccgaaagcgcctacccgtcgtcgggggccacgacggccggtcccgtgggcctcgcccgttgggtaccgaacggtaccttaccgttaccgaacgtaccgttactacctacgttggaccggtcgggtctacgggaccgaaacggggtccgacgtaagttacggcncgtnagcgnngncgcnnnnnncnnnnnnn

SEQ ID NO: 132792 - DNA, 556 bp, Homo sapiens
  misc_feature: GYAE6OF01CITMJ.9.34.D01.1.454.CMB.1.raw
  modified_base (140)..(140): a, c, t, g, unknown or other
  misc_feature (140)..(140): n is a, c, g, or t
  modified_base (229)..(229): a, c, t, g, unknown or other
  misc_feature (229)..(229): n is a, c, g, or t
  modified_base (379)..(379): a, c, t, g, unknown or other
  misc_feature (379)..(379): n is a, c, g, or t
  modified_base (534)..(556): a, c, t, g, unknown or other
  misc_feature (534)..(556): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaaataacctgagaggcgaggacacggcctattttatttcngtgcgaaggaggcatagtgggaagtacgtattttcgactccctccgcagtcgactactttgattacggtcgggggacccgggtaaccctggtccgccgtcctcctcgacgccctaccaccgaacgggccctagtccggtccttcccccgngccctacccctccctaccaacgcgccacccgtcggtcggggaccacgacggcccggcccgtgggcctcggccgtcgggtacaacgggtacctaccgttaccgagtactactccgacgtggacggcgggcgtgggaccgaaggccgactagtacgnnnnnnnnnnnnnnnnnnnnnnn

SEQ ID NO: 132793 - DNA, 746 bp, Homo sapiens
  misc_feature: GYAE6OF01BL8QJ.9.34.D01.1.454.CMB.1.raw
  modified_base (426)..(426): a, c, t, g, unknown or other
  misc_feature (426)..(426): n is a, c, g, or t
  modified_base (710)..(710): a, c, t, g, unknown or other
  misc_feature (710)..(710): n is a, c, g, or t
  modified_base (721)..(721): a, c, t, g, unknown or other
  misc_feature (721)..(721): n is a, c, g, or t
  modified_base (736)..(736): a, c, t, g, unknown or other
  misc_feature (736)..(736): n is a, c, g, or t
tcagtgatacgtctcacgaccggtgctcgatttagatcgtctgtgttggggtttgggattcacgttgcagatggtaggtctgggtcgcaggcatcgctggtggcggtccatgacacattctacgcaaacgtccgtgaggggccgcttcatcatctccagagacaacttcccagaactatactgtctctgacaactcaataacctgagaggcgagacacggactatttattctgtgacgaaggagcatagtgggtaagtacgtatttcgactcccgtccgcacgtcgactacgtttgacgtttacgtcggggtaccgggtaaccgtggtccggaccgtccgtcctcgacgtccctaccgaccgtaacggccctacgtccggtccttcccccgtggaccctacccgtacccgtacccgaaacggtacnccgtacccgtacggttaccgggggacctaaccggaccgggtcccggggtaccccggttcgggggtacccgttacccggggtccccggtttaacgggtaaacccgggtaaacggggttaacccggtttaacccggtttacccggtaacggttaaacccggtttaacgtacccgttaaccggttacggtaacccgggtccggggtaccgtacggggtaaccggaaacggggtccccggaacgttaacggtacgacgttacgtacgtcgcgtacgcggacgtaccgngactcggtacncgtacacgctacganctacgctacg

SEQ ID NO: 132794 - DNA, 640 bp, Homo sapiens
  misc_feature: GYAE6OF01D6TUC.9.34.D01.1.454.CMB.1.raw
  modified_base (389)..(389): a, c, t, g, unknown or other
  misc_feature (389)..(389): n is a, c, g, or t
  modified_base (632)..(632): a, c, t, g, unknown or other
  misc_feature (632)..(632): n is a, c, g, or t
tcagtgatacgtctcacgaccggtgctcgatttagatcgtctgtgttgggtcgtgggggaggcttggtccagcctggggagtccctgcgactctcctgtgtggcctctggattcacctttgagacctatgaccttgacctgggtccgccaggctccgaggggagggactgggaggtgggtcgcaggcatcgcgtggtggcggtcatgacactattctaccgcaaacctccggtggacggggcctcttcattcatctccgaagacgaacaacttcccaagaaacctatactgttcctctcgactaaactcaaacgtaacctggaagacgggacggaggacacggcctattttattctggtgacgaaggaggcagtagtacggagtacgtntttcgactccctcgcacgtacgactacgtttgaacgtttacggacgggggtaccgggaaccgttcggtaccggtccgttacctccctcgacgtccctacccgacccgaacggcccctacgttcccgttcccttccccgtcggcccacccgtccaccgaacgacgtcccaccgttccggtcgggacacgcggccgtccgtcgggcgtcgtcggtggtacaacggtctactccgacgagtactcncggtacgg

SEQ ID NO: 132795 - DNA, 578 bp, Homo sapiens
  misc_feature: GYAE6OF01D5V36.9.34.D01.1.454.CMB.1.raw
  modified_base (388)..(388): a, c, t, g, unknown or other
  misc_feature (388)..(388): n is a, c, g, or t
  modified_base (551)..(551): a, c, t, g, unknown or other
  misc_feature (551)..(551): n is a, c, g, or t
  modified_base (554)..(555): a, c, t, g, unknown or other
  misc_feature (554)..(555): n is a, c, g, or t
  modified_base (559)..(562): a, c, t, g, unknown or other
  misc_feature (559)..(562): n is a, c, g, or t
  modified_base (565)..(576): a, c, t, g, unknown or other
  misc_feature (565)..(576): n is a, c, g, or t
  modified_base (578)..(578): a, c, t, g, unknown or other
  misc_feature (578)..(578): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtggaggggccgcttcatcatctccagagacaattcccagaacatactgtctctgacaactcaatacctgagaggcgaggacacggctatttattctgtgacgaaggagcagtagtaggaagtacgtattttcgactccctcgctagtcgtactacttgacgttaccggcgggggacccgggtaacccgtgggtccgtccgtcctcctcacgccctaccgaaccggaacgggccctacgtcccggttcccttcccccgnggcccaccctcctacgaaacgcgtcctaccgtcggtcggggccacggacgccggacccgtgggcctcgtccgtacggtactaaacggtaccttaccgtccgaagtaccgtatcccgtagacgggacggccgggtactagggaccgaaggcccggatacgtagntanncgannnngcnnnnnnnnnnnngn

SEQ ID NO: 132796 - DNA, 530 bp, Homo sapiens
  misc_feature: GYAE6OF01AD082.9.34.D01.1.454.CMB.1.raw
  modified_base (319)..(319): a, c, t, g, unknown or other
  misc_feature (319)..(319): n is a, c, g, or t
  modified_base (494)..(494): a, c, t, g, unknown or other
  misc_feature (494)..(494): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacacgaccccaaagtcatcatttangacaacatagaagcggccctcgacggggtccctgaccgtattcctccggctaccgaagtctggcacactcacgccctcccgtcggccactccacgtcgggcctccgaggccgtggaggatggacggctaggacttattacctgacctagtcgtatgacagtcggtcctaagtacnttcgtcttacggaactgggaccaggtccacggtccg

SEQ ID NO: 132797 - DNA, 591 bp, Homo sapiens
  misc_feature: GYAE6OF01BY5DA.9.34.D01.1.454.CMB.1.raw
  modified_base (294)..(294): a, c, t, g, unknown or other
  misc_feature (294)..(294): n is a, c, g, or t
  modified_base (364)..(364): a, c, t, g, unknown or other
  misc_feature (364)..(364): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (558)..(558): a, c, t, g, unknown or other
  misc_feature (558)..(558): n is a, c, g, or t
  modified_base (570)..(570): a, c, t, g, unknown or other
  misc_feature (570)..(570): n is a, c, g, or t
  modified_base (574)..(574): a, c, t, g, unknown or other
  misc_feature (574)..(574): n is a, c, g, or t
  modified_base (578)..(579): a, c, t, g, unknown or other
  misc_feature (578)..(579): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (587)..(588): a, c, t, g, unknown or other
  misc_feature (587)..(588): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccattttattctgtgcgaaggaggcatagtgggaagtacgtattttcgattccctccgcagtcgactactttgattacgnggggccgggaacctggtcgccgtctcctcacgcctccaaccgaacgggcccagtccggtccttcccccgnggccctaccctcctaccaaagcgaccaccgtcgtcgggggacaaccgacggccgggcccgtggggcccttcggaccccgttagggtaaaccggtaccttaaccgttaccgaaggtaccgttactaccgaaccgtggacgggtccgggtactggggacctaaaggggcccgacgtaacgttaaggcncngacganagctagcagcgnacgnacgnngcncancnngcg

SEQ ID NO: 132798 - DNA, 663 bp, Homo sapiens
  misc_feature: GYAE6OF01EF0D1.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccagggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcctatttattctgtgcgaaggagcatagtgggaagtacgtattttcgactccctccgcagtcgactactttgactttacgtcggggacccgggtaacctggtccgccgtctccgtcacgccctaccgacccgaacgggcccctagttcccggttaccctttccccccgtcgggtaccctacccccgttcccgtacccgaaacggaccgaccctaacccgttccgggttcggggggaccaaccggtacgggccccgggtccccggttgggggacccttcggtcccgttacggggtaccaaacgggtacccgttaaccttacccgaacggtacccgttatccgaacgttgggaccggg

SEQ ID NO: 132799 - DNA, 544 bp, Homo sapiens
  misc_feature: GYAE6OF01EVV7B.9.34.D01.1.454.CMB.1.raw
  modified_base (519)..(522): a, c, t, g, unknown or other
  misc_feature (519)..(522): n is a, c, g, or t
  modified_base (524)..(527): a, c, t, g, unknown or other
  misc_feature (524)..(527): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(544): a, c, t, g, unknown or other
  misc_feature (533)..(544): n is a, c, g, or t
tcagtgatacgtctcacgaccggtgctcgatttagatcgtctgtgttggggtttgggattcacgttgcagatgtaggtctgggtcgcaggcatcggctggtggcggtcatgacacattctacgcaaactccgtggaggggccgcttcatcatctccagagacaattcccagaacatactgtctctgcaactcaataacctgagaggcgaggacacggcctattttattctgtgcgaaggagcatagtagggaagttacgtatttcgatccctcgcacgtcgactactttgattaccggtcgggggaccggggaaccctggtccgccgtctcctcagcctccaccgaacgggccctacgtccggtccttccccgtggcccaccctcctaccaacggcgcctaccgtcgtcggggacacgacgccggccgtcggctcggccgtcggtacgaaacggtacctaaccttaccgaagtacgtactaccacgtggtaggccgggcgtcggacgaggcgacgatgnnnngnnnngncngnnnnnnnnnnnn

SEQ ID NO: 132800 - DNA, 485 bp, Homo sapiens
  misc_feature: GYAE6OF01EV6MG.9.34.D01.1.454.CMB.1.raw
  modified_base (371)..(371): a, c, t, g, unknown or other
  misc_feature (371)..(371): n is a, c, g, or t
  modified_base (465)..(485): a, c, t, g, unknown or other
  misc_feature (465)..(485): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggagcatatgggaagtacgattttcgatccctcgcagtcgacactttgattactggggccggggaaccctggtcgccgtctcctcagcctccaccaagggcccatccggtcttccccctggccaccctcctccaagacncacctcgtcggggcacgagccggcctgggctgcctggtcaaggactactccagacgtactcacgtgacgcgggctggacgaaggcgacgatagnnnnnnnnnnnnnnnnnnnnn

SEQ ID NO: 132801 - DNA, 608 bp, Homo sapiens
  misc_feature: GYAE6OF01BUNVR.9.34.D01.1.454.CMB.1.raw
  modified_base (336)..(336): a, c, t, g, unknown or other
  misc_feature (336)..(336): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagcccgcctcagtcgtcgtcgggccccagggcagacgggtcaccatctcgtcgcactggaagtacgctaccaacgagtcggggctacgttatgatgtacacgtacggtaaccaacaaccttccaaggaaccacgaccccaaagtcatctatttangaacaacatacgaacgccgaccctgacgggtcccacgaccgtacttccgtccgctaccgaagtccgacggcactactcgacgtccctcccgtacggcctactcgaccgtcggcctccgtaggcctaggacgtacgtggacggtcttacggtactttacgttacgtacgtccgtagtaccgttagtacggtactaggtaccgtacctaaaggtactaacgttccggttacgttacggaagtaccggaaaccgtacggtccgacccggttacgg

SEQ ID NO: 132802 - DNA, 495 bp, Homo sapiens
  misc_feature: GYAE6OF01BU01M.9.34.D01.1.454.CMB.1.raw
  modified_base (475)..(475): a, c, t, g, unknown or other
  misc_feature (475)..(475): n is a, c, g, or t
  modified_base (481)..(495): a, c, t, g, unknown or other
  misc_feature (481)..(495): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtagacactttgattacgtggggccggggaaccctggtcgccgtctcctcacgcctccaccaacggcccatccgtccttccccctcggccacccctccctccaacgacgccaccctcgtcgggggcaccgacgccggcccctggggctcggcctgggtcaaacggactacttccgagacgtatcactgagcgggctggcaaggcncatagnnnnnnnnnnnnnnn

SEQ ID NO: 132803 - DNA, 589 bp, Homo sapiens
  misc_feature: GYAE6OF01EJ25C.9.34.D01.1.454.CMB.1.raw
  modified_base (462)..(462): a, c, t, g, unknown or other
  misc_feature (462)..(462): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaactaacctgagaggcgaggacacggcctatttattctgtgcgaaggaggcaatagtgggaagtacgtagttttcgactccctccgcacgtcgactactttgaacttacgtggggaccggggtaacctggtccgccgtctcctcacgcctccaccgacgggcccagtccggtccttccccnggcccaccctcctcgaacgcgcctaccgtcgtcggggccacgacgccggcccgtgggcctcggtcccgtgggtaccgaacggtacccttaaccgttcccgaacgtaccgtatccgacgtcggacggg

SEQ ID NO: 132804 - DNA, 474 bp, Homo sapiens
  misc_feature: GYAE6OF01CMB8S.9.34.D01.1.454.CMB.1.raw
  modified_base (447)..(474): a, c, t, g, unknown or other
  misc_feature (447)..(474): n is a, c, g, or t
tcagtgatacgtctcacgaccggtgctcgatttagatcgtctgtgttggggtttggggggggcacgttatgatgtacactggtaccaacaacttccaggaacagcccccaaagtcatcatttatgacaacatgaagcgccctcaggggtccctgaccgattctccggctccaagtctggcacatcagccctccctggccatcactgggctccaggctgagatgaggctgactattactgacctaggtcgtatgacagtcggacctaaagtaacagttcgtcgtttacggaactgggaaccaaggtccaccggtccgtggggtccaacggacccaacggacccaacccctactcgtaccaccttcctccgtttcccccaaccccttcctacgacgtacgtactacacgtggacggcgggcgtggaccgaaacgggcacgtaagtagcnnnnnnnnnnnnnnnnnnnnnnnnnnnn

SEQ ID NO: 132805 - DNA, 585 bp, Homo sapiens
  misc_feature: GYAE6OF01D4K7J.9.34.D01.1.454.CMB.1.raw
  modified_base (398)..(398): a, c, t, g, unknown or other
  misc_feature (398)..(398): n is a, c, g, or t
  modified_base (556)..(556): a, c, t, g, unknown or other
  misc_feature (556)..(556): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (571)..(576): a, c, t, g, unknown or other
  misc_feature (571)..(576): n is a, c, g, or t
  modified_base (578)..(581): a, c, t, g, unknown or other
  misc_feature (578)..(581): n is a, c, g, or t
  modified_base (583)..(585): a, c, t, g, unknown or other
  misc_feature (583)..(585): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctatttatttctgtgcgaaggaggcatagtgggaagtacgtattttcgactccctccgcagtcgactactttgatttacgtcgggggacccggggaaccctggtccgccgtctcctcacgccctccaaccgaacgggccccagttccggtcccttcccccgtggcccacccctcctccaagcnccacctcggtggggccacgacggccggtcccgtgggcctcgccgtgggtacgaaacggtaccttaccttacccgaaggtaccgttacgtaccgtaaccgttggaacgggtccggggtaccgtcgggaaccgaaacgggtcccgacgtaagtacggcgntacgcagcngncgcnnnnnncnnnncnnn

SEQ ID NO: 132806 - DNA, 721 bp, Homo sapiens
  misc_feature: GYAE6OF01BEYFG.9.34.D01.1.454.CMB.1.raw
  modified_base (707)..(707): a, c, t, g, unknown or other
  misc_feature (707)..(707): n is a, c, g, or t
  modified_base (714)..(714): a, c, t, g, unknown or other
  misc_feature (714)..(714): n is a, c, g, or t
tcagtgatacgtctcacgaccggtgctcgatttagatcgtctgtgttgggtttgggggaggtcttggtccagccgtggggagtccctgcgactctcctgtgtgcctctggattctacctttgacgacctatcgccttgaccgtcgggtcccgccgaggcctccggagggggagggacgtgggaggtgggtcgcgaggcagtcgcgtgggtggcggtcagtgacactattctacgacaacgtcgtggacgggcctcttcatcactcctaccgagacgactaacttcccaagaactattactgtcctcgtcgactaactacaactaaccgtggaggaggacggacggaccgaccggtacctttattttacttcgtggtacgacgggaaaggagactaagtaggtagggtaacttacgttacgtttcgaccttcccgacgtacgtacggtacgtacttacgttttagacgttaccggggcgggggtacccgggtaccttcgggtccctccgttccgtcctcgaccgtcccgtaccgaaccgaccggtaccgtcgttcccggttaccccttccccgtacgcccctaaccctcccgtaaccgacggtcctccgtaccggttcgggacgggccacggtccggtcccggtcccgtcggtccgttccgggccgttagggtaccgaaccgttccttaccgtacgtacgacgttacncgtacgngggccgg

SEQ ID NO: 132807 - DNA, 653 bp, Homo sapiens
  misc_feature: GYAE6OF01BFVXN.9.34.D01.1.454.CMB.1.raw
  modified_base (233)..(233): a, c, t, g, unknown or other
  misc_feature (233)..(233): n is a, c, g, or t
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccaggggagggactggagtgggtcgcaggcatcgctggtggcggtcatgacacattctacgcaaactccgtgaggggccncttcatcatctccagagacaacttcccagaacatactgtctctgcaactcaataacctgagaggcgaggacacggccatttattctgtgacgaaggaggcagtagtagggaagttacgtagttttacgactccccgtccgacagttaccgaactaccttttaggacttaacggtcgggggacccgggaacccgttgggtccgcccgttctccccgtcgacgtccctacccgaaccaacgggtccccacgtcccggttcccttcccccgtggcccctaccccgttcccacccgaaacggaccgtcccgtaacccgttcggtacgggggaccaccggacggcccggtccccgtggggcccttcggcccgttgggaccgtaaacggtaccctaccgttccaacgtacgtactccgacgtacgg

SEQ ID NO: 132808 - DNA, 629 bp, Homo sapiens
  misc_feature: GYAE6OF01COC0I.9.34.D01.1.454.CMB.1.raw
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
  modified_base (323)..(323): a, c, t, g, unknown or other
  misc_feature (323)..(323): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgacaaactccgtgacggggccncttcatcatctccagagacaatccagaacatactgtctntgacaactacaatacctgagaggcgaggacacggtcctattttatttcngtgacgaaaggagctatagtaggtaagtacgtattttcgacttccctcgactacgtcgaccttagtttaggaactttacggcgggggtacccggggaacccgttcgggtccgtccgtcctcctcaacgccttacccgaccgacgggccctagtccgttcccgttcccctggccctacccgtcaactacccaaggtacgacctccgtacggtcggggacacgaccggtccgggcccgtgggtccgtcgcgtaccgggtacaacgggtacctaccgttaccgacgtaaccggttactcgtagtacggg

SEQ ID NO: 132809 - DNA, 616 bp, Homo sapiens
  misc_feature: GYAE6OF01DTRYF.9.34.D01.1.454.CMB.1.raw
  modified_base (591)..(591): a, c, t, g, unknown or other
  misc_feature (591)..(591): n is a, c, g, or t
  modified_base (596)..(601): a, c, t, g, unknown or other
  misc_feature (596)..(601): n is a, c, g, or t
  modified_base (603)..(616): a, c, t, g, unknown or other
  misc_feature (603)..(616): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtggaggggccgcttcatcatctccagagacaattcccaagaacatactgtctctgacaactcaactaacctgagaggcgaggacacggctattttattctgtgacggaaggaggcataggtaggaagtacgtattttcgactccctcgcagtccactactttgacttacggcgggggacccgggtaaccgtcggtccgtccgtcctcccgacgacgtcccctacccgacccggaaccgggcccctacggttccccggttccccttccccccggtcggacccctacccccgttccctacccgaaacgccgaccctacccgtcgggtcggggaccaaccggccgggcccggtcccggtcgggaccttccggccgttacgggtaacgaacggtacctaccttaccgacgtacgtactcgacgtcgggacggtcgggaccgtggaaccggacggccgacagtagntgacnnnnnngnnnnnnnnnnnnnn

SEQ ID NO: 132810 - DNA, 610 bp, Homo sapiens
  misc_feature: GYAE6OF01B22M5.9.34.D01.1.454.CMB.1.raw
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (592)..(593): a, c, t, g, unknown or other
  misc_feature (592)..(593): n is a, c, g, or t
  modified_base (596)..(598): a, c, t, g, unknown or other
  misc_feature (596)..(598): n is a, c, g, or t
  modified_base (600)..(610): a, c, t, g, unknown or other
  misc_feature (600)..(610): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgactactttgattacgtggggccgggaaccctcggtcgccgtctcctcacgcctccaccaacgggcccacgtccggtccttccccccgtcgggccacccctccctcccgaaacgtacgcctacccgtcgtcgggggccacgacggcccgggtccccgtggggccttacgggaccgttcggggtacccgaaacgggtaaccctttaacccgttacccgaacggtaaccggttactaccgtaaccgtcggaacgggtccggggtccgttacggggaccgtaaacggggccgtaccgtaaggttacggacagcgngncgnngcnnngnnnnnnnnnnn

SEQ ID NO: 132811 - DNA, 567 bp, Homo sapiens
  misc_feature: GYAE6OF01DN3NE.9.34.D01.1.454.CMB.1.raw
  modified_base (461)..(461): a, c, t, g, unknown or other
  misc_feature (461)..(461): n is a, c, g, or t
  modified_base (558)..(558): a, c, t, g, unknown or other
  misc_feature (558)..(558): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgcctaggctccaggggagggactggagtgggtcgcaggcatcgctggtggcggtcatgacacattctacgcaaactccgtgagggccgcttcatcatctcagagacaattccagaacatactgtctctgacaactcaatacctgagagcgaggacacggctatttattctgtgacgaaggagcatagtaggaagtacgtatttcgactccctcgctagtcgactacgtttagacttacggtcgggggacccgggtaacctggtccgtccgtcctccgtcacgccctaccacgacggcccagtccgtcccttccccgngccctacccgtcctaccaagcgcctaccgtcgtcggggacacgcgccgtccgtgggctcggccgtggacgaacggtccttacgtccaagtacgtacncgacgtcgg

SEQ ID NO: 132812 - DNA, 173 bp, Homo sapiens; identical to SEQ ID NO: 132720
  misc_feature: GYAE6OF01C7VBR.9.34.D01.1.454.CMB.1.raw
  modified_base (173)..(173): a, c, t, g, unknown or other
  misc_feature (173)..(173): n is a, c, g, or t

SEQ ID NO: 132813 - DNA, 915 bp, Homo sapiens
  misc_feature: GYAE6OF01BPA4P.9.34.D01.1.454.CMB.1.raw
tcagtgatacgtctcacgaccggtgctcgatttagatcgtctgtgttgggtttgggacaagaggcagcactcaggacaatctccagcatggcctggtctcctctcctcctcactctcctcgctcactgcacagggtcctgggcccagtctgttctgacgcagccgccctcagtgtcgtcggggccccagggcaggagggtccaccatctcgtgcacgtggaagtagctaccaacagtcggggctacgttatgatgtaacactcggtaaccaactaacttccaaggaacacgacccccaaagtcatactattatgaacaacatagaacgccgtaccctacgacgggtccctagaccgtacgttccgtccggtacctaccgaagttccgtacgggacctaacgtacgtccgaaccggtccccgttacccccgtacgggtaccctaaccgttcccgtaacccggttcgggggccccctttaacccgggaaacggggtcccgttaaacggggaaaccgggttaacgtttacggggaaccggggttacccgttaaacgggttaaacccgtttttaaacgtttaacccggttaccgggtaccccggttaaaccgggttttaccggtttaaacggttacccgggaaacccggttaacggggttacccggggtttaaaaccccgtttaaaaacgggtttaaaacccgtaccgggtttttaaccccgggtttaaacccggttttaaacccgggggaaaaccgggtttacccgggggtaaaacccccgttaaaggggttccccccgttaaaccccgggtttccccgggtaacggggtttaaccccgaaacccgggtacccccccgtaaaacccggggtaaccccccttaaaaccccccggtcgtttccccggtttaaacccccgg

SEQ ID NO: 132814 - DNA, 841 bp, Homo sapiens
  misc_feature: GYAE6OF01CWH9J.9.34.D01.1.454.CMB.1.raw
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttggctgacctggtctttttctcgtggtcttagttttaaaaggtgtccagtgtgaggttcaactgttggagtcgtggggagtcttggtccagccgtggggacgtccctgcgactctcctgtgtcgcctgtggtacttcctacctttgacgtacctagtcgtccttcgtaccgtcgggtccgccgacggtccgtaccggagggggacggtacgtgggaggtcgggtccgcgacggcgtacgtccggtcgtgggtcggccggtacagtacgaactactactttaccgtaaccgaacctaaacccgttccgggtacgggaaccggggtcccttaccttacgaacttaccgtaccttacccgtaaccgaacgtaaccgtaaaccttaaacccgttaccccgaaagtaaacctaacgtttaccgttacggttcccttaccgtaccgtaaccctaaaccgtaccttaaaaccgttaaccggtacgggaaccgggtaacgggaaccgggtaaccgggtaacccgtaacccgggtttacttttaaacgtttttacgtttttacccggagggttaaccggtaacggggaaaacgggtaccgttaacggttaaacgggtttaagggttaaaccgggggtttaaacgtttaaccggtttttaacccgtttttacccggaaaccccgttcccccggttcccgggtaaacccgg

SEQ ID NO: 132815 - DNA, 640 bp, Homo sapiens
  misc_feature: GYAE6OF01DR1C3.9.34.D01.1.454.CMB.1.raw
  modified_base (235)..(235): a, c, t, g, unknown or other
  misc_feature (235)..(235): n is a, c, g, or t
  modified_base (292)..(292): a, c, t, g, unknown or other
  misc_feature (292)..(292): n is a, c, g, or t
  modified_base (632)..(632): a, c, t, g, unknown or other
  misc_feature (632)..(632): n is a, c, g, or t
tcagtgatacgtctcacgaccggtgctcgatttagatcgtctgtgttgggttgggggaggcttggtccagcctggggagtccctgcgactctcctgtgtggcctctggattcacctttgagacctatgccttgacctgggtccgccaggctccgagggggagggactgggagtgggtcgcaggcatcgctgggtggcggtcatgacacattctacgcaaactccgtgaggggccnctcatcatctccagacgacaacttccaagaacatactgtctctgacaactcaatacngagaggcgaggacacggctatttattctgtgcgaaggagcatagtgggaacgtacgtattttcgacttccctcgactacgtacgacttacgtttgtacttacgggtcggggggtacccggggtaacccgtgggtacccgtcccgttcctccctcgaccgtccctacccaaccggaaccgggccctacgttcccggttccccttccccgtcggtccctaccccttccgtacccgaaacggccgaccctaccgtcgggtcggggaccacggccggcccggtcccgtcggctcggcccgtgggtacacggtacctaccgttaccgacgtacgtactaccgtgngggacggg

SEQ ID NO: 132816 - DNA, 767 bp, Homo sapiens
  misc_feature: GYAE6OF01DAJ0P.9.34.D01.1.454.CMB.1.raw
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcacgccgccctcagtcgtcgtcggggccccagggcaggagggtcaccatctcgtgcacgtaggaagtagcctaccaacgagtcggggactacggttatagaatcggtaacacgttcggtaaccaaactaacttaccgaaggaaaccaaccgaccccctaaaagtccaagtactaacttttagacgaacaaactagtacgaacggccggaccctacgacggggttccctacggaacgtacttccgtacccggtactaccgaaggtctaggaccacgtataccacgtcccctccgtacgaccaacttccgaacgtcgggcctaccggtaaggccgttaggaacggtagtacgggacggtacgttaacggtaaacctttaagttacgtacggtaccaacggttacctaactaactttaaacgtaaacccgaaacccgaaggtacccgtaaccgttaaccgttcggtttacggtttacggggtacccgggtaacggggaacgggttaaccggttaacgtaaccggttccgggttaaaccccgttccgggttaaacgggtacccaaccggtacccccgggtaaacggtcccgttaccccgggtaccccccgg

SEQ ID NO: 132817 - DNA, 535 bp, Homo sapiens
  misc_feature: GYAE6OF01DD3QY.9.34.D01.1.454.CMB.1.raw
  modified_base (254)..(254): a, c, t, g, unknown or other
  misc_feature (254)..(254): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
  modified_base (529)..(529): a, c, t, g, unknown or other
  misc_feature (529)..(529): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagcccgccctcagtgtctggggcccccagggcagagggtcaccatctcgtgcactggaagtagcctaccaacagttcgggggacacggtttanggattggtaacactaggtaacccaaacgtaacttccgaaggaaaccacgacccccaaagtcatcatttatgacacaaatgagcgcctacgacgggtcccngacgattcnccgctcgaagtctgcanatcancctcctgcctncactggctcgagctgagatgagntagactatactgccagttcgaatgactagtgtacctaagtactatcgtacttacggaattgggaccgtaaggtccaccgtcgtcggcacggcccaaacggcccaacccgntcgtac

SEQ ID NO: 132818 - DNA, 712 bp, Homo sapiens
  misc_feature: GYAE6OF01CE1ZZ.9.34.D01.1.454.CMB.1.raw
  modified_base (142)..(142): a, c, t, g, unknown or other
  misc_feature (142)..(142): n is a, c, g, or t
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (280)..(280): a, c, t, g, unknown or other
  misc_feature (280)..(280): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (689)..(689): a, c, t, g, unknown or other
  misc_feature (689)..(689): n is a, c, g, or t
  modified_base (692)..(696): a, c, t, g, unknown or other
  misc_feature (692)..(696): n is a, c, g, or t
  modified_base (698)..(698): a, c, t, g, unknown or other
  misc_feature (698)..(698): n is a, c, g, or t
  modified_base (700)..(706): a, c, t, g, unknown or other
  misc_feature (700)..(706): n is a, c, g, or t
  modified_base (708)..(712): a, c, t, g, unknown or other
  misc_feature (708)..(712): n is a, c, g, or t
tcagtgatacgtctcacgaccggtgctcgatttagatcgtctgtgttgggtttgggattcacgttgcagatgtaggtctgggtcgcaggcatcgctgggtggcggtcatgacacattctacgcaaactccgtggaggggccncttcatcatctccagagacaattcccagaacatactgtctctgacaactacaataaccngagaggcgaggacacggcctaattttacttcnggtgacgaaggagctatagtaggaagtacgtatttcgactccctacncagtacgactacgtacgtacgttacggcggggacccgggtaacccgtggtcccgtccgttcctcctacgtaccgtaccctaccgaacccggaacgggtaccctacgttcccggttaccctttacccccgtacgggtacccctaacccccgttccctaacccgaaaccggtaccgaccgtaaaccccggttcgggtaccggggggtaccaaacccggaccgggtaccccggggtaccccggttcgggggaccctttacgggtaacccggtttagggtaacccgaaaacgggttaacctttaacccgttacccggtaacggtaacccgttacttaccggtaacgtacgggtaacgggtccggggtacgttacgggaaccgtaacgggcccgtaactaaggtacgngngacncgnnnnngngnnnnnnnannnnn

SEQ ID NO: 132819 - DNA, 234 bp, Homo sapiens
  misc_feature: GYAE6OF01DDAXM.9.34.D01.1.454.CMB.1.raw
  modified_base (211)..(211): a, c, t, g, unknown or other
  misc_feature (211)..(211): n is a, c, g, or t
  modified_base (218)..(234): a, c, t, g, unknown or other
  misc_feature (218)..(234): n is a, c, g, or t
tcagtgatacgtctcacgaccggtgctcgatttagatcgtctgtgttgggtttgggctgactattactgccagtcgtatgacagtggcctaagtaacatcgtcttcggaactgggaccaaggtcaccgtcctgggtcagcccaaggcccaaccccactgtcactctcgttcccgccctctcagacgtatcactgagcgggctggcaaggcncagtagnnnnnnnnnnnnnnnnn

SEQ ID NO: 132820 - DNA, 547 bp, Homo sapiens
  misc_feature: GYAE6OF01DXYDY.9.34.D01.1.454.CMB.1.raw
  modified_base (341)..(341): a, c, t, g, unknown or other
  misc_feature (341)..(341): n is a, c, g, or t
  modified_base (372)..(372): a, c, t, g, unknown or other
  misc_feature (372)..(372): n is a, c, g, or t
  modified_base (477)..(477): a, c, t, g, unknown or other
  misc_feature (477)..(477): n is a, c, g, or t
  modified_base (494)..(494): a, c, t, g, unknown or other
  misc_feature (494)..(494): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
  modified_base (524)..(524): a, c, t, g, unknown or other
  misc_feature (524)..(524): n is a, c, g, or t
  modified_base (540)..(540): a, c, t, g, unknown or other
  misc_feature (540)..(540): n is a, c, g, or t
tcagtgatacgtctcacgaccggtgctcgatttagatcgtctgtgttgggtttgggcatgtgtgagttttgtcacaagatttgggctcaactttcttgtccaccttggtccagcctggggagtccctgcgactctcctgtgtggcctctggattcacctttgagacctatgccttgacctgggtccgccaggcctccgagggggagggactgggagtggggtcgcaggcatcgctgggtggcggtcatgacacattcacgcaaactccgtgacggggccgcttcatcatcctccagagacaattcccagaacatactgtctctgacaactacaattaaccngagaggcgaggacacggcctattttatttcngtgacgaaggaggcattagtgggaagtacgtatttacgacttccctcgcaagtcgactactttcgtacttacgcggggtacccgggaacctggtccgcgtctccncacgcctcacacggccngtccgtctccccngccnccctcncacgacncacctcgtcgggcacngcgcccg

SEQ ID NO: 132821 - DNA, 570 bp, Homo sapiens
  misc_feature: GYAE6OF01AKMLL.9.34.D01.1.454.CMB.1.raw
  modified_base (328)..(328): a, c, t, g, unknown or other
  misc_feature (328)..(328): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattccccagaacatactgtctctgcaactcaataacctgagaggcgaggacacggccatttattctgtgcgaaggngcatatgggaagtacgattttcgatccctcgcagtcacactttgattacgtggggccgggaaccctggtccgccgtctcctcacgcctccaccacgggccctagtccgtccttccccgtgccaccctcctccaacgcgcctaccgtcgtcggggccacgacggccggccgtgggactcggaccgtgggtacgaacgggtaccttaccgttcccaacggtaccgttagtccacgttggacggg

SEQ ID NO: 132822 - DNA, 446 bp, Homo sapiens
  misc_feature: GYAE6OF01C92QZ.9.34.D01.1.454.CMB.1.raw
  modified_base (243)..(243): a, c, t, g, unknown or other
  misc_feature (243)..(243): n is a, c, g, or t
  modified_base (277)..(277): a, c, t, g, unknown or other
  misc_feature (277)..(277): n is a, c, g, or t
  modified_base (342)..(342): a, c, t, g, unknown or other
  misc_feature (342)..(342): n is a, c, g, or t
  modified_base (425)..(446): a, c, t, g, unknown or other
  misc_feature (425)..(446): n is a, c, g, or t
tcagtgatacgtctcacgaccggtgctcgatttagatcgtctgtgttgggtttggggggcacgttatgatgtacactggtaccaacaacttccaggaacagcccccaaagtcatcatttatgacaacatgaagcggccctcaggggtccctgaccgattctccggctccaagtctggcacatcacgccctccctggccatcacgtgggctccgaggctgaaggatggaggctgacttattacngcctagtcgtatgacagttggacctaaagtaacnttccgtcgttacggaacgtcggaccaaaggtccaccgtcgtgggcacgacccaacgcccaacccntgtcaccttccgtcgtccccacccctcctcaacgtcgtactcgtactggacggcggtcgtggaaccgaaggccgctaagtcgnnnnnnnnnnnnnnnnnnnnnn

SEQ ID NO: 132823 - DNA, 702 bp, Homo sapiens
  misc_feature: GYAE6OF01DZZ7C.9.34.D01.1.454.CMB.1.raw
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagcccgccctcagtgtcgtcggggccccagggcaggacgggtcaccgatctcgtcgcacgtaggaagtacgctaccaacagtcggggactaacgttatgattcggtaacacgttacggtaaccaacctaacttccgaaggaaccaaccgacccccaaaagtcaatactatttacagaacaacagtagaacgccgccctacggacgggtcctacggacctacttccgccgtctacctaagtcgtacgcactataccacgtccctccgtcgacctactaccgtacgtcgggtacctaccgaggtaccgtgggaacggtacgtcgggaacgtcgttaacgtaacgtttacttcccgtagtacccgtagtttaccggtatacggtaaccgtaacggttacgtaaacccttaagtaacctcggttccggttaccgttacgggtaaccgtacgggtaacccgtacgggttacccgacccggttcggtaccgggtaccaaccggtaccccgaacccgtaaccccaaccccgtagtccggttaaccccg

SEQ ID NO: 132824 - DNA, 706 bp, Homo sapiens
  misc_feature: GYAE6OF01AI4CE.9.34.D01.1.454.CMB.1.raw
  modified_base (163)..(163): a, c, t, g, unknown or other
  misc_feature (163)..(163): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggtctttttcncgtggcttgttttaaaaggtgtccagtgtgaggttcaactgttggagtcgtgggggagctggtccagccgtggggacgtccctgcgactctcctgtgtcggcctcgtggacttccaccttttgacgtacctatcgtccttcgaccgtgggtcccgccaggcctccgaggggaggacgtggaggtgggtcgcgaggcagtcgctgggtggcggtcagtgacacacttcctacgacaaaccgtccggtaggacggggtccctcttccgaatccgaatcctccgaagacgaactaacttacccaagaaactactaacttcgtcctacgtcgacctaactacctaaacgtaacccgtaggaacggtacgggacggtaaacgggaaccgtaaccgggtacccttaagttttacgtttaccggttcgggttaacgggtacgggtaaaacggggtaggggtaactaacggttaaaggggttaagggtaaaacgggttaaccgtttaacgttttaccccgggtaactttcccccggtacccggttaacccg

SEQ ID NO: 132825 - DNA, 435 bp, Homo sapiens
  misc_feature: GYAE6OF01AZD0W.9.34.D01.1.454.CMB.1.raw
  modified_base (364)..(364): a, c, t, g, unknown or other
  misc_feature (364)..(364): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (426)..(435): a, c, t, g, unknown or other
  misc_feature (426)..(435): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggcctccaggctgaggatggaggctgactattactgccagtcgtatgacagtggacctaagtaacatcgtcttcggaactgggaccaaggtcaccgtctgggtcacgcccaaggcccaaccccnctgtccactctcgttccccaccctcncagactancatgagcgggctggcaaggcacatagcnnnnnnnnnn

SEQ ID NO: 132826 - DNA, 736 bp, Homo sapiens
  misc_feature: GYAE6OF01DV3NV.9.34.D01.1.454.CMB.1.raw
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggcttgttttaaaaggtgtccagtgtgaggttcaactgttggagtcgtgggggaggcttggtccagccgtggggacgtccctgcgactctcctgtgtgcctctggattcacctttgacgacctatgccttgaccgtgggtcccgccgaggcctacccggaggggggtacgggaccgttggggaggtcggggtcgcgtaagggccagtccggcgtgggtcggccggtcagttggaaccactatttactaaccgacctaaaaccgtccgggtaggacggggccctcttacgactcactcctaccaagaacgacctaaacttcccaaagtaacctatacttcgtacttccgtcgacctaaccttacaaacttaacccgtaggaacggtaagggccggaacggtaacccgaaccgggttacccttaaagtttttttaccgtttccggttaggttacggtaccgggtaaaaggggtaaccggtacttaaagttaaagggttaaggggtaaaacggttttaacccggtttaacgtttttacccggtaacccttccccccggttcccggtaaacccgg

SEQ ID NO: 132827 - DNA, 523 bp, Homo sapiens
  misc_feature: GYAE6OF01BDXEY.9.34.D01.1.454.CMB.1.raw
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (506)..(523): a, c, t, g, unknown or other
  misc_feature (506)..(523): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctatttatttctgtgcgaaggaggcatagtgggaatacaattttcgatccctcgcagtcacactttgattacgtggggccgggaaccctggtcgcccgtctcctcagccctccaccaagggcccatcggtccttccccgnggccnccctgcctcccgaggacnccacccgtccgagacgcaaccgagcccggccctgggcctcgcccttgggtacaaacgggtaccctacttcccgaaggtaccgtactcaacgtggcgccgggctgggaccgaagggtccgacagtacgnnnnnnnnnnnnnnnnnn

SEQ ID NO: 132828 - DNA, 766 bp, Homo sapiens
  misc_feature: GYAE6OF01CK9TY.9.34.D01.1.454.CMB.1.raw
  modified_base (237)..(237): a, c, t, g, unknown or other
  misc_feature (237)..(237): n is a, c, g, or t
  modified_base (337)..(337): a, c, t, g, unknown or other
  misc_feature (337)..(337): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggcctccgaggggaggactggagtgggtcgcaggcagtcgcgtggtggcggtcatgacacattctacgacaaactccgtggacgggccnttcatcatctcagagacaacttccagaacatactgtactctgacaactcaaactaacctgagaacggacgaggaccgtacggtcctaattttagttttcnggttagacggaaaggcggaacaagtagtagggaaattaccgtagttttcgaacttccccgtacgacacggtaccaacttacgttttagtacgttaaccggtacgggggacccgggggtaacccgttcgggtccgtcccgttcgttacccttcgaccgtcccgtaacccaaccgtaacgggaccccctaacggttcccggtttaccccttcccccggtacggtaccctacccccgttaccgttaacccgaaacggaccgtacccgtaccgttaccgggacggggtaccaacggtacccgggccggtaccccggtcggggtcccttcggtacccggttacggtaacccggtaaaacggttaccctttaacccgtttacccgaaccgggttaaaccgttaccgtacccgtaacggtttccggaaaccggggg

SEQ ID NO: 132829 - DNA, 588 bp, Homo sapiens
  misc_feature: GYAE6OF01A0R3B.9.34.D01.1.454.CMB.1.raw
  modified_base (234)..(234): a, c, t, g, unknown or other
  misc_feature (234)..(234): n is a, c, g, or t
  modified_base (459)..(459): a, c, t, g, unknown or other
  misc_feature (459)..(459): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgaccctgggtccgccaggctccagggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggcctatttattctgtgcgaaggaggcatagtgggaagtacgtatttcgactccctccgctagtcgactactttgattacgcggggacccgggaacctggtccgccgtctcctcgacgcctaccaccacggccctagtccggtcccttccccncggcccaccccgtcctaccgaagaccgcctacccgtcgtacggggacaccgacggcccggccctcgggcctggcccgtggtaccaaagggacccttacgttcccgaacgtaccgtactcgaccgtaggg

SEQ ID NO: 132830 - DNA, 667 bp, Homo sapiens
  misc_feature: GYAE6OF01DMO2G.9.34.D01.1.454.CMB.1.raw
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (364)..(364): a, c, t, g, unknown or other
  misc_feature (364)..(364): n is a, c, g, or t
  modified_base (382)..(382): a, c, t, g, unknown or other
  misc_feature (382)..(382): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggcctccagggggaggactgggagtgggtcgcaggcatcgctgggtggcggtcatgacactattctacgccaaactccggtggaggggcctcttcatcatcctcaganacaattcccagaacatactgtctctgacaactnaatacctgagacggngaggacncggctatttattcngtgcgaagngnatagnggatactattcgactcccgtcgntagtcgtactacgttttnaacgtttcgggcgggggacccggggtaacccgtcgggtccgtacccggttcttcccgtcacgtcccctccaacccgaacgggtcccctagtcccggttcccgtttacccccgtcggtaccctacccctcccgttacccgaacggaccgtaccgtacccgttacgggtccgggggaccaccggaccggtcccgggacccgttcgggtcccgttcggtcccgttacgggtacccgaaacggtaccctaacccgtttaccgaacggtaccgttactccgtcgtacggg

SEQ ID NO: 132831 - DNA, 750 bp, Homo sapiens
  misc_feature: GYAE6OF01DRGH5.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtctcctcctcctcctcactctcctcgctcactgcacagggtcctgggcccagtctgttctgacgcagcccgcctcagtgtcgtcggggccccagggcaggaggtccaccatctcgtgcacgtggaagtacgctaccaactacggtccggggtactaacgttatgattagtaacctacgtacggtaacccaaacctaacttaccgaacggaaccaaccgaccccctaaagtctattactaattttacacgaacaacagtacgaaacggccggtaccctacggtaccggggttaccctacgtaccgtacttccggtacccgtacctaccgtaacgtcgtacggaccaactactaccgtaccgtcccttaccccggtcggacctaacgttacccgtaccgggttcgggtacccttaacccggaggtaccgtacgggaagggttaacgtacgggaacggttccgtaacggttaccgtttaacgttacccgtaccggttaccccttacgttaaccttaacggtacctaccggacgtaccgtacgtacccgtaagggtaaacggttaacgggttcggttaacgggttacggggttaacccggggaccggggtaaaccggccggtaaaccggtacccggg

SEQ ID NO: 132832 - DNA, 576 bp, Homo sapiens
  misc_feature: GYAE6OF01CCSM4.9.34.D01.1.454.CMB.1.raw
  modified_base (234)..(234): a, c, t, g, unknown or other
  misc_feature (234)..(234): n is a, c, g, or t
  modified_base (330)..(330): a, c, t, g, unknown or other
  misc_feature (330)..(330): n is a, c, g, or t
  modified_base (471)..(471): a, c, t, g, unknown or other
  misc_feature (471)..(471): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattctacgcaaactccgtgaggggccncttcatcatctccagagacaattcccagaacatactgtctctgacaactcaataacctgagaggcgagacacggctatttattctgtgacgaaggngacatagtaggaagtacgtatttcgactccctccgacacgtcgaactactttagagttacggtcgggggacccgggtaaccgtcggtccgccgttctccctcacgccctaccaccgaacggcccagtccgtccttccccgngcccaccctccctaccaagacgccaccgtcgcgggcacgcgccggcccgtgggcgtcgccgtacggtcgaacggtaccttaccgtcgagtactactcgacgtcgg

SEQ ID NO: 132833 - DNA, 978 bp, Homo sapiens
  misc_feature: GYAE6OF01COB7M.9.34.D01.1.454.CMB.1.raw
  modified_base (843)..(843): a, c, t, g, unknown or other
  misc_feature (843)..(843): n is a, c, g, or t
tcagtgatacgtctcacgaccggtgctcgatttagatcgtctgtgttgggtttggggtctgagagaggagcccagccctgggattgtcaggttgttttcatttggtgatcaggactggacagagagaactcacatggagtttggctgacctggtctttttctcgtggctagttttaaaaggtgtccagtgtgtaggttcaacgttgttggagttcgtggggggagtccgttggtccaggccgtagggggtacgtcccgtgaccgtactccgtccgttggtggtcgggtccttcgtagggtaactttccgtaaccgtttttggaacgtacccgtttagtcgtcccgtttgaacccgttcggggtccccgacccgtaggtcccggttacccggaggggggaggtaccgttggggaacggttcgggggtccgacggtaacgggcctaacggtccggtcggttacggggttcgggccggggttaacaagttcgggaaaccctaaccttacgttttaaccgtacccggaacctaaaaacccggttcccggttagggaacccggggggtcccttacccttaaccgtaacgttcccgtaagtttccccttaacccgaacggtaaaccggtaaaccccttaaaccgttttaccccgaaaacggttaaaccctacgtttaaacccggttcggttacccttacgggttttaaaccgacccttaaaaccgttaacccttaaaaaccgtttaaaccccgttaaggggtaaaccgggtaaccggggacccgggttaaaacggggaaccccgtaaacccggggtttacccttaaaggttttttccgttttaaccggngggtttacccgggaaacgggtaaaacgggtaacggtaccggtaaatttaaacggggtaacggggtttaaacggttaacccgggtttaacgtttttacccggaaacccgttcccccggtttacggtaacccccggg

SEQ ID NO: 132834 - DNA, 618 bp, Homo sapiens
  misc_feature: GYAE6OF01BX5S7.9.34.D01.1.454.CMB.1.raw
  modified_base (226)..(226): a, c, t, g, unknown or other
  misc_feature (226)..(226): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
  modified_base (598)..(601): a, c, t, g, unknown or other
  misc_feature (598)..(601): n is a, c, g, or t
  modified_base (603)..(603): a, c, t, g, unknown or other
  misc_feature (603)..(603): n is a, c, g, or t
  modified_base (605)..(618): a, c, t, g, unknown or other
  misc_feature (605)..(618): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtggagggccgcttcatcatctccagagacaattcccagaacatactgtctctgcaactcaaataacctgagaggcgaggacacggctatttattcngtgcgaaggagcagtagtaggaagtacgtatttcgactcccgtccgcagtcgactacttgtacgttacggtcggggcccggtaacctggtccgtccgtctcctcacgccctacccaccgaacggccctagttcccggttcccttcccccgtcggaccctaccccgtacccgtacccgaacgacgcccgtaccgtcgggtacgggggacccaacggtccggcccggtccccggtggggtcctccggtacccggttgggtaacccgtaaacgggtacccttaccgttcccggaacgtaaccgtttactacccgtagtacgggaccgggtcgggccgacgggaaccgaacgggcccgacgtaagcgngtgcncgnnnngngnnnnnnnnnnnnnn

SEQ ID NO: 132835 - DNA, 832 bp, Homo sapiens
  misc_feature: GYAE6OF01CISTQ.9.34.D01.1.454.CMB.1.raw
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggtctttttctcgtggcttagttttaaaaggtgtccagtgtgaggttcaacgtgttggagtcgtgggggaggcttggtccagccgtggggactcccgtgcgactctcctgtgtcggcctcgtggattcctacctttgacgtacctagttcgcctttggacccgtcggggtcccgccgacggtccgtaccggaagggggtaacggaccgtgggaacggtcggggtaccgaccggagggtacccaagttcccggcggttcggggttcgggtccgggttaccgaagttaccgggaaaccgaaccttaacgttttaccccgaaaccggtaacccgtaaaaacccggtttcccgggttagggggaacccggggggtccccttaccgttttaccaaccgttacccgtaacttccgtacccgaaagtaaccggtaaacccttaaaccgtttaccccgaaacggtaaaacctaaccgtttaaccgttcggttacctttccgtaacggtaaccctaaacttaaccgtaaacgttaacccggtaggaacggaacgggtaccggaacgggacccgaacgggttaccttaagtttttacttacggtacggttagaccgggtaaagggacgtacaaggttacggtacgggtaaagttaccgttaagttttccggaccttcccgtccgtaacgg

SEQ ID NO: 132836 - DNA, 572 bp, Homo sapiens
  misc_feature: GYAE6OF01A67D7.9.34.D01.1.454.CMB.1.raw
  modified_base (279)..(279): a, c, t, g, unknown or other
  misc_feature (279)..(279): n is a, c, g, or t
  modified_base (321)..(321): a, c, t, g, unknown or other
  misc_feature (321)..(321): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (558)..(564): a, c, t, g, unknown or other
  misc_feature (558)..(564): n is a, c, g, or t
  modified_base (566)..(570): a, c, t, g, unknown or other
  misc_feature (566)..(570): n is a, c, g, or t
  modified_base (572)..(572): a, c, t, g, unknown or other
  misc_feature (572)..(572): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaaactccgtgaggggccgcttcatcatctccagagacaattcccagaacatactgtctctgcaactcaataacctgagaggcgaggacacggccattttattctgtgcgaaggaggcatatgggaagtacgattttcgatccctccgcagtcgacnctttgattacgtggggccgggaacctggtcgccgtctcctcngccctccaccgaaggccactcggtccttcccccgtggcccacccctcctcccaagacgccacccgttcgtcgggggcaaccgcggccggcccgtggggccgtcgtcccgtcgggttaccaacgggtaaccttacccgtttacccgacgtaaccggttaactccgtacgtcggaacggtccggggacgttcggggaccgtaacgggtcggacctaagttacggcgngncgngncnagnnnnnnncnnnnngn

SEQ ID NO: 132837 - DNA, 831 bp, Homo sapiens
  misc_feature: GYAE6OF01DRRDY.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcaccttttgagacctatgccttgaccgtgggtccgccaggctccgagggggagggactgggaggtgggtcgcaggcatcgcgtgggtggcggtcatgacactattctacgacaaactccgtggacggggcctcttcatcactcctaccagagaactaacttcccaagaactattactgtctctcgactaactcaaaactaaccgtggaaggacggcggaacggaccgaccggtaccttaattttttacgttcgtaggtacggacggtaaagggcggactaagtaaggtacgggtaaagttacgtttacgttttccggaacctttcccccgtacgacgtaacggttaccctaacgtttacgttttaggaaacggttttaccggggaccggggggtaccccgggtaacccgttggggtccccgtcccgtttccctcccgttaccgacccggtaccccttacccgaaccccgggtaacgggtccccttacgggtttcccccggtttccccctttccccccggaggtccccctaacccccgttcccgtaaccggaaaccggtccctacccgtacccggttcgggtaaccggggaacccaccggccgggtccccgggtacccggtcggggtacccttccggtacccggttacggtaacccggaaaccggttccctttaacccgttaccggaaacggttaacccttacctccgtacggtacgggg

SEQ ID NO: 132838 - DNA, 663 bp, Homo sapiens
  misc_feature: GYAE6OF01EBVM6.9.34.D01.1.454.CMB.1.raw
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggcttagttttaaaaggtgtccagtgtgaggttcaactgttggagtcgtgggggagcttggtccagccgtggggactccctgcgactctcctgtgtggcctctggtattcacctttgagaccctatcgtccttgacccgtcgggtcccgccgacggccgtccggagggggacgggtaccgtggggaggtcggggtcgcgtaggcagtcgcgtgggtcggcggtcagtcgacactattcctaacgactaaaccgtccggtaggacggggccctcttcgactcatcctaccagacgaactaacttacccgaagaacctatacctgttcctctacgacctaacctacaaacttaacccgtagaacggacggacggaacggaaccgaaccggtaccttaagttttacgtttcgtcggtacggacggtaaagggacgactaagtacgggttaagggtaaacgttacggttaacttttacccgaactttcccccgtacgtaccg

SEQ ID NO: 132839 - DNA, 572 bp, Homo sapiens
  misc_feature: GYAE6OF01DRYGH.9.34.D01.1.454.CMB.1.raw
  modified_base (545)..(545): a, c, t, g, unknown or other
  misc_feature (545)..(545): n is a, c, g, or t
  modified_base (548)..(550): a, c, t, g, unknown or other
  misc_feature (548)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
  modified_base (564)..(572): a, c, t, g, unknown or other
  misc_feature (564)..(572): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaatcccagaacatactgtctctgcaactcaataacctgagaggcgaggacacggccattttattctgtgcgaaggaggcagtatgggaagtacgtattttcgactccctccgcgacgtacgactactttagtagttacggtcggggccgggtaacccgtcggtccgccgtctcctcacgcctccgaccgacggccacgtccgtccttccccgtcggccctaccctcctccaagacgcctacctcggtcggggccacgacggccggtcccgcgggtccgtcggtccgttacggtaccgaacggtaccttaccgttacccgaacgtacgttactaccgacggtacgacgggccggtacgtcggaccgtaggccgacgtagtacgtagnagnnngngnagcgntnngnnnnnnnnn

SEQ ID NO: 132840 - DNA, 681 bp, Homo sapiens
  misc_feature: GYAE6OF01CX2WR.9.34.D01.1.454.CMB.1.raw
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (347)..(347): a, c, t, g, unknown or other
  misc_feature (347)..(347): n is a, c, g, or t
  modified_base (499)..(499): a, c, t, g, unknown or other
  misc_feature (499)..(499): n is a, c, g, or t
  modified_base (657)..(657): a, c, t, g, unknown or other
  misc_feature (657)..(657): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgaccgtgggtccgccaggctccgagggggagggactggaggtgggtcgcaggcatcgcgtgggtggcggtcatgacacattcacgacaaactccgtggacggggccncttcatcatcnccaganacaattcccagaacatactgtactctgacaactcaaagtaaccnggagaggcgaggacacggctagtttattcgngtgacgaaggcgganatagtaggggaattacgtattttcgactccctacgacagtcgactacgtttgaagttacggtcgggggacccggtaacctgggtaccgcccgtctccgtcacgccctaccgaaccgtaacgggcccctagttcccggtccctttacccccgnggaccctaccccctcctaaccgaacgcgtaccccaaccggtttcgggacgggggacccaacgcgggcccgggtccccgtgggggtccctccgggtacccgttaggggtacccaaacgggttaaccccttacgttaacccgaacggttaccggtttaanccccgaaaggttcggaaccggggg

SEQ ID NO: 132841 - DNA, 605 bp, Homo sapiens
  misc_feature: GYAE6OF01BK7X6.9.34.D01.1.454.CMB.1.raw
  modified_base (414)..(414): a, c, t, g, unknown or other
  misc_feature (414)..(414): n is a, c, g, or t
  modified_base (459)..(459): a, c, t, g, unknown or other
  misc_feature (459)..(459): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggcttgttttaaaaggtgtccagtgtgaggttcaactgttggagtcgtgggggagcgttggtccagcctggggatcctgcgactctcctgtgtggcctctggattcacctttgagtacctatcgccttgacctgggtccgccgacggctccgagggggacgggacgtgggaggtgggtcgcgaggcagtcgcgtgggtcggcggtcagtcgacactattccaccgacaaacgttccggaggcggggccncgttcatcatccaccagacgacaattcccagaacatactgtctcnacaactcaactacctggagacgggacgaacggaccgacggcctaagttttacttccgtaggtacggacggaaacgggtaggcctaaaggtacgtaaggggaaacgttaacgttacttttaacggaacttccccggtacgtaacccg

SEQ ID NO: 132842 - DNA, 583 bp, Homo sapiens
  misc_feature: GYAE6OF01BG8CZ.9.34.D01.1.454.CMB.1.raw
  modified_base (475)..(475): a, c, t, g, unknown or other
  misc_feature (475)..(475): n is a, c, g, or t
  modified_base (522)..(522): a, c, t, g, unknown or other
  misc_feature (522)..(522): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaactgttggagtcgtgggggaggcttggtccagccgtggggacgtcctgcgactctcctgtgtggcctctggattcaccttttgacgacctatcgtccttgaccgttcgggtcccgccgacggctccggaggggacgggacgtgggaggtcgggtcgcgaggctagtcgcgtggtcggcggtcagtgacactattccgtacgtacaaaccgtccgtaggacggggtcctcgttacactcatcctccgaagacgactaaacgtccaagaactatacgtntctactcgacaactcaactacgtagaggacgcgagcgacgctatttnttctagtagacgaaggtagacgtagtagtaggtagtacgttattcgacttcccgtcgtacg

SEQ ID NO: 132843 - DNA, 606 bp, Homo sapiens
  misc_feature: GYAE6OF01BZ0K6.9.34.D01.1.454.CMB.1.raw
  modified_base (232)..(232): a, c, t, g, unknown or other
  misc_feature (232)..(232): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggctatttattctgtgacgaaggaggcatagtgggaagtacgtattttcgactccctcgctagtcgactacgtttgacttacggtcggggacccgggtaaccctggtccgccgttctcctcacgcctaccacgacgggccctagtccgtcccttccccgtggcctaccctcctaccgaagccgacctacccgtcggtacggggccacgacggcccggtccgtcgggtcctcggcccgttgggtaccaaacgggtcccttaacccgttaccgaacggtaccgttatcctaacgttggaccggg

SEQ ID NO: 132844 - DNA, 580 bp, Homo sapiens
  misc_feature: GYAE6OF01C2TW4.9.34.D01.1.454.CMB.1.raw
  modified_base (140)..(140): a, c, t, g, unknown or other
  misc_feature (140)..(140): n is a, c, g, or t
  modified_base (558)..(559): a, c, t, g, unknown or other
  misc_feature (558)..(559): n is a, c, g, or t
  modified_base (561)..(580): a, c, t, g, unknown or other
  misc_feature (561)..(580): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataacctgagaggcgaggacacggccatttattctgtgcgaaggaggcatagtagggaagtacgtattttcgatccctccgcagtcgactacttgattacgtcggggaccgggaccctggtccgccgtcctcctcacgccctccaccgaacgggcccagtccggttccttcccccgtcggcccacccctcctaccctaacgacgcacccgtcggtcggggaccaccgacggccggtcccggtcgggtcctcggcccgttacggtacgaaacgggtaccttaaccgtttaccgaacgtacgttaccaccgtacgtcggaacgggtcccgggtacgtcggggaccgaacgggccgaacgtaaacgcgganngnnnnnnnnnnnnnnnnnnnn

SEQ ID NO: 132845 - DNA, 252 bp, Homo sapiens
  misc_feature: GYAE6OF01BPS5K.9.34.D01.1.454.CMB.1.raw
  modified_base (214)..(214): a, c, t, g, unknown or other
  misc_feature (214)..(214): n is a, c, g, or t
  modified_base (219)..(252): a, c, t, g, unknown or other
  misc_feature (219)..(252): n is a, c, g, or t
tcagtgatacgtctcacgaccggtgctcgatttagatcgtctgtggttggggttgggctgactattactgccagtcgtatgacagtcggcctaagtaacatcgtcttcggaactgggaccaaggtcaccgtctgggtcagcccaaggcccaaccccatgtcacttctgttccccaccctcctcagacctatcactgagccgggctggcaaggcncatgnnnnnnnnnnnnnnnnnnnnnnnnnnnnnnnnnn

SEQ ID NO: 132846 - DNA, 552 bp, Homo sapiens
  misc_feature: GYAE6OF01ALTWZ.9.34.D01.1.454.CMB.1.raw
  modified_base (141)..(141): a, c, t, g, unknown or other
  misc_feature (141)..(141): n is a, c, g, or t
  modified_base (237)..(237): a, c, t, g, unknown or other
  misc_feature (237)..(237): n is a, c, g, or t
  modified_base (534)..(552): a, c, t, g, unknown or other
  misc_feature (534)..(552): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtggaggggccncttcatcatctccagagacaattcccagaacatactgtctctgcaactcaatacctgagaggcgaggacacggctattttattctgtgacgaaggngcagttagagggaagtacgtattttcgacttcccgtcgcacgtcgactacgtttgacgttacggtcgggggacccgggtacctgggtccgccgtcctccgtcaccgcccgtacccaaccgacgggtccctacgttccggtcccttccccgcggcccaccccgttcccacgaacgcgtacccgtaccgtcggtcgggaccacgcggccggccgtggcctcgccgttcggacgaacggtcctaccgttccgagtacgtctccgacgtggacggtcgggcgtaggacgacggcacgatgnnnnnnnnnnnnnnnnnnn

SEQ ID NO: 132847 - DNA, 858 bp, Homo sapiens
  misc_feature: GYAE6OF01BRLRM.9.34.D01.1.454.CMB.1.raw
  modified_base (732)..(732): a, c, t, g, unknown or other
  misc_feature (732)..(732): n is a, c, g, or t
  modified_base (740)..(740): a, c, t, g, unknown or other
  misc_feature (740)..(740): n is a, c, g, or t
  modified_base (767)..(767): a, c, t, g, unknown or other
  misc_feature (767)..(767): n is a, c, g, or t
  modified_base (781)..(781): a, c, t, g, unknown or other
  misc_feature (781)..(781): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactcctcctcgctcactgcacgacgggtcctcgggccctagttcttcgttctcggacgccgacgcccggtccctgacggttcggtccggtccggggaccccgaggggcagggtacgggtaccaccgtacttccgtcgtcgacgtacgtagggtaacgtcgtaccctaaccgaacggtacggtccggggtacttaacggtttagtacggtacgttaccggtaacccgtaaccggttaccggtaaaacccctaaaaccgttaaccggttacccggaaacggaaacccgtaaaccccggtaacccccgttaaaaggtaccttaacgtttaaccgtttaaacgttttaacggaaacccgtaaaacgtaaaccggtaacgggttaaccggaaacccgggtccccgggttaacccccgggttaccggggtaacccgggggtttaccccctaaccggggttaaccccggtttaccgtttacccccggtacccggtaccgttaacccggttaaccggtccggtacgaaccctaacgtaccgttaccgacccgttccctacccggtacgacctacgtacccggtcgggtcggaccgtacgagggtacgnggtaacgnggtagaccgtctacggtacttacgtcncgtaccttgacgtnacgtacgtgtaacggacttaacgtcgtccgtacggttacgaacggtaccggtagacccggtagcccggtcgtaccgg

SEQ ID NO: 132848 - DNA, 661 bp, Homo sapiens
  misc_feature: GYAE6OF01D2T5F.9.34.D01.1.454.CMB.1.raw
  modified_base (252)..(252): a, c, t, g, unknown or other
  misc_feature (252)..(252): n is a, c, g, or t
  modified_base (316)..(316): a, c, t, g, unknown or other
  misc_feature (316)..(316): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagcccgccctcagtgtcgtcggggccccagggcaggagggtcaccatctcgtgcacgtggaagtagctaccaacagtcggggctacgttangtatagtacacgtacggtaaccaactaacttccaaggaacacgaccccaaagtcatctatttangaacaacatgaacgccgcctacgacgggttccctggaccgtacttccgtccggactaccgaacgtcgtaggacacgtatccgtaccgccctccgtacggaccacgtccgtacgtcgggcctaccggaggtccgtaggacggtagtcggacggtcttacgtaacttacgttacgtcggaccttagttacgtagtacggacgtacgggttacgtaaccttaaacgttaaccgtaccgttacggttaccggtaacggtacggtaaccggtaacgtacggtacccgtaccggttcgggccgaaccgtacccgaacccgaacccgaaccccgtacctccggtctaacccg

SEQ ID NO: 132849 - DNA, 768 bp, Homo sapiens
  misc_feature: GYAE6OF01CFDVQ.9.34.D01.1.454.CMB.1.raw
  modified_base (178)..(178): a, c, t, g, unknown or other
  misc_feature (178)..(178): n is a, c, g, or t
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (642)..(642): a, c, t, g, unknown or other
  misc_feature (642)..(642): n is a, c, g, or t
  modified_base (694)..(694): a, c, t, g, unknown or other
  misc_feature (694)..(694): n is a, c, g, or t
tcagtgatacgtctcacgaccggtgctcgatttagatcgtctgtgttgggtctgggggaggcttggtccagcctggggatccctgcgactctcctgtgtgcctctggattctactttgagacctatgccttgaccgtgggtccgccaggcctccgagggggaggactgggagtgggcncgaggtcagtcggctgggtcggtcgtacagtcgaacacgtattccacgactaaaccttccggtaggacggggtccctnttacaattcattccnccgaaagacgtaactaaccttacccaagtaacctaatccgtgttaccttcgtaactactaaacctactaaaaccttaaccggtaggaacggaacggggtaccgaacggaaccgtaaccggtaccttttaatttttagttccgtaaggtccggaacggtaacgggaacgtacgtaagttaggtacgggtaaacgttacgtttacgttaccggtacctaccccgtacgcgtaacgtaccgactttacgttaggacgtacgggtccggggaccggttaccgtcggtaccgtccgttcctaccgtacgaccgtcccgtaaccaccgaacggtccctaacgtcccgtacccgtccccgttgaccctcccgtaaccncgtaaccgaccgtccgacgtccggtacggacaccggtcggcccggtacccgngggtactaccggtccgttaaggtccgtaaaccgtccgttaactaccggtaagttacccgactcgtaggtacggg

SEQ ID NO: 132850 - DNA, 577 bp, Homo sapiens
  misc_feature: GYAE6OF01AHGI6.9.34.D01.1.454.CMB.1.raw
  modified_base (556)..(556): a, c, t, g, unknown or other
  misc_feature (556)..(556): n is a, c, g, or t
  modified_base (558)..(577): a, c, t, g, unknown or other
  misc_feature (558)..(577): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctattttatttctgtgcgaaggaggcatagtgggaagtacgtattttcgactccctccgcagtcgactactttgattacgtcgggggcccgggacccgtcggtccgccgtctcctcgacgccctccaccgaacgggcccacgtccggttcccttccccccgtcgggtccctacccccttccctacccaacggacgccctacccgtcggtcgggggccacgacggcccgggcccgtgggcctcggtccgtcgggtacgaaacgggtaccttaccgttccgacgtaccgttacgtccacgtaggacggccgggtcgtcgggacgaacgggccgactaagtagncnnnnnnnnnnnnnnnnnnnn

SEQ ID NO: 132851 - DNA, 696 bp, Homo sapiens
  misc_feature: GYAE6OF01AZVDX.9.34.D01.1.454.CMB.1.raw
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
tcagtgatacgtctcacgaccggtgctcgatttagatcgtctgtgttggggtttgggggaggcttggtccagcctggggagtccctgcgactctcctgtgtggcctctggattctacctttgagtacctatgccttgacctgggtccgccaggctccgaggggaggactggagtgggtcgcaggcagtcgctggtggcggtcatgacactattctacgctaaaccgtccgtgacggggcctcttcatcatctcagagacaattcccaagaacatacgtgtctctgactactcaatacctgagaggcgaggacgaccggtcctaattttcgttcnggtcgacggaaagggngtctaagttagtaggggtaaacttcgttaacgttttccgaacttccccgtccgtacaggttccgaacttacgttttacggaactttaccgggcggggggaccccgggtaacccgtcgggttcccgcccggttcctcccgtacgaccgtccctaccgaaccgacgggccctacggttccgtcccgttccccgcgtcccctaccctccgtaccacgacgtccctaccgtcggtcggggcctaccggccggccggtcccggttgggacccgttcggcccgtttacgggacgtaaccgggtaccttaccgttacccgaggttaccgtaagtccgaacggttgggaccggg

SEQ ID NO: 132852 - DNA, 796 bp, Homo sapiens
  misc_feature: GYAE6OF01C9SZI.9.34.D01.1.454.CMB.1.raw
  modified_base (236)..(236): a, c, t, g, unknown or other
  misc_feature (236)..(236): n is a, c, g, or t
  modified_base (346)..(346): a, c, t, g, unknown or other
  misc_feature (346)..(346): n is a, c, g, or t
tcagtgatacgtctcacgaccggtgctcgatttagatcgtctgtgttggggtttgggggaggcttggtccagcctggggagtccctgcgactctcctgtgtggcctctggattcacctttgagacctatgccttgaccgtgggtccgccaggctccgaggggagggactggaggtgggtcgcaggcatcgctggtggcggtcatgacacattcacgcaaactccgtgacggggccncttcatcatctaccagagacaacttccaagaacaatactgtctctagacaactacaaataacctgagaggacgaaggacacggcctatttactttcgtgtgacggaaggnggacagtagtagggtaagtacgtattttacgacttcccgtacgtacgacgtacgaccttactttacggtaatttaaccggggtccggggggtaccccggggtaaaccccggttcgggttcccggtaccccgtttccgtacccgttacgaccggtaccccgttaacccgaacccggaaaccggggtcccccttaaacggttccccggtttccccgtttaccccccggtacgggtaccccccttacccccttcccgtaaacccgaaacggtaacccgtacccgtacccgttccgggtcgggggtacccaccggtaccgggccccgggtaccccgtcggggtcctaccggtaccggtttacgggtaacccgtaaacgggtaaccctttaacccgttaacccgtaaccgggttaaaccgttaccgtaacccggtccggttcgggaacccggggg

SEQ ID NO: 132853 - DNA, 604 bp, Homo sapiens
  misc_feature: GYAE6OF01CLZAT.9.34.D01.1.454.CMB.1.raw
  modified_base (159)..(159): a, c, t, g, unknown or other
  misc_feature (159)..(159): n is a, c, g, or t
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (573)..(573): a, c, t, g, unknown or other
  misc_feature (573)..(573): n is a, c, g, or t
  modified_base (575)..(604): a, c, t, g, unknown or other
  misc_feature (575)..(604): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacacgcccccaaagtcatcatttangacaacatgaacgcgccctcgacggggtccctgaccgattccnccggctccaagtctcggcacatcacgtccctcctggccatcacgtgggcctccgaggctaggaaggagtggaggtctacgtaacttactttacncggcctaaggttacgtagtgaacaggtcggaaccttaaacgtaactagttccgtacgttaacggaaccgtcgggaacccgtaaggtcccgtaaccggttccggtacggtaccgaccggaccccgaaacggtaccccctaaacccctcgttccgttaccaccctttccgttcccgttaccccctaccccgttccctacggaaccgttaccggtactaacccgtcgacgggtaccggcccgggtacgtacgggaaccggtaacggcgaactagtacggncnnnnnnnnnnnnnnnnnnnnnnnnnnnnnn

SEQ ID NO: 132854 - DNA, 788 bp, Homo sapiens
  misc_feature: GYAE6OF01CZ19T.9.34.D01.1.454.CMB.1.raw
  modified_base (232)..(232): a, c, t, g, unknown or other
  misc_feature (232)..(232): n is a, c, g, or t
  modified_base (267)..(267): a, c, t, g, unknown or other
  misc_feature (267)..(267): n is a, c, g, or t
tcagtgatacgtctcacgaccggtgctcgatttagatcgtctgtgttgggtttgggggaggcttggtccagcctggggagtccctgcgactctcctgtgtggcctctggattcaccttttgagacctatgccttgacctgggtccgccaggctccaggggagggactggagtgggtcgcaggcatcgctggtggcggtcatgacacattctacgcaaactcgtgaggggccncttcatcatctccagagacaactccagaacatacngtctctgcaactacaatacctgagaggacgaggaccacggaccctaattttactttcgtgttacgacggtaaagggaggacctaagtaagtacggggaaagttaacgtagtttttaccgaacttcccctacgtaccgacggttaccgaaccttactttacgtacgtttacggtaccgggggtcccgggggtaaacccgttcgggtaccgtaccggtccccttacccgtaccgtaccggtaccccttacccgaacccggtaaccggggtccccctaacggtttccccgggttacccctttaccccccccggttgggtaccccctaaccccccgttaccccgtaacccgtaaaccggaccgtacccgtaccccgttacgggttccggggaacccgtaccggaacccggtcccgggtaccccgtcggggtcctacccggtccggttaccgggtaaccgtaaaccgggtaccttaacccgttaccgtaacggtaacccttagttacccaacgttggaacccgggg

SEQ ID NO: 132855 - DNA, 884 bp, Homo sapiens
  misc_feature: GYAE6OF01B7QPP.9.34.D01.1.454.CMB.1.raw
  modified_base (151)..(151): a, c, t, g, unknown or other
  misc_feature (151)..(151): n is a, c, g, or t
tcagtgatacgtctcacgaccggtgctcgatttagatcgtctgtggttgggtctgggggaggcttgggttccagcctggggagttccctgcgactctcctgtgtggcctctggattcactttgaggacctatgccttgacctggggtcccnccaggctccgagggggaggactgggagtgggtcgcgaggccatcgacgtgggtggcggtcagtgacactattcgtacgaccaaacgtccggtaggggacggggtcccgtagtttcgaatccaaactttcctaccgaagaacgtaacctaaacttaccccgaaaggaaacctaattaacttacgtccttaccgacgaaccctaaacttaccgaaaacgttaacccggtgaacggacggaccgaacggaccgtaaccggtacttaattttaacttcgtaggtacggaacggtaaggacgactaaagttacggtaagggtaaacgttaccgttaagttttaccggaaccgtttccccgaaccggtacgtaacgggttacctaactttacgttttaaggaacgttttaccgggggccggggggaaccccggtaaccttgggtcccgttacccggtcttacccgtacgaaccgtccccttaaccgaacccgggtaaccgggtcctacgggtttccccgttccccttacccccggtgggtaaccccctacccccgttacccggtaaccgtaacgggacccgttaccctaccggttccggggacgggaaccctacggacccgggtccccgggtacccgttgggacccttccgggtaccccgttacgggaaaccgtaaacccgggttacccttttacccggaccgaaaccgggtacctttctaacccggccgggttacggg

SEQ ID NO: 132856 - DNA, 831 bp, Homo sapiens
  misc_feature: GYAE6OF01BY3NJ.9.34.D01.1.454.CMB.1.raw
tcagtgatacgtctcacgaccggtgctcgatttagatcgtctgtgttgggtttgggtctgagagaggagcccagccctgggattgtcaggtgttttcatttggtgatcaggactggacagagagaactcaccatggagtttgggctgacctggtctttttctcgtggcttagttttaaaaggtgtccagtgtgagttcaactgttggagtcgtggggagcttggtccagccgtggggactccgtgcgactctcctgtgtcgcctctggtacttctacctttgacgacctatcgtccttcgaccgtcgggtccgccgacggccgtccggaagggggacgggtaccgtgggacgggtcgggtccggacggacgggtacacgttccggcggttcgggttcgggtccggttactaagtacggaccaaccgttaacgttaccgtaaaccggtacctaaaacccggttcccgggttacgggaaccggggggtccccctacgttttaccgaacgttcctaacgttaccctaacccgtaacggaaacggtaaaccctaaaccgtttaccccgaaacgtaaacccttaacgtttacccgttacgttcctaccgtacgtaaccttaacctaactaaaccgttaaccgtaggaaaccgggtaacgggaaccggaacgggaaacccgtaccgggtacctttaacgttttaccgtttaccgttagggtacggtaacggtaaacgggtacggaaccgttaaggttaacgggttaaggggttaaaccgttaaacggtttacccgttttaacccggtaaccgttcccccgttaaccccggtaaccgg

SEQ ID NO: 132857 - DNA, 722 bp, Homo sapiens
  misc_feature: GYAE6OF01BXLM3.9.34.D01.1.454.CMB.1.raw
  modified_base (146)..(146): a, c, t, g, unknown or other
  misc_feature (146)..(146): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtcccnccaggcctccgaggggaggactggagtgggtcgcaggcatcgctggtggcggtcatgacacattctaccgacaaacgtccgtggacggggccgcttcatcatctaccagagacacttcccaagaacatactgtctctgacaactcaaactaaccgtgaacggaggacgaggaccacggccttatttactttcagtcgacgaaggagactagtaggtaggtaacgttacgtatttaccgactcccccgtcgactacggtaccgaacttacgtttagacgtttaccgggtccgggggtaccccggggtaacccgtcgggtcccgtcccgttacctcccctacgtaccgtccctacccgaaccgtaaccgggccctacggttcccgtccccgttaccccgcggtacccctacccgtacccgtaaccgacggacctacccgtaccggttaccggtagggacccacggccgggtaccccggtcccggtaccgggtccgtcccggtaccggttacggtaacccggaacggttacccttaacccggttaccaaccggttaaccgtcctacgaccggtacgggg

SEQ ID NO: 132858 - DNA, 772 bp, Homo sapiens
  misc_feature: GYAE6OF01AVNHS.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtcctcctctcctctcactctcctcgctcactgcacgacgggtccgtcggccctagttctgttcgtgaccgcaccgcccgtcccgtcgacggtcgtccggtccggggccccgagggccgaggtacggtaccaaccgcgttccgtcggtcgactacggtagggtaacgtcgacccttaccgaacgtcggtaccgggtacttacgttagtgtaacttacggtacctaacggtaccgtaaccctaaacgtacgtaccgaacggaaccaccgaacccgtaatctactactaattacgtacaacgaacgtacgtacggaccgtcccggtaccgtaccggtaaccgggtccgacgtacccgttcgttcccgtacccggtacctacgtaacgtccgtacggaccctacgtacctaccgtccgtccccttaccggtaccgacctacgttcccgcgtacccgggccctcggaacgtacggaggtaacgtaggtacggtacggtccttaagttaaccttacgttccgtacgtacgttaacggtcgtaacgtacgaaaccggttggtaaaccgttaccgtaaagttccggttcgttaaccggttaccggtaacggttaaaccggggtacccgtaaaccggtaccgttcccggttcccgggtaacggg

SEQ ID NO: 132859 - DNA, 681 bp, Homo sapiens
  misc_feature: GYAE6OF01B2PLN.9.34.D01.1.454.CMB.1.raw
  modified_base (337)..(337): a, c, t, g, unknown or other
  misc_feature (337)..(337): n is a, c, g, or t
  modified_base (669)..(669): a, c, t, g, unknown or other
  misc_feature (669)..(669): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggaggactggagtgggtcgcaggcatcgctggtggcggtcatgacacattcctacgcaaactccgtgacggggccgcttcactcatctccagacgactacttccaagaacatactgtctctgcaactcaatacctgagaggcgaggacacggtctattttattcgtgtagcggaaaggnggctagtagtggggaagtacgtattttcgactcccgtccgacacggttccgacttacgtttgaacgtttacgggcgggggacccggggtaacccgtgggtcccgtccgttccctccgtcgaccgtccctaccgaacccgacgggcccctacgtcccggttcccttcccccgtcggtaccctacccccgttccaccgaacgaccgccgtaaccctcgggttcggggacctaccggaccggtcccggcccggtacgggtcccttacgggtcccgttagggaccgtaaccggtaccgttacccgttaccaaccggttacttaccgacctaacggnggtaacccgggg

SEQ ID NO: 132860 - DNA, 711 bp, Homo sapiens
  misc_feature: GYAE6OF01BAB2M.9.34.D01.1.454.CMB.1.raw
  modified_base (140)..(140): a, c, t, g, unknown or other
  misc_feature (140)..(140): n is a, c, g, or t
  modified_base (674)..(674): a, c, t, g, unknown or other
  misc_feature (674)..(674): n is a, c, g, or t
  modified_base (687)..(687): a, c, t, g, unknown or other
  misc_feature (687)..(687): n is a, c, g, or t
  modified_base (692)..(693): a, c, t, g, unknown or other
  misc_feature (692)..(693): n is a, c, g, or t
  modified_base (696)..(697): a, c, t, g, unknown or other
  misc_feature (696)..(697): n is a, c, g, or t
  modified_base (703)..(703): a, c, t, g, unknown or other
  misc_feature (703)..(703): n is a, c, g, or t
  modified_base (705)..(707): a, c, t, g, unknown or other
  misc_feature (705)..(707): n is a, c, g, or t
  modified_base (709)..(709): a, c, t, g, unknown or other
  misc_feature (709)..(709): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataacctgagaggcgaggacacggctattttattctgtgcgaaggaggcatagtagggaagtacgtagttttcgactccctccgctagtacgactacgtttgagttaccggtcgggggtcccgggtacccgtcgggtccgccgttctccgtcacgtccctaccaaccgaacggcccctacgttccggttaccccttcccccgtacggtccccaccccgttccctacccgtaaacggaccgtacccgtaacccgttccgggttaccggggggaccctaacccgggtaacccgggccccgggttccccggtcgggggtacccgttccgggtaccccggttacgggttaacccggaaacgggttacccgtttaacccgttaccccggtaacgggtaacccgttaccgttaacccgtacggttccggaacggggtcccgggtaccggtacggtaccggaacgggtccgacgtacgttacggcgtacgnacgctagcctagngtcgnngcnngcgtcncnnngngc

SEQ ID NO: 132861 - DNA, 829 bp, Homo sapiens
  misc_feature: GYAE6OF01BMPY7.9.34.D01.1.454.CMB.1.raw
  modified_base (253)..(253): a, c, t, g, unknown or other
  misc_feature (253)..(253): n is a, c, g, or t
tcagtgatacgtctcacgaccggtgctcgatttagatcgtctgtgttgggtttgggggaggcttggtccagcctggggagtccctgcgactctcctgtgtggcctctggattcaccttttgagacctatgccttgacctgggtccgccaggctccgaggggagggactggagtgggtcgctggcatcgctggtggcggtcatgacacattctacgcaaactccgtggaggggccgcttcatcatctaccaganacaacttcccaagaacatactgtctctgacaactcaatacctgagaggcgagacgacgctatttattctgtgacgaaggagcatagagggaacgtacgtacttttcgacctccctccgactacgtaccgactttacgtttagtaacgtttaccgggtacggggggtaccccgggggtaacccgttcggggtcccgtcccggttacccgttccctacctaccggtccccttaccccgaaaccccggtaaccggggtacccccttacggtttaccccgggtttccccccgtttcccccccggtcgggtacccccttaaccccccgttcccgtaacccccggaaacggtcccggtaccccgtaaccccggttccggggtaccggggggtaccccaaccgggtacccggggtcccccgggtacccccgggttccgggggtccccttaccgggttccccgggtttaaccggggttaaccccggtaaaaccggggttaccccgtttaaacccccgttttacccgggaaaccggttaaacccggtttaccttaccggtaaccgggttccggggaaccgggggg

SEQ ID NO: 132862 - DNA, 838 bp, Homo sapiens
  misc_feature: GYAE6OF01DVSKH.9.34.D01.1.454.CMB.1.raw
  modified_base (172)..(172): a, c, t, g, unknown or other
  misc_feature (172)..(172): n is a, c, g, or t
  modified_base (341)..(341): a, c, t, g, unknown or other
  misc_feature (341)..(341): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacgagggtcctcgggcccagtctgttctgacgcaaccgcctnagtgtcgtcgggcccaggcaggcggtcactatctcgtgctacgtaggaagtcgcctaccaaacgtggtccggggactaacgttagtagtacttcgtaacgtaacgtacggtaaccaaactaaccttacgaacggaaccaccgaacccctaaagtctactacgtatttanacgaactaactagtacggaacggccgtacccgttacggtaccgggtaccctacggtaaccgtacgtttcccggaccgtaccgtaaccggtaacggtccgtacggtacctaaacgtctaccgtacccgttccccgtacccggtacgggaccctacgttaccggtacgggtcccgggtaacctcccgggtaaggtccgtaacgggtaacggtagtacgggttacggtaccttaacggttaacctttacgttaaccgcggttaacccgtttacggttaccgttaggtaaccgtaacgggtacggtttaacccgggtaaacttaaccggttacgttaccgttccgggtttaacccgttaacggggtaaaccggtaaccggtaaacccgggtacggtttaccccgtacggggttaccccggtaacggggttacccaacccgggttaacccgaaaccccgttaccccggaaaccctttcggtacccgttacccttaaccccgg

SEQ ID NO: 132863 - DNA, 620 bp, Homo sapiens
  misc_feature: GYAE6OF01B84E6.9.34.D01.1.454.CMB.1.raw
  modified_base (243)..(243): a, c, t, g, unknown or other
  misc_feature (243)..(243): n is a, c, g, or t
  modified_base (378)..(378): a, c, t, g, unknown or other
  misc_feature (378)..(378): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (596)..(596): a, c, t, g, unknown or other
  misc_feature (596)..(596): n is a, c, g, or t
  modified_base (601)..(604): a, c, t, g, unknown or other
  misc_feature (601)..(604): n is a, c, g, or t
  modified_base (606)..(606): a, c, t, g, unknown or other
  misc_feature (606)..(606): n is a, c, g, or t
  modified_base (609)..(609): a, c, t, g, unknown or other
  misc_feature (609)..(609): n is a, c, g, or t
  modified_base (611)..(613): a, c, t, g, unknown or other
  misc_feature (611)..(613): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatagngggaagtacgattttcgactccccgtccgcagtcgactacgtttgattacgtcggggccgggaaccctggtccgccgtctccgtcacgcccttccgaccgaacgggcccctagttcccggttccctttcccccgnggccctaccccttccctaccgaaacggcgccctaccgtcggtacgggggccaaccgtacggcccgggtacccgtggggtcctcggtccgttacgggtaccaaacgggtacccttaccgtacccgaacgtaccgttactccgtacgtggaacgggccgggtaccgttacgggacgtaacgggccggtactaaacggtacggcngngtacgngngngcgngtcgnnnngncgngnnngngngtg

SEQ ID NO: 132864 - DNA, 596 bp, Homo sapiens
  misc_feature: GYAE6OF01CB6B3.9.34.D01.1.454.CMB.1.raw
  modified_base (233)..(233): a, c, t, g, unknown or other
  misc_feature (233)..(233): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggaggactggagtgggtcgcaggcatcgctggtggcggtcatgacacattctacgcaaactccgtgaggggccncttcatcatctccagagacaacttcccagaacatactgtctctgcaactcaactaacctgagaggcgagacacggcctatttattctgtgacgaaggaggcaagtagtagggaagttacgtattttcgacttcccgtcgcgacgtcgactactttgacgttacggtcggggacccgggtaaccgtcggtccgtccgtctccgtcacgcctaccgaccgacggcctacgtccgtccttccccgtgtcccaccctcaccgaacgacgccgtaccgtcggtcgggactacgcggtccgccgtcggccgtcgtcccgtaggaccgaacgtacctaccgtaccgacgtacgtatccgtagtggacggg

SEQ ID NO: 132865 - DNA, 862 bp, Homo sapiens
  misc_feature: GYAE6OF01CXW4R.9.34.D01.1.454.CMB.1.raw
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggcttttttctcgtggtcttagttttaaaaggtgttccagtgtgaggttcaacttgttggagtacgtggggggagtcgttggtccagccgtggggactcccgtgcgactcgtcctgtgtgcctcgtggacttctacgtttgacgtacctatcgtccttcgaccgtcggtcccgccgacggtaccgttccggaagggggtacggtacgtcgggtaaggtcggggttaccgacgaaggtcccgaagtccggtacgttcggggtacggccggttacgaaggttaccgaacgaccttaacgttttaccaaaccgtaccgtaaaaacccgttccgggttagggaaacccgggggtcccttaccgtttacgacttacctaacgttacccttacccgaaagtaaacgtaaacccttaacgttaaccccgaaaagaaaccttaacttaccgttacgtttacccgtacttccggtaaacccttaaccgtaaaccttaaaacgttaaccccgttaaggaaacggtacgggtaaccgggaaccggtaacccgtaacgggtaccccttaagttttaccggtttaccgttaggttaacgggaccggtaaaaggggtaccggtaaaccgttaaggttaacgggtttaaacgggtaaaccggtttaaacgggtttaaacccgttttaccgttaaacccggttcccccggttaccgtaaccccggg

SEQ ID NO: 132866 - DNA, 974 bp, Homo sapiens
  misc_feature: GYAE6OF01BF2SG.9.34.D01.1.454.CMB.1.raw
  modified_base (362)..(362): a, c, t, g, unknown or other
  misc_feature (362)..(362): n is a, c, g, or t
  modified_base (944)..(944): a, c, t, g, unknown or other
  misc_feature (944)..(944): n is a, c, g, or t
tcagtgatacgtctcacgaccggtgctcgatttagatcgtctgtgttggggtttgggggaggcttggtccagcctgggggagtccctgcgactctcctgtgtggcctctggattcacctttgagacctatgccttgaccgtgggtccgccaggctccgagggggagggactgggaggtgggtcgcaggcagtcgcgtgggtggcggtcagtcgacactattctacgacaaaccgtccggtagggacgggggcccgtctttacaacttcacttcctaccgaaggaacgtaacctaaacctttccccgaaagaaacctacttaccgttgttcctcgtacgacctaaacctacaaacttaaccgnggaacggacgggacgaacggaccgaaccggtacctttaagtttttactttaccgttgggtaacggaacgggaaaaggggacggtacgttaaggtaagggtaacggggttaaacgttaacggtttaaccgttttacgaacccgttccccgttaccggaccgtaaacggttacccgtaaccgtttaacgttttacggtaaccggtttaccggggtccggggggggtaaccccgggtaacccggtttcggggtaccccggttccccgtttacccggtttacccgacccgtacccgggtaccccttaaccccgggaaacccgggtacccggggtacccccttaagggtttccccccgggtttaccccttccccccggacggttacccccgaacccccctttacccgtaacccgaaaccggtccccggttacccgtaaccccggttccggggaccggggaaccctaccgggtacccgggccccggttacccgggtccgggtccctaccgggttaccccggtacgggttaacccggtaaaacggtcccctttaaacccgtaccccggtaaacggttacccgtttaacncccgggttaacggttaccggggaaccgggg

SEQ ID NO: 132867 - DNA, 477 bp, Homo sapiens
  misc_feature: GYAE6OF01CBY26.9.34.D01.1.454.CMB.1.raw
  modified_base (283)..(283): a, c, t, g, unknown or other
  misc_feature (283)..(283): n is a, c, g, or t
  modified_base (381)..(381): a, c, t, g, unknown or other
  misc_feature (381)..(381): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (464)..(477): a, c, t, g, unknown or other
  misc_feature (464)..(477): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacacgcccccaaagtcatcatttatgacaacatgaagcggccctcgaggggtccctgaccgattcctccggctccaagtctggccacatcacgccctccctggccatccactcgggcctccgaggctgaggatgaggctgactattacncgccagtcgtatgacaggtgacctaagtacatcgtcgttacgaacgtgggaaccaaggtcaccgtccgtgggtccacgaccgaaggccccaaaccccntcgtcctactctcccgttccccgcccttcctcgacgacgttacnctacgngtacggccgggatcgggacacggcacagtagcnnnnnnnnnnnnnn

SEQ ID NO: 132868 - DNA, 797 bp, Homo sapiens
  misc_feature: GYAE6OF01DQI2X.9.34.D01.1.454.CMB.1.raw
tcagtgatacgtctcacgaccggtgctcgatttagatcgtctgtgttgggtttgggggaggcttggtccagccgtggggagtccctgcgactctcctgtgtggcctctggattctacctttgagacctatgccttgaccgtgggtccgccaggcctacggagggggagggacgtgggaggtgggtcgcgaggcatcgcgtgggtcggcggtcagtgactactattactacgacaaaccgtcggtagggacggggtcctcttacactactacgtcctacgaagaacgaactaaaccttacccgaaagaaacctacgttacgttcgttaccttctacgacctaaacctaacgtaaactaaccgtaggaacggacgggacggaacgggaccgtaaccggttacctttaagttttacgtttcgtaggttacggaaacggtagggacgactaaggtaagggtaacggggtaacgttaacggttacgttttacggacccttcccgtaccgacgtacgttacctacgtttaggtttacgtacggtttaccgggtcggggggaacccgggttaaccgtccggtcccggttcccgtacgtttcccacgacccgtccccgtaccggaaccggacccggaccgttacgtttcccggtacccccttcccggccgtaccctaccccgtaaccgaaccggtaacgcccgttaacccaccggtaccgtacgaccgaaccgcggtaccggccgtccgaggtccgtcgacgtacgacgtacgtacctttacggcaagtcctagtacctggacgg

SEQ ID NO: 132869 - DNA, 600 bp, Homo sapiens
  misc_feature: GYAE6OF01A5FSI.9.34.D01.1.454.CMB.1.raw
  modified_base (575)..(575): a, c, t, g, unknown or other
  misc_feature (575)..(575): n is a, c, g, or t
  modified_base (578)..(578): a, c, t, g, unknown or other
  misc_feature (578)..(578): n is a, c, g, or t
  modified_base (581)..(585): a, c, t, g, unknown or other
  misc_feature (581)..(585): n is a, c, g, or t
  modified_base (587)..(600): a, c, t, g, unknown or other
  misc_feature (587)..(600): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctattttatttctgtgcgaagggaggcatatgggaagtacgtattttcgactccctccgcagtcgactactttgattacgtgggggcccgggaaccctggtccgccgtctcctcacgccctccaccgaacgggcccacgtccggtcccttccccccgtggcccaccccgtccctacccgaacgacgtcccaacccgttccggtcggggggaccaccgacgggcccgggtcccgtcggggtcctccggcccgttgggtacccgaaacggtaccgttaccgtttacccgaggtaccgttacgtccgtaaccgttgaacgggccgggtcgtcgggtaccgaacgggccgacgtaagtacggcncancgnnnnngnnnnnnnnnnnnnn

SEQ ID NO: 132870 - DNA, 660 bp, Homo sapiens
  misc_feature: GYAE6OF01BZQKT.9.34.D01.1.454.CMB.1.raw
  modified_base (263)..(263): a, c, t, g, unknown or other
  misc_feature (263)..(263): n is a, c, g, or t
  modified_base (602)..(602): a, c, t, g, unknown or other
  misc_feature (602)..(602): n is a, c, g, or t
  modified_base (619)..(619): a, c, t, g, unknown or other
  misc_feature (619)..(619): n is a, c, g, or t
  modified_base (654)..(654): a, c, t, g, unknown or other
  misc_feature (654)..(654): n is a, c, g, or t
  modified_base (656)..(656): a, c, t, g, unknown or other
  misc_feature (656)..(656): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgagggccgcttcatcatctccagagacaattcccagaacatactgtctctgcaactcaataacctgagaggcgaggacacggccattttattctgtgcgaaggaggcagtagtgggaatcgagtttcgtacncccttccgcgagtacgtacactttagtagttacgtcggggaccggggtaacccgtcgtcggtccgtccttcctccgacgccctccaaccgaacgggcccgtacctaccggttcccgttcccccgtccggaccacccctacccgtccaacggacgccacccgtcggtacggggccgaccacggcccgggtcccgtacgggtcggtccgttaccgtcggttaaccggaaacggaccctttaccctttaccgaacgggtaacgttcgttacctacggtacggacggggccgggtccgggttacggaaccgaacggggtacccggtcctaaaagtttaccggncgacgcgagtccgtacncggttgtcgagacgcgacgcgcgtacgacgatcgngngtcg

SEQ ID NO: 132871 - DNA, 422 bp, Homo sapiens
  misc_feature: GYAE6OF01CM3ET.9.34.D01.1.454.CMB.1.raw
  modified_base (288)..(288): a, c, t, g, unknown or other
  misc_feature (288)..(288): n is a, c, g, or t
  modified_base (413)..(413): a, c, t, g, unknown or other
  misc_feature (413)..(413): n is a, c, g, or t
  modified_base (418)..(422): a, c, t, g, unknown or other
  misc_feature (418)..(422): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagccccaaagtcatcatttatgacaacatgaagcggccctcaggggtccctgaccgattcctccggctccaagtctggcacatcagcctcctggccatcactgggctccaggctgagatcgagctgactatactgcctagtcgtatgacagngtacctaagtaacatcgtcttcggaatgggaccaaggtcacgtctgggtcagccaaggcccaaccactgctactctacgtcccacctcgtcacgtactatcactggagcggactggacaagggcnaatgnnnnn

SEQ ID NO: 132872 - DNA, 738 bp, Homo sapiens
  misc_feature: GYAE6OF01EVFKP.9.34.D01.1.454.CMB.1.raw
  modified_base (130)..(130): a, c, t, g, unknown or other
  misc_feature (130)..(130): n is a, c, g, or t
  modified_base (141)..(141): a, c, t, g, unknown or other
  misc_feature (141)..(141): n is a, c, g, or t
  modified_base (152)..(152): a, c, t, g, unknown or other
  misc_feature (152)..(152): n is a, c, g, or t
  modified_base (716)..(738): a, c, t, g, unknown or other
  misc_feature (716)..(738): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattcacgcaaactccgnggacggggccncttcatcatcnccagagacattcccaagaactatactgtcctctgacaaactcaaataccgtgagaggcgaaggacacggtcctattttattcgtgtggacgaagggaagtcaagtagagggaagtacttagtttacgacctcccgtccgacgtagtaccgtaacgtactttaggtaactttaccggggtacggggggaccccggggttaaaccccggttcgggttcccggtacccggttaccctttacccacgtaccgggtaccccttaacccgaacccggtaaaccggggtacccctaacggtttcccccggggtttcccccttttcccccccgggtaccggaaccccgttacccccctacccgttaaccggtaaaacggaccgtacccgtaaaccccggtttcgggtacgggggaccaaaccggaccgggtcccgggtcccggtcgggtacccgtaccggccgttaacggggtaccgtaaacgtaaccttacccgttaacgaacgtacggtaacttacgacgttagggacggtaccggggtctacggacgtaacggcccgtaacgtagtagnnnnnnnnnnnnnnnnnnnnnnn

SEQ ID NO: 132873 - DNA, 782 bp, Homo sapiens
  misc_feature: GYAE6OF01BXGRC.9.34.D01.1.454.CMB.1.raw
  modified_base (163)..(163): a, c, t, g, unknown or other
  misc_feature (163)..(163): n is a, c, g, or t
  modified_base (181)..(181): a, c, t, g, unknown or other
  misc_feature (181)..(181): n is a, c, g, or t
  modified_base (303)..(303): a, c, t, g, unknown or other
  misc_feature (303)..(303): n is a, c, g, or t
tcagtgatacgtctcacgaccggtgctcgatttagatcgtctgtggttgggtttggggacaagaggcagcactcaggacaatctccagcatggcctggtcctcctctcctcctcactctcctcgctcactgcacgacgggttccgcgggcccagtcttgttcncgacgcacgccgcctcgnggtcgtcggccggggcccgagggcacgggtacgggccaaccgtcgtccgtcggtacgacgtacggtaggtaaacggtcgaccttaaccgaaacgtacgggtcggggtacttacggtttaagngtaacgttacgtaacgtaccggtaacggtaaacctaaaccgttaaccgtaccggaaacggaacctaccgaaccctaagtctaactactaatttacgacaaactaaacgtgaacggaccggccgtacccgtacgggtaccggtccacgtaccgttcgtaccggttccgacgtaacacggttcgaccgaccaccgtaccgtcccgtccctaccggacgtacctacgtaccggtcggtccggtacttacgggacggtcgttacgggacgtaggtaaccggtcgacgtttaattacgtttacgtacccgccgttaacctaacgtacttaacgacgtaccgacgtaccgtacgtaacgaaggttacgacgtttacgggtacgggtaccggtacgggggaacgaaccggtaaccgtaggcccgttaccgggaccgttacggttacggaacccgaccgaccgggtaccgtcccgtcccggtacccg

SEQ ID NO: 132874 - DNA, 613 bp, Homo sapiens
  misc_feature: GYAE6OF01EK1N9.9.34.D01.1.454.CMB.1.raw
  modified_base (235)..(235): a, c, t, g, unknown or other
  misc_feature (235)..(235): n is a, c, g, or t
  modified_base (291)..(291): a, c, t, g, unknown or other
  misc_feature (291)..(291): n is a, c, g, or t
  modified_base (488)..(488): a, c, t, g, unknown or other
  misc_feature (488)..(488): n is a, c, g, or t
  modified_base (513)..(513): a, c, t, g, unknown or other
  misc_feature (513)..(513): n is a, c, g, or t
  modified_base (536)..(536): a, c, t, g, unknown or other
  misc_feature (536)..(536): n is a, c, g, or t
  modified_base (598)..(598): a, c, t, g, unknown or other
  misc_feature (598)..(598): n is a, c, g, or t
tcagtgatacgtctcacgaccggtgctcgattttagatcgtctgtgttgggtttgggggaggcttggtccagcctggggagtccctgcgactctcctgtgtggcctctggattcacctttgagacctatgccttgacctcgggtccgccaggctccgaggggaggactggagtggtcgcaggcatcgctggtggcggtcatgacactattctacgcaaactccgtgacggggccncttcatcatctcagagacattccagacatactgtctctgacaactacaacttaccnggagacggcgacggacgacggctattttacttcgtgtcgagaaggacgtacagtagtagggaaacgttctagtttccgactacccgtacgctacggtacactcgtttgaacgttaccggcgggggacccgggtaacctggtcccgtacgtccttcgcacgtccctaccgaccgaggccctcgtaccgtcctccccgngaccctaccgtcctacgaacggacnccgtaccgtccgagggaccacgnggtcccggccgtcggcctcgtcggtacgtacgtacggactttaccgaccgtagtacgttacncggtcgtggaccggg

SEQ ID NO: 132875 - DNA, 628 bp, Homo sapiens
  misc_feature: GYAE6OF01BQFC2.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgggacctatgccttgacctgggtccgccaggctccgaggggagggactggagtgggtcgcaggcatcgctggtggcggtcatgacacattctacgcaaactccgtgaggggccgcttcatcatcctccagagacaattcccagaacatactgtctctgcaactcaataacctgagaggcgaggacacggcctatttatttctgtgcgaaggagcatagtgggaagtacgtattttcgactccctccgctacgtcgactactttgacttacggtcgggggaccgggtaaccctggtccgccgtctcctcacgcctccacgacggcccagtccggtccttccccgtgccctaccctcctaccgaacgaccgccgtaccgtcggtcggggaccacggacggtcccggcccgttcgggccgtacggtcccggtacggtacccgaaacgggtcccttaacccgttacccggaacgtaacccggttactacctaaccggtcggcgggtcccgggg

SEQ ID NO: 132876 - DNA, 695 bp, Homo sapiens
  misc_feature: GYAE6OF01A1YJX.9.34.D01.1.454.CMB.1.raw
  modified_base (268)..(268): a, c, t, g, unknown or other
  misc_feature (268)..(268): n is a, c, g, or t
  modified_base (557)..(557): a, c, t, g, unknown or other
  misc_feature (557)..(557): n is a, c, g, or t
  modified_base (565)..(565): a, c, t, g, unknown or other
  misc_feature (565)..(565): n is a, c, g, or t
tcagtgatacgtctcacgaccggtgctcgatttagatcgtctgtgttgggtttggggtcaccatctcgtgcactggaagtagcctccaacatcggggcacgttatgatgtacactggtaccaacaacttccaaggaacacgacccccaaagtcatcatttatgacaacatgaacgcggccctgacggggtccctgaccgattcctccggctaccaagtctggcacatcagtccctccgtgccatcacgtcggctacgaggctagaggntgaagtctacgactatacgtcgcctagtcgtatcggacaggtcggacctaaagtacctagtcgtacttacggaacgtgggaaacctaaggtccaccgttcgacgggtcaacggccccgaaacggtccccaaaccccgttagtcggtaaccctacttcccttaccgtaccccgtacccctttcgaccgtaaacggtaacccgttacttacccgaacggttaacggacgggtacccgggttcggtaaccgggaccgaaaacggggtcccgaaccgttaaagttcccggganaacgttcncgtacgtacgtacgtacgacgtacgtacgtacgtacgtacgtacgtaccgtacgtaccgtacgtacgtaccgacgtcgtacggtacgtacgtacgtaccgtacgtacgtacgacgactaccgtacgtacg

SEQ ID NO: 132877 - DNA, 831 bp, Homo sapiens
  misc_feature: GYAE6OF01ALL08.9.34.D01.1.454.CMB.1.raw
  modified_base (149)..(149): a, c, t, g, unknown or other
  misc_feature (149)..(149): n is a, c, g, or t
  modified_base (215)..(215): a, c, t, g, unknown or other
  misc_feature (215)..(215): n is a, c, g, or t
tcagtgatacgtctcacgaccggtgctcgatttagatcgtctgtgttgggtcgtgggggaggcttggtccagcctggggagtccctgcgactctcctgtgtggcctctggattcaccttttgagacctatgccttggacctgggtcccnccagggctccgaggggagggactgggagtgggtcgcgaggcatcgcgtggtggcggtcatgacacnttctacgcaactccgtggacggggccgcttcatcatcgtaccagagaacaacttcccaagaactaatacttgtcctctgaccaactaccgaaattaccgtgaacgggaggcggaacggaccgtaaccggccctagttttacgttttcgtggttacggacgggaaagggcgacgtaacttaggtaaggggaaacgttacgttaacgtttttacggaccttacccccgtcgtcgtaacgtccgaaaccgttcgtttcgtaacgtttaccgggtcggggggaccccggggtaacccgttcggggtcccggttccccggttaccttccccgtaccgtacggtccccttaacccggaacccgggtaacccggggaccccttacgggttccccggttaccccgttttcccccccggacggtaccccctaacccccgtttccgtaaaccccgaacgggaaccgtccgtaacccgtcgggttcgggggacctaccgggtacgggtaccccggtacccgggtcgggtcccgtccggttaccccggttaggtaacccggtaaacgggtccctttaaccggtacccgaaccgggttacccgtaagttcccggacggttacccggggg

SEQ ID NO: 132878 - DNA, 550 bp, Homo sapiens
  misc_feature: GYAE6OF01AF8OI.9.34.D01.1.454.CMB.1.raw
  modified_base (226)..(226): a, c, t, g, unknown or other
  misc_feature (226)..(226): n is a, c, g, or t
  modified_base (354)..(354): a, c, t, g, unknown or other
  misc_feature (354)..(354): n is a, c, g, or t
  modified_base (530)..(550): a, c, t, g, unknown or other
  misc_feature (530)..(550): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctatttattcngtcgcgaaggaggcaatagtagggtaacgtacgtaagttttccgactacccttcccgactacgtcgacgtacttttgactttaacggtcgggggaccgggaacccgttggtccgtccgtctcctcacnccctaccaccgacggcccacgtcgtcccttccccgtggccctaccctcctaccgaacgacgcctacccgtcggtaccggggcacgacggccgtcccgtgggactcgccggtggtacccgaagcctactccgaagtacgtcacacgtggacgcggtctggacgacgcgctaagtcgnnnnnnnnnnnnnnnnnnnnn

SEQ ID NO: 132879 - DNA, 668 bp, Homo sapiens
  misc_feature: GYAE6OF01EZI2E.9.34.D01.1.454.CMB.1.raw
  modified_base (321)..(321): a, c, t, g, unknown or other
  misc_feature (321)..(321): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgacggggccgcttcatcatcctccagagacaacttcccagaacatactgtctctgcaactcaatacctgagaggcgaggacacggctatttatttcngtgcgaaggagcatagtagggaagtacgtatttcgactccctcgacagtcgactactttgacgtttacgtcggggggaccgggtaaccctgggtccgtacccgtctccctacgacgtccctacccgaccgaacgggcccctacgttcccggtccctttccccccgtggacccctaccccgttcccgtaaccgaacggcctacccgtacccgttcgggtaccggggaccaccggacgggtccccgggtcccgtgggggtacccttcggcccggtttacgggtacccgtaaacgggtaacccttacccgttaacccggacgtaaccggtttactaccgagttaccgggg

SEQ ID NO: 132880 - DNA, 734 bp, Homo sapiens
  misc_feature: GYAE6OF01BWWW1.9.34.D01.1.454.CMB.1.raw
  modified_base (167)..(167): a, c, t, g, unknown or other
  misc_feature (167)..(167): n is a, c, g, or t
  modified_base (171)..(171): a, c, t, g, unknown or other
  misc_feature (171)..(171): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacgagggtcctgggcccagtctgttctgacgcagccncctnagtgtcgtcgggcccagggcaggacggtcaccatctcgtgacctagtggaagtacgcctaccaacgtagtccggggactacgttatcgtatcgtactacgtacggtaaccaaactaccttaccgaacggtaaacaccgacccctaaagtcactactaactttaacgcggaactaacgtagtacggaaccgtccggacccgttacggacgggttcccgtaacggacccgttacgttcccggtcccgtacctacgtaaacgtcggtacggactaaccgctacccgacgtcccttccacggtcctaacgtcccgtaacggtccggtaccttaccggacgtacccggtaggaccggtagtacgggacgtacgttacggtaacgttacgttaccgcgtacccgtgtacgtttacgacgttacggacggttacaccgttaaagtaccgtacggttaccgtcgtaaccgggtaccggtaccgggaccgtaaccgggttccgttacccggttaccgtccgggacccaccccggtaccggaaccgaccccctaaccgtcgtaccgtaacccg

SEQ ID NO: 132881 - DNA, 934 bp, Homo sapiens
  misc_feature: GYAE6OF01B02WD.9.34.D01.1.454.CMB.1.raw
  modified_base (187)..(187): a, c, t, g, unknown or other
  misc_feature (187)..(187): n is a, c, g, or t
tcagtgatacgtctcacgaccggtgctcgatttagatcgtctgtgttgggtttgggcatgtgtgagttttgtcacaagatttgggctcaactttcttgtccaccttggtccagccgtggggagtccctgcgactctcctgtgtgcctctggattcacctttgagacctatgccttgacctgggtccnccaggcctccgagggggaggactgggaggtgggtacgcgaggcacgtcggcgtggggttcggcggtacaagtcggaactacctaatttcctaaccggacctaaaaaccgttcccgggtaggaacgggggggtcccctacttttaccaacgtttaccgaaagttcccccttaaccgaaaacgggttaaccggaaacccttaaaaacttttacccccccgaaaaagggtaaaacccctaacttttaaacccgtttacgggtttcccctttaccggttacgggaaaccccttaaaaacccgttaccgtaaaaaaacgttaaaccccggttagggaaaagggttaaccgggggaccggtaaaacgggggaaaccctacccggggttaaccctttaagttttttacgttttaccggtggttaacggaccgggtaaaagggacggtacctaaggttaacggtagggtaaacgtaccggtttattttaccgaccttacccgtaccgtacaacggttccgaacgttctttacggtaagttaccgggtccgggggtacccgggtaaccgttcggtccgtaccgttcctacccgtacgaccgtacccgtaccgaaacccgtaacgggacccctacggtcccggttaccccgttcccccgtacgggtacccctaccccgttcccgtaacccgaaacggtcccgccctaaacccggttcggtaccggggaacccacgtacccgggcccggttacccggg

SEQ ID NO: 132882 - DNA, 545 bp, Homo sapiens
  misc_feature: GYAE6OF01A3HX7.9.34.D01.1.454.CMB.1.raw
  modified_base (139)..(139): a, c, t, g, unknown or other
  misc_feature (139)..(139): n is a, c, g, or t
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (522)..(523): a, c, t, g, unknown or other
  misc_feature (522)..(523): n is a, c, g, or t
  modified_base (528)..(528): a, c, t, g, unknown or other
  misc_feature (528)..(528): n is a, c, g, or t
  modified_base (532)..(542): a, c, t, g, unknown or other
  misc_feature (532)..(542): n is a, c, g, or t
  modified_base (544)..(545): a, c, t, g, unknown or other
  misc_feature (544)..(545): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaatccgtgaggggccncttcatcatctccagagacaattcccagaacatactgtctctgcaactcaataacctgagaggcgaggacncggctatttatttcngtagcgaagggngcattagtgggaagtacgtattttcgacttcccgtccgctagtcgactacgtttagtacttacggcggggcccggtaacctcggtccgccgtctcctcgacgccctaccgaccgaccgggccacgttccgtccttcccccgtggccctacccctcctaccgagccgctaccgcggtcgggcacgacgccggcccgtggcgtcgtccgtggtacaacgtaccttacgtacagtacgtacgtcacgtgacggcgggtacgacggcgacggcacgagtcgngtnagtnncagtnagcnnnnnnnnnnngnn

SEQ ID NO: 132883 - DNA, 491 bp, Homo sapiens
  misc_feature: GYAE6OF01BTQOW.9.34.D01.1.454.CMB.1.raw
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
  modified_base (464)..(491): a, c, t, g, unknown or other
  misc_feature (464)..(491): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagcccccaaagtcatcatttatgacaacatgaagccggcccctcgagggggtccctgaccgattcctccggctccaagtctggccacctcacgccctccctggcccatccacgtgggccttcgaggctgaggntgaggctgtattattactgcccacttcctatgacngcagcctgagagtgtggtagtcggcgggacggacagctcggaccgtctaggtcacgcccgagctccgcccctgtccactcttcgttccccacccttcctacgacgtacgtactccacgtgacggtccgggcgtcggacgtaacggcgtanacgtagntcnnnnnnnnnnnnnnnnnnnnnnnnnnnn

SEQ ID NO: 132884 - DNA, 869 bp, Homo sapiens
  misc_feature: GYAE6OF01BXKJT.9.34.D01.1.454.CMB.1.raw
  modified_base (857)..(857): a, c, t, g, unknown or other
  misc_feature (857)..(857): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttggacctgggtccgccaggctccgagggggagggactgggaggtgggtcgcaggcagtcgcgtggtggcggtcatgacactattcgtacgacaaacgtccggtaggacggggcctcttacatcatcctaccgagacgaacaacttcccaagaaactattaactgtcctcgtagaccaactcaaactaaccgtggaaggacggggcgtaacggaaccgaccgggtacctttaagtttttacttttcgtaggttacggacggtaaaacggggacggtaccgtaaagttaagggtacggggtaaaacgttaaccggtttacgttttaccggaacctttccccccggtaccgtacgtaacggttaccgtaaaccgtttacgttttacggtaacgtttacccgggtcggggggtaaccccgggtaacccgttacgggtccggtaccccgttcccgtcccgttaccgaccggtcccctaacccgaacccgaaacccggggtcccctaaccgggtttccccgttaccccttcccccggtacggtacccctacccccgttcccgaaccgtaacgacccgtccctaaccccggttgggtacccgggggtacccaaccgggtaccggtcccgggtcccgggttacgggccggtacccggttcccggttaacggggtaccgtaaaaccgggttcccttaaacccgtcccggtaacgttaaccgttaccgtaccggnggttacccgggg

SEQ ID NO: 132885 - DNA, 630 bp, Homo sapiens
  misc_feature: GYAE6OF01DEFN0.9.34.D01.1.454.CMB.1.raw
  modified_base (143)..(143): a, c, t, g, unknown or other
  misc_feature (143)..(143): n is a, c, g, or t
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (607)..(630): a, c, t, g, unknown or other
  misc_feature (607)..(630): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtggacgggggccncttcattatctccagagactaattcccagaaacatactgtctctgcaactcaaataacctgagaggcgagacacggccatttattcngtgcgaaggngcatagaggaagtacgtattttcgatccctccgcagtcgactactttgattacgtggggggacccgggtaacctcggtccgcccgtctcccgtctcgaccctcccaaccgaacgggacccctagtccggtcctttccccccgtgggacccctacccccgttcctacccgaaaaggaccgaccgtaaccccgttccggtggggggacccaaccggtaaccgggcccggggtccccgtgggggccttccgggccggttacggtaacggtaaacggtacccttaaaccgtttacccggaagtaacccgttaacttaccgaaacgttgggaaccggtcggggcctgggacgaagggccgacgaagttacgnnnnnnnnnnnnnnnnnnnnnnnn

SEQ ID NO: 132886 - DNA, 679 bp, Homo sapiens
  misc_feature: GYAE6OF01DWIX8.9.34.D01.1.454.CMB.1.raw
  modified_base (150)..(150): a, c, t, g, unknown or other
  misc_feature (150)..(150): n is a, c, g, or t
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
tcagtgatacgtctcacgaccggtgctcgatttagatcgtctgtgttgggtttgggcatgtgtgagttttgtcacaagatttgggctcaactttcttgtccaccttggtccagcctggggacgtcccctgcgactctcctgtgtggcctntggattcacctttgagacctatgccttgacctgggtccgccaggcctccgagggggaggactggagtgggtcncaggcatcgctgggtgcgtcatgaacncattctaacgacaaacgtccgtaggacggggcctcttcatcaatcctacaagacgactaacttacccaagaactaatactcgtctctcgacaaactcaaactaactgagaggacgtaagacgacggctattttattctaggtagacggaaagaggacagtaagtgggtaagttactagttttcgactaccccgtccgacgtacgtacgacttacgttagtacgttacggacgggggtacccgggtaacccgtggtacccgtaccgtcctccctacgaccgtaccctacccgaaccgaaccgggtacccacggttacccggttccctcccccgtacggtaccccgtaacccctacccgtaaccgaaacgaccgtaccgtaaccccggttcgggtaacggggaccctaacggccgggcccggtaccccggg

SEQ ID NO: 132887 - DNA, 741 bp, Homo sapiens
  misc_feature: GYAE6OF01ETYTU.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtagacgggccgcttcatcactctaccagagaccaattcccagaacatactcgtctctacgctaactacaactaacctgagaggacgaggaccgaccggacctattttagtttccgtgttagaccggtaaggacggtacgaagtaagtagggtaaagttacggtaattttcgaacttcccgtcgacgtacgtacgtacttacgtttcgtagttaccggtacggggtacccggggtaaccgtcgggttccacccggttcctacctcgacgtccctaccgaaccgtaacgggtccctaacgttccgttccccgttacccctacggtacccctacccgttccctacccgaacgaccggtacccgtaccggttccgggtaccggggaccgaaaccgtccgggcccgggttacccggttccggggacccgttccggtacccgggttacggttaacccggaaaccgttacccgttacccgtacccggacgttacccggttacttacgtaccggtccggtaacggg

SEQ ID NO: 132888 - DNA, 607 bp, Homo sapiens
  misc_feature: GYAE6OF01B3U61.9.34.D01.1.454.CMB.1.raw
  modified_base (237)..(237): a, c, t, g, unknown or other
  misc_feature (237)..(237): n is a, c, g, or t
  modified_base (304)..(304): a, c, t, g, unknown or other
  misc_feature (304)..(304): n is a, c, g, or t
  modified_base (330)..(330): a, c, t, g, unknown or other
  misc_feature (330)..(330): n is a, c, g, or t
  modified_base (477)..(477): a, c, t, g, unknown or other
  misc_feature (477)..(477): n is a, c, g, or t
tcagtgatacgtctcacgaccggtgctcgatttagatcgtctgtgttgggtttgggacaagaggcagcactcaggacaatctccagcatggcctggtctcctctcctcctcactctcctcgctcactgcacagggtcctgggcccagtctgttctgacgcagcccgcctcagtgtcgtcgggcccagggcagagggtcaccatctcgtgcactggaaccagcagtgactagttggtncttaataactagttgtctcctggtaaccaacagcacccgaggacaaagtccccaaatcatgatttangagtacaatagcgcctgtgggtcccngtactcgcttctcgtggctccgaagtcgtggacaaacgaccggtaccctcccgtagacccgtctcgtggggcctcccgaggcttaggaaccgagtaggacggtcttagtaactttacttaaccgtgaccacgtcctacaagttaacncgaccgaacgtaccaaccctaacgtaacgttcgtaccgttaacgggtaacggtaccgggaacccgtaccggtccgtacccgttaccgtacggaccgaccggacccgaaaccggaccccaaacccgtctcg

SEQ ID NO: 132889 - DNA, 844 bp, Homo sapiens
  misc_feature: GYAE6OF01CD08O.9.34.D01.1.454.CMB.1.raw
  modified_base (193)..(193): a, c, t, g, unknown or other
  misc_feature (193)..(193): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgagggtcctgggcccagtctgttctgacgcacgcccgcctnagtcgtcgcgggcccagggcaggacggtccaccatcgtcgtcgacgacgtaggaagtacgcctaccaacgacggtccggggactaacggttatgtacgtcgtaaccaccgttacggtaaccctaaaccgtaaccgttaccgaacggaaaaccgtaccgaaccccccgtaaagttacctaacgttacttaagtttaacgtacgaaacctaaacgtaagtaacggaacggtcccggtccctaccgggtaccggggtcccctacggtaacccgttacgtttcccgtacccggtacccttaccgtaacggttccgtacgggtacccacgtaaccttcccgtaacccgtccccgttacccggtaccgaaccctacgttcccgaaccgggttccgggtaccctccggtaaccgggtagtacgggaacgggtacggtcgggtaaccggttaccgttacgttaacgttaaaccgttcgacccggttaccgtagggttaccgttacgtaacggtacccggtagggtttaacccgaaccggtttaaaaggttaacctttacccgggttaccgggttaacccggtttaaacccgggtaaaccgggttaccccggggtaaaaccgggtccccggttacccgggtaacccccggtttaccgggg

SEQ ID NO: 132890 - DNA, 734 bp, Homo sapiens
  misc_feature: GYAE6OF01A96VG.9.34.D01.1.454.CMB.1.raw
  modified_base (259)..(259): a, c, t, g, unknown or other
  misc_feature (259)..(259): n is a, c, g, or t
tcagtgatacgtctcacgaccggtgctcgatttagatcgtctgtgttgggttgggggaggcttggtccagcctggggagtccctgcgactctcctgtgtggcctctggattcacctttgagacctatgccttgacctgggtccgccaggctccgagggggaggactggagtggctggctagtttgtttcattctaggaaggtattgttacaaatactaatacagaccttccggtaggaacgggcctattccaccatccnccaagacgactaactaccaaagacacgtatgtactcgtagacaagtacggacagacctaaggagttaggaacggtacgacgtcttagttttaacttacgtaggtaacggtaaagggaagggggtataacggagtacggacgacgtaccgtaccgtaaacgtttaccttacgtttacggtaccgtttccgggtacggggtacccgtaaccggggtacccgtttcgggtaacccctacccggttcccgtcccgtaccgtaccgtacccctacccgaacccggtaaccggccccgtacggttcccgttccccgttccccggtcggccccgtccgtcgccgtacccgacggactcccgaccgccggacgacgccgaacgcggccgcccggtacgggtcgtccggtccgtcgtaccgaacggtacctaccgtaccgaagtccgtactcgtacgcggaccggcgggtcgacggtcggaacg

SEQ ID NO: 132891 - DNA, 676 bp, Homo sapiens
  misc_feature: GYAE6OF01AD0UP.9.34.D01.1.454.CMB.1.raw
  modified_base (236)..(236): a, c, t, g, unknown or other
  misc_feature (236)..(236): n is a, c, g, or t
  modified_base (661)..(661): a, c, t, g, unknown or other
  misc_feature (661)..(661): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattctacgcaaactccgtggacggggccncttcatcatcctccagacgactaacttcccaagaacatactgtctctgacaactcaatacctgagaggcgaggacacggctatttattctgtgacgaaggagactagtagtagggtaagtacgtatttacgaccttcccgtacgacacgtacgactacgtttagtacgttacggtcgggggtacccggggtaacccgtcgggtccgtccgtcctcccgtacgtaccgtcccgtaccgaacccggaccgggtcccctacgttcccggttaccccttcccccgtcggtcccctacccctcccgtaccgaaccggaccgtacccgtacccggttccgggtaccggggtaccaccggtaccggcccggtcccggtcgggccgtcggtccgtcgggtacgacggtaccttaccgtacgtacgacgttacncgtcgtggtaccggg

SEQ ID NO: 132892 - DNA, 539 bp, Homo sapiens
  misc_feature: GYAE6OF01EQNP3.9.34.D01.1.454.CMB.1.raw
  modified_base (481)..(481): a, c, t, g, unknown or other
  misc_feature (481)..(481): n is a, c, g, or t
  modified_base (493)..(493): a, c, t, g, unknown or other
  misc_feature (493)..(493): n is a, c, g, or t
  modified_base (517)..(521): a, c, t, g, unknown or other
  misc_feature (517)..(521): n is a, c, g, or t
  modified_base (523)..(539): a, c, t, g, unknown or other
  misc_feature (523)..(539): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaaataacctgagaggcgaggaccacggcctattttattctgtgacgaaggaggcagtatagggaagtacgtattttcgactccctccgcagtcgactatttgattacggtgggggaccgggaaccgtggtcgccgtctcctcacgcctccaaccgaacggcccacgtccgtacccttcccccgtggccctaccctccctaccaacgacgcctaccgtcgtcggggccacgacggccggccgtggcctcgcgtggtacgaaggtactaccttaccgacgtacgtactccacgnggacgccgggcngggaccgaagggtccgacagtagnnnnngnnnnnnnnnnnnnnnnn

SEQ ID NO: 132893 - DNA, 781 bp, Homo sapiens
  misc_feature: GYAE6OF01BARBC.9.34.D01.1.454.CMB.1.raw
tcagtgatacgtctcacgaccggtgctcgatttagatcgtctgtgttgggtcgtggggggaggcttggtccagccgtggggagtccctgcgactctcctgtgtggcctctggattcacctttgagacctatgccttgaccgtggggtcccgccacggctccggagggggagggacgtgggaggtggggtcgcgaggcagtcggcgtgggtggcggtcagtgacactacttcacgactaacgtccggtgggacggggcctcttacatcactcctacgagacaactacgtacccaagaactactacgtcgtctctcgacaactactaactaccgtagaagggacggcggaacggaccgaccggacttaagtttactttcgtggtgacgggaaaggtagacttaagtaggtaacgggtaaagttacgttacttttaccgacgttccccgtacgtacgtacgtaccgtacttacggtttagtacgtttaccggggtaccggggtacccggggtacccggttcgggtccggttcccggttacccgttcccgtaccgtacctacccgtacccgacccggaaccggtcccgtaaccgttcccggttaccccttccccggtccgtaccctaccctacccgtaaccgacgaccgtacccgtccgtaccgggtccgggaccgaccggaccggtcccggtacccgggtcgggtaccggtccggtaccggttacggtaacccgtaacccggtaccttaccgtaccgtacggttaccgtactcggtcggtacgg

SEQ ID NO: 132894 - DNA, 756 bp, Homo sapiens
  misc_feature: GYAE6OF01CHV27.9.34.D01.1.454.CMB.1.raw
  modified_base (142)..(142): a, c, t, g, unknown or other
  misc_feature (142)..(142): n is a, c, g, or t
  modified_base (171)..(171): a, c, t, g, unknown or other
  misc_feature (171)..(171): n is a, c, g, or t
  modified_base (179)..(179): a, c, t, g, unknown or other
  misc_feature (179)..(179): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (720)..(720): a, c, t, g, unknown or other
  misc_feature (720)..(720): n is a, c, g, or t
  modified_base (730)..(730): a, c, t, g, unknown or other
  misc_feature (730)..(730): n is a, c, g, or t
  modified_base (740)..(740): a, c, t, g, unknown or other
  misc_feature (740)..(740): n is a, c, g, or t
tcagtgatacgtctcacgaccggtgctcgatttagatcgtctgtgttgggtttggattcacgttgcagatgtaggtctgggtcgcaggcatcgctggtcggcggtcatcgacacattctacgcaaactccgtggacgggccncttcatcatctccagagacattccagacntactgtcnctgctaactcaatacctgagagcgagacncggtctatttatcngtcgcgtaggcgntagtagtaggtaagtctacgttttcgactcccgtcgactacgtacgacgttacgttagacgttaccggtcggggtacccggtaaccgtcggtaccgtccgttaccgtaccgtcgtaccgtccgtacccgtacgtaaccgggtcccgtacggttaccggtcccgtttaccccggtacggtacccttaccccgttacccggtaaccgtaaacggtaccgttacccgtaaccggttccgggtaccggggtaacctaccggtacgggtaccccgggtccggttacgggtaccgttaccgggttaccgtacggggttaacccgtaaaccgggttcccttaaacccgggtttacccgaacgggtaccgttaaccgggtaaccggtaccgggtaccgggtaccggttacgtacccgggtaacgccgggttaactacggtcgtacgtacgcgtacgacgtcgtacgtacgtcgtagaccgtctggaccgtcgngtaacccgtnccggttacgngtacgtcgtgtaccgg

SEQ ID NO: 132895 - DNA, 799 bp, Homo sapiens
  misc_feature: GYAE6OF01ATUGZ.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattcacgcaaactccgtgacggggcctcttcatcactctccagacgacaacttcccaagaacatactgtctctgaccaactacaaactaacctggaacggagggacgaacggaaccgaccggaccttaatttttacgtttcgtggtacgacgggaaagggacggactaagttaggtaggggtaaacgttacgttaacgttttccgaacttccccgtccgtacgtacgtacgacttacgttttagacgttacgggtcgggggacccgggtaccgtcggtccgtccgtcctccgtacgacgtccctaccgaaccgtaccggccctacgtcccggttcccttaccccgtcggacccctacccctacccgtacccgaacggtaccgacccgtacccggttccgggtaccgggggaccctaaccgggtacccgggccccggggtaccccggttcgggggtccctttacccggggtacccgggtttaccgggtaaacccggtaaaccgggttaacccgtttaaaccccggtttacccgtaaacgggttaacccggtttaaaccgtaccggttaacccggttaacggggaacccggggg

SEQ ID NO: 132896 - DNA, 873 bp, Homo sapiens
  misc_feature: GYAE6OF01C6AKU.9.34.D01.1.454.CMB.1.raw
  modified_base (846)..(846): a, c, t, g, unknown or other
  misc_feature (846)..(846): n is a, c, g, or t
  modified_base (848)..(848): a, c, t, g, unknown or other
  misc_feature (848)..(848): n is a, c, g, or t
  modified_base (852)..(852): a, c, t, g, unknown or other
  misc_feature (852)..(852): n is a, c, g, or t
  modified_base (854)..(855): a, c, t, g, unknown or other
  misc_feature (854)..(855): n is a, c, g, or t
  modified_base (857)..(862): a, c, t, g, unknown or other
  misc_feature (857)..(862): n is a, c, g, or t
  modified_base (865)..(870): a, c, t, g, unknown or other
  misc_feature (865)..(870): n is a, c, g, or t
  modified_base (872)..(872): a, c, t, g, unknown or other
  misc_feature (872)..(872): n is a, c, g, or t
tcagtgatacgtctcacgaccggtgctcgatttagatcgtctgtgttgggtttgggattcacgttgcagatgtaggtctgggtcgcaggcatcgctgggtggcggtcatgacacattctacgcaaactccgtggaggggccgcttcatcatctcagagacaacttcccaagaacagtactgtcttctgaccaactacaaacttaaccgtggaacggacgggacggaacgggaaccgaccgggtacccttaatttttactttcgtggtacggaccgggaaaggggacggactaagtaaggttaaggggtaaacggttaacgtttacgtttacgacccttcccccgtaccgtactacggtaccgtaacgttaccgttttacggtacggtttaaccggggtaccgggggggtaaccccgggggtaaaccccgttcgggggttccccggtaccccgggttcccttacccggttaccgacccggttaccccgtaaccccggaaaaccccgggtaacccggggtaccccttaaccgggtttcccccggtttcccccgtttcccccccggtacgggtaccccctaaccccccttcccgttaacccgaaacggaccgtaccccgtacccgggtttcggggaccggggacccaaccggtcccggggtaccccggggtaccccggtttggggaccccgttccgggtaccccggttaccgggtaacggtaaaccggttacccttaaacccggtttacggaacccggttaacgtaccgtaccgacgggttacgggaaccggggtcgggtaccggttagggaaacccggaaggggcctaacggtagtaggactaacggncngtgngnngnnnnnncgnnnnnngng

SEQ ID NO: 132897 - DNA, 698 bp, Homo sapiens
  misc_feature: GYAE6OF01DY5UV.9.34.D01.1.454.CMB.1.raw
  modified_base (186)..(186): a, c, t, g, unknown or other
  misc_feature (186)..(186): n is a, c, g, or t
tcagtgatacgtctcacgaccggtgctcgatttagatcgtctgtggttgggtttggggtctgagagaggagcccagccctgggattgtcaggtgttttcactttggtgatcaggactggacagagagaactcaccatgggagtttgggctgacctggtctttttctcgtggcttgttttaaaaggngtccagtgtgaggttcaactgttggagtcgtgggggagcttggtccagcctggggactccctgccgactctcctgtgtcggcctcgtggactttctaaccgttttgaacgtaccctatcgtcctttaggacccgttggggtccccgcccaagggtcccttccgggaaggggggtacgggtaccgtggggaacggttcgggggtcgacgaagggcctaagttcggccgttgggtcggccggttcaagttcgaactacgtatttaccgtaacggacctaaacgtcccgggtaggaccggggtcctctttacatccactcctccgaagtaacactaacgtcccaagaacctatactagtctactcgacctaacgtcaaactaaccgtgtaaggacgaccgtaaggaccctacggtaccttagttttacttcgagtacggacggtaaagggacgtactaagttaaggtacggggtaaatttaccggttaattttccggaccttccccgtcgtaacg

SEQ ID NO: 132898 - DNA, 810 bp, Homo sapiens
  misc_feature: GYAE6OF01B7Z68.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactgggagtgggtcgcgaggcatcgcgtgggtggcggtcatgacacattctacgactaaactccgtggacggggcctcttcatcatctaccagacgactaacttccaagaacatacgtgtctctgacaactacaaactaacctggagaggacgaacggacaccggccttaattttactttcgtggtcgacggaaagggacggactaagttaggtacgggggtaaagttaccggttaagtttttaccggaaccttcccccgtacccggtacgtaacggttaccgtaacctttacggttttacgtaacggtttaccggggtccgggggggtaccccggggtaacccggttcgggttcccggtccccgttccgtccccgttaccgtaccgtaccccgttaacccgaacccggaacccgggtaccccgtaccgttaccccgggttcccccttacccccggtaccggtaccccttacccccgtacccgttacccgaaccgtacccgtaaccccgtacccggttaccgggtccgggggaacctaccggtaccggcccgggtccggtccgggtccgtccggtccggtacggtaccgtaaccggtaccgttaaccttaccggaacgtacgtactccgtacggtcggtaccggg

SEQ ID NO: 132899 - DNA, 743 bp, Homo sapiens
  misc_feature: GYAE6OF01BY7JZ.9.34.D01.1.454.CMB.1.raw
  modified_base (191)..(191): a, c, t, g, unknown or other
  misc_feature (191)..(191): n is a, c, g, or t
  modified_base (266)..(266): a, c, t, g, unknown or other
  misc_feature (266)..(266): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctnagtgtcgtcggggccccagggcaggaggtcacatctcgtgcagtggaagtgctaccaagagtcgggctacgttangatgtacacgtacggtaccaacgtactccgaaggaaccaccgaccccaaagtcaactacgtaatttagacgaacaacgtatacggaacggtccggtaccccgtacggacggggttccctacggtaccgtacctttcccgccggtctacccgtaacggtcctacggaccaactacgtaccgtaccgtaccccttacccggtacggtaccaacgttccgacggttccggtacctacccggacggtcggttaagggaccggtaaggtacggtacgggttaccgtaacggtacctttaacgttaccgttaccgggtaccgtaacggtttacggttaaacggtacggtaaaccgttacgggttaaccggttaaacccggttaaaggttaaccctaaacgggttcccggttaaacggtttacggggtaaaccggtacggggttaacccggtaaccggttaccggtaccccggtttacccgggg

SEQ ID NO: 132900 - DNA, 778 bp, Homo sapiens
  misc_feature: GYAE6OF01E4RA8.9.34.D01.1.454.CMB.1.raw
  modified_base (172)..(172): a, c, t, g, unknown or other
  misc_feature (172)..(172): n is a, c, g, or t
tcagtgatacgtctcacgaccggtgctcgatttagatcgtctgtgttggggtttggggacaagaggcagcactcaggacaatctccagcatggcctggtctcctctcctcctcactctcctcgctcactgcacagggtcctgggcccagtctgtctgacgcacgccgccctnagtgtcgtcggggccccagggccaggacgggtccacctattcgtcggtgccacgtagggaagtacgcctaccgaaacaggtccgggggactacgttagtcgatacgtaccaccgttacggtaaccaacctaacttaccgaacggaaccaccgacccccaaagtccatactattacgtacgaacaacgtagtagacggacccgtcccgtacggtaaccgggtcctacgtaccgtacttccgtccgacctaccgtaacgtcgtacggacctacgtacgtacaaccgttccctacccggtcgacccgtaacgttaccgcggtacggtaccgtaccgtacgggtaccgtaggaacggtacgtagggtaaccgtcggttacgtaacgtttaaccgtacgtaccggtaccgttacggttacgtagtacccgggtaacgtacggggttaaccgtaaaccgttaaacgttaacgtaccggttccggttaaccgttacgggtaaaccgggtacgggtaaccgtaccgggttaccggaaccccggtttcgggaccggtaacccgaccggtaaccccggaaccgtaacccccctaaacccgtccgtaacggttaccc

SEQ ID NO: 132901 - DNA, 615 bp, Homo sapiens
  misc_feature: GYAE6OF01BQ68F.9.34.D01.1.454.CMB.1.raw
  modified_base (230)..(230): a, c, t, g, unknown or other
  misc_feature (230)..(230): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
  modified_base (597)..(597): a, c, t, g, unknown or other
  misc_feature (597)..(597): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(613): a, c, t, g, unknown or other
  misc_feature (612)..(613): n is a, c, g, or t
  modified_base (615)..(615): a, c, t, g, unknown or other
  misc_feature (615)..(615): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaaactccgtggaggggccgcttcatcatctccagagacaattcccagaacatactgtctctgacaactcaataacctgagaggcgaggacacggcctattttattcngtgacggaaggagcatagtaggaagtacgtatttcgactccctccgacacgtcgactactttgacgttacggtcgggggacccgggtaccgtcggtccggtccgtcctccgtacacgccctaccgaaccgaacggccctacgtccggttcccttccccgtcgccctacccctccctaccgaacgtacgaccctaccgtcggtacggggccacggacggcccgggtcccgtcgggtccgtcggtcccggttggtaaccgaacggttaaccttaccgttaccgaacggtaccgtactaccgtacgtcggacggtaccgggtcgtacgggaacgacggccgaacgtagacgngcagncncngctancgtngcacgntcncnancnngn

SEQ ID NO: 132902 - DNA, 604 bp, Homo sapiens
  misc_feature: GYAE6OF01CRFK1.9.34.D01.1.454.CMB.1.raw
  modified_base (127)..(127): a, c, t, g, unknown or other
  misc_feature (127)..(127): n is a, c, g, or t
  modified_base (238)..(238): a, c, t, g, unknown or other
  misc_feature (238)..(238): n is a, c, g, or t
  modified_base (326)..(326): a, c, t, g, unknown or other
  misc_feature (326)..(326): n is a, c, g, or t
  modified_base (566)..(604): a, c, t, g, unknown or other
  misc_feature (566)..(604): n is a, c, g, or t
tcagtgatacgtctcacgaccggtgctcgatttagatcgtctgtgttggggtttggggggggcacgttatgatgtacactggtaccaacaacttccaggaacacgccccccaaagtcatcattttangaacaacatggaaggccggccctcgacgggggtcccctgaccgtattccgtccggctccaagtcgtggacacatcacgccctccgtggacctatcacgtcgggcctaccgnggctggaggtatgggacggtctagtaacttacttaccgtcgaccgtaggttcgtagtacgaccgaggtacggtaacctaaagtaaccngttccggttaccgttacggaacggtacgggaacccgtaaggtccctacccggtcggtcgggtaccaaccggcccgaaccggaccccctaaccctgttcgtacctaacccgttcccttaaccccgttccccccgaccccttacgtaacgtaaccggttaccttaccgttacgtaacccggggtaggaacccggggttcccgggtaacggaccggaaccggacgggtaccacgtaaagtcannnnnnnnnnnnnnnnnnnnnnnnnnnnnnnnnnnnnnn

SEQ ID NO: 132903 - DNA, 916 bp, Homo sapiens
  misc_feature: GYAE6OF01CG3ET.9.34.D01.1.454.CMB.1.raw
  modified_base (192)..(192): a, c, t, g, unknown or other
  misc_feature (192)..(192): n is a, c, g, or t
  modified_base (420)..(420): a, c, t, g, unknown or other
  misc_feature (420)..(420): n is a, c, g, or t
tcagtgatacgtctcacgaccggtgctcgatttagatcgtctgtgttgggtttgggcatgtgtgagttttgtcacaagatttgggctcaactttcttgtccaccttggtccagcctggggacgtccctgccgactctcctgtggtcggcctctggattcacctttgagacctatgccttgaccgtgggtccnccaggctccgaggggaggctggaggtgggtcgcgaggcacgtcgcgtgggtggaccggtcaagtcgaacacgtacttcgaaccggacctaaaccgttccggtaggaacgggggccctactttaccgacttcctacttccgtaccaaggaaccgactaaaccgtttccccaaagtaacctataaccgttcgtaccttcgacgacctaacttacccaaacttaacccggnggaacggacgggaccggaaggtaacccacgggtaccttaagttttttacgttcgtaggtacgggcggtaaaacggggtcgtaacgtaagttaacggggtaggggtaaacgtttacggttaaccgtttttaccgaacccgttccccggtaccgtacgttaaaccggttcgtaaccgtttaccgtttacggttaacggtttacccggggtaccggggggtaccccgggttaacccgttcgggttccccggtaccggtttccctcccccgttaccggacccgttccccgtaaaccccgtaaccgggtaacccggggttcccctaaacggtttcccccgggtttaccccctttccccccggtacccgggtacccctttaacccccccggtaccctttaaaccccgaacccggtaccggttacccccgtaccccgggttaacccggggtcgggggaaccccttaacccggggtcccggggccccgggtttaacccccgggg

SEQ ID NO: 132904 - DNA, 595 bp, Homo sapiens
  misc_feature: GYAE6OF01EV6M2.9.34.D01.1.454.CMB.1.raw
  modified_base (140)..(140): a, c, t, g, unknown or other
  misc_feature (140)..(140): n is a, c, g, or t
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
  modified_base (400)..(400): a, c, t, g, unknown or other
  misc_feature (400)..(400): n is a, c, g, or t
  modified_base (570)..(570): a, c, t, g, unknown or other
  misc_feature (570)..(570): n is a, c, g, or t
  modified_base (573)..(573): a, c, t, g, unknown or other
  misc_feature (573)..(573): n is a, c, g, or t
  modified_base (577)..(580): a, c, t, g, unknown or other
  misc_feature (577)..(580): n is a, c, g, or t
  modified_base (582)..(584): a, c, t, g, unknown or other
  misc_feature (582)..(584): n is a, c, g, or t
  modified_base (586)..(595): a, c, t, g, unknown or other
  misc_feature (586)..(595): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataaccngagaggcgagacacggcctattttattctgtgcgaaggnggcatagtgggaagtacgtattttcgactcccctcgcagtcgactactttgattacgtcgggggcccgggtaacccgtgggtccgcccgttcctcctcacgccctccaaccgaacgggcccagtccggtcccttccccgtggcccacccctcctacccaaagcnccgtacccgtcggtcgggggaccacgacggccggcccgtggggcctcggcccgttggtacccgaaacggtaccttaccgttacccgaacgttaccgtacgttacccgaacgttcgggaacggtccggggtactcggggaaccgtaaacgggccgaccgtaaagttcggangcngcgnnnngnnncnnnnnnnnnn

SEQ ID NO: 132905 - DNA, 805 bp, Homo sapiens
  misc_feature: GYAE6OF01EAH3Y.9.34.D01.1.454.CMB.1.raw
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccgagggggagggactgggagtgggtcgcgaggcatcgcgtggtggcggtcagtgaccacattctacgactaaacgtccgtggacggggtcctcttcatctactctccgagacacacgttcccaagaacattacctgtcctctagacaactacaactactgagacggcgaaggaccgacggtaccttattttactcgtagtcgacggaaggngactagtaggtagggtaacgttacgttnttaccgctaccccgtcgagtacgtccacttacgttacgtacgttaccgggtccggggggtacccgggttaaccgttcgggttacccgcccgttacccgttcccgtaccggtaccgtaccccgtaccccgtaacccggtacccggggtaccccttaccgggttaccccgtttaccccccgtttccccggtccggtacccccctaaccccgtttccccgaaacccgacggtacccggtacccgttaccggttccggggtaccgggggtacccaaccggtaccggggtccccggttcccgggtcgggttacccggtccggtacccgggttacgggtaacccgtaacccgggttaaccgttaaccccgttacccgtaaacgggttacccgttaccctccgggtaccggtaccgggg

SEQ ID NO: 132906 - DNA, 679 bp, Homo sapiens
  misc_feature: GYAE6OF01C4S7H.9.34.D01.1.454.CMB.1.raw
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (387)..(387): a, c, t, g, unknown or other
  misc_feature (387)..(387): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacaggtcctgggcccagtctgttctgacgcacgccgccctcagtgtcgtcggggccccagggcaggacgggtccaccatcgtcgtcgcacgtggaagtacgcctaccaacgacggtccggggactacgttatgacttcgtacaccgtacggtaacccaaacctaccttaccgaagaaccacgaccccaaagtcatactatttanacgaacaacngtagaacgccgcccgtacgacgggtcctcggacctacgttccnccgtctacctaagtccgtggacactacgtccacgtccctccgtcgaccactaccgtaccggtcgggtacctacggaggtccgtaggaagtacgtggacgtcgtacgtaccttaattaccgtagccgtagttacgtacgtacgaacgtaggtacgtaaccgttaaagtaacctacgttaccggttaccggttaaccggaacggtaccgggaaaccgtacggtacccgaccggtttacccgcgggtacccaccggaacccccgaacgacccccaaacccgtcgtaccgtacccg

SEQ ID NO: 132907 - DNA, 748 bp, Homo sapiens
  misc_feature: GYAE6OF01BPBN6.9.34.D01.1.454.CMB.1.raw
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (309)..(309): a, c, t, g, unknown or other
  misc_feature (309)..(309): n is a, c, g, or t
  modified_base (629)..(629): a, c, t, g, unknown or other
  misc_feature (629)..(629): n is a, c, g, or t
  modified_base (704)..(704): a, c, t, g, unknown or other
  misc_feature (704)..(704): n is a, c, g, or t
  modified_base (731)..(731): a, c, t, g, unknown or other
  misc_feature (731)..(731): n is a, c, g, or t
tcagtgatacgtctcacgaccggtgctcgatttagatcgtctgtgttgggtttggggctctgcttcagctgtgggcacaagaggcagcactcaggacaatctccagcatggcctggtctcctctcctcctcactcctcctcgcttcactgcacgaggtcctcgggcccagtcttgttcngacgcacgcccgcctnaggtcgtcgtccgggcccgaagggccaggacggtccaccacgttccgtcgcgaccgtaacggtaggtaaacgttcggacctaccgtaaacgcggtccggggtacttaagtttanacgtacgttacgtaacctacggtaaccgtaaacctaaaccgttaaccgttaacccggaacggaaacccgtaaccccgtaaaccccgtaaaaggttacctaccgtttaacgttaagttttaaccgaagaacctaaaaccgtacggtacggaacgtcccggttaccccggtaaggtcccggtacccgtacggtaaccgttccgttacccggtcccgtaccgtaacgtacggtcgtaccggtactacctacgtcccgtacgtcccgttacccgggactcgtacctaccggtaccggtggaaccccgcggtacgtagtacgggngttaaccgtggtacctacgtaactacgttcgtaactcgtaccgtagtacctagaccgtagtaccggataacgtanacgttcgacgtacgacgtacgcgtaanccgtcgtaccgtacggg

SEQ ID NO: 132908 - DNA, 629 bp, Homo sapiens
  misc_feature: GYAE6OF01E3J67.9.34.D01.1.454.CMB.1.raw
  modified_base (139)..(139): a, c, t, g, unknown or other
  misc_feature (139)..(139): n is a, c, g, or t
  modified_base (225)..(225): a, c, t, g, unknown or other
  misc_feature (225)..(225): n is a, c, g, or t
  modified_base (600)..(600): a, c, t, g, unknown or other
  misc_feature (600)..(600): n is a, c, g, or t
  modified_base (603)..(605): a, c, t, g, unknown or other
  misc_feature (603)..(605): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (617)..(618): a, c, t, g, unknown or other
  misc_feature (617)..(618): n is a, c, g, or t
  modified_base (620)..(620): a, c, t, g, unknown or other
  misc_feature (620)..(620): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattcacgcaaactccgtgaggggccncttcatcatctccagagacaattcccagaacatactgtctctgacaactcaataacctgagaggcgagacacggcctatttattcngtgacgaaggagcatagtaggaagtacgtattttcgactccctccgctagtacgactacgtttgtacgttacggtcgggggacccgggtaacccgtgggtaccgcccgtctccgtcacgccctaccaaccgaacgggtcccacgtccggtacccctttcccccgtcggaccccacccctccctaccgaaacgaccgaccctacccgttccgggtacgggggaccctaccggaccgggtccccgggtccccggtacggggcctcggtaccccgtggtaacccgaaaccggtaaccttaccgttaccgaacggtaccgtaacttacaacgtggacgggccgggtcgagggaccgaagggccgacgtaagtacgacgncgnnnangngnancnanngnacancngnc

SEQ ID NO: 132909 - DNA, 896 bp, Homo sapiens
  misc_feature: GYAE6OF01EDCGJ.9.34.D01.1.454.CMB.1.raw
  modified_base (216)..(216): a, c, t, g, unknown or other
  misc_feature (216)..(216): n is a, c, g, or t
  modified_base (306)..(306): a, c, t, g, unknown or other
  misc_feature (306)..(306): n is a, c, g, or t
  modified_base (395)..(395): a, c, t, g, unknown or other
  misc_feature (395)..(395): n is a, c, g, or t
  modified_base (444)..(444): a, c, t, g, unknown or other
  misc_feature (444)..(444): n is a, c, g, or t
tcagtgatacgtctcacgaccggtgctcgatttagatcgtctgtggttgggtttgggggaggcttggtccagcctggggagtccctgcgactctcctgtgtggcctctggattcacctttgagacctatcgccttgaccgttgggtccgccaggcctccgagggggaggactgggagtgggcgacgaggcatcgcgtgggtggcggtcagtcgacnctattcacgactaaaccgtccggtggacgggtcctcttacatccactcctcgagagtaacctaccttacccgaagaaactacttaccgtnttaccgtcttacggacctaacctactaaaactaccgtgaaggacggcggaagaccgacgtacttagttttacttgcgtgacgtaaaggngaactagtaggaggtaaacgttcgttactttcggaccttcccgtacggnttaccggaacgtaaccgttttacgtttaacgggtaaccgtttacgggggtacccggggggacccgggttaacccgttggggttaccccgtccgttccccgtttaacctaccggtaacccgttccccgtaacccgaacccgggtaacccgggtccccttaacgggtttcccccgttaccccggttaccccgtcccggtaccccttacccccgtaccgtaacccgtaaccggaccccgttaccggtacccgggttacccgggaggggttaacccccaacggggtacccgggtcccccgggtttaccgggtacccggggtaccctttacccgggggtacccccggtttacgggtaaaccccggttaaaacggttaaccccggtttcccccgttaaaccgggtacccggggttaaaccaccgttaaacccgggttccggtaggggtacccccgggg

SEQ ID NO: 132910 - DNA, 632 bp, Homo sapiens
  misc_feature: GYAE6OF01CSURN.9.34.D01.1.454.CMB.1.raw
  modified_base (346)..(346): a, c, t, g, unknown or other
  misc_feature (346)..(346): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagaccctatgccttgacctgggtccgccaggctccgaggggagggactgggagtgggtcgcgaggcatcgctggtggcggtcatgacacattctacgacaaactccgtggacggggccgcttcatcatctccagagactaacttccagaacatactgtctctgacaactacaactaactgagaggacgaggacgaccggacctattttatttctgtgacggaaggngatagtagtagggaagtacgtagttttcgaccttcccgtacctgacgtcgacttacgttgtacgttcggcggggtacccggtaaccggtcggtccgtcccgtctcctcgacgtccctaccgaaccgtacgggaccctcggtacccgttcccccttcccgccgaccctaccctccgtaccaacgtccgacctccgtcggccgggacacggacggtcccgaccgtcgggtctaccggtccgtagtacccgaacgtctacccgtacgagtaccgtcacgcgtggaccgg

SEQ ID NO: 132911 - DNA, 650 bp, Homo sapiens
  misc_feature: GYAE6OF01BP979.9.34.D01.1.454.CMB.1.raw
  modified_base (328)..(328): a, c, t, g, unknown or other
  misc_feature (328)..(328): n is a, c, g, or t
tcagtgatacgtctcacgaccggtgctcgatttagatcgtctgtgttgggtttggggacaagaggcagcactcaggacaatcgtccagcatggcctggtctcctctcctcctcactctcctcgctcactgcacgaggtcctgggcccagtctgttctgacgcacgccgcctcagtcgtcgtcggggcccagggcaggacggtcaccgatctcgtgctacgtaggaatacgcctaccaacgtacggtcggggactacgttagagatcgtaacacgtacggtaaccaactaacttcgaacgaacaccgtacccaagtcatactaatttanacgaacactagtacgaacgtccgacctacgtacgggtccacggtaccgtacttccggccgtactaccgtaacgtcgtcggaactacgacgtaccgacgtccccttccggacgacctactccgacggttcggacctccggaagtcgtaggacgtagtcggaacgtctaacggtcttaacgttcgtacgtacgtacgtacgtaactacgaacgtgtaccgactaacgtaccacgtacgtacgtacggtactacgggaactacgggtaccacggttcggacggtaccgaccgtacccgaaccgaccctacctacgtccgtaaccg

SEQ ID NO: 132912 - DNA, 865 bp, Homo sapiens
  misc_feature: GYAE6OF01ENRSZ.9.34.D01.1.454.CMB.1.raw
  modified_base (364)..(364): a, c, t, g, unknown or other
  misc_feature (364)..(364): n is a, c, g, or t
tcagtgatacgtctcacgaccggtgctcgatttttttagatcgtctgtgttgggtttgggggaggcttggtccagcctggggagtccctgcgactctcctgtgtggcctctggattcacctttgagacctatgccttgacctgggtcccgccaggctccgagggggagggacgtggaggtgggtcacgaggcagtcgcgtgggtggcggtcatgacactatttacacggacaaaaccttccggtaggaacgggggccctcttacactcacttccaccgaggagaactaattacccaaaggaacctacggatgtaatcgtgaactaaagtcggacaggacctaaggagttgaggaacgaccggtntttagtttaattactaggtaacgaaagggagggggaacttaacgaggtacggacacgtaccgttaacccgtaaagttaccgtttaacgtttcgtaaaccggtttccggttacggggggaccccggtaacgggtaaaccccggttcgggttaaccctaccccgggtttaaccctcccgttacgtaaccgacccccgtaccccgaaacccgggaaacccgggtacccgtaacggttcccggttaaccccgtttccccccggtaacgggtcccccgtcccgttacggaccccgttaccggaaccgggaccgtaaccctaccccgtaaccgggaagacccgacgtaaacccggtaccggccccgggtacccggtacgggtcctacgtacccccggttaagggaacccgtaaagggtaacccctttacggttaaccccggttaaggtaaccccgtttaagttacccgaaaggtaccggttaaccggggccgggtaccgtaacgggg

SEQ ID NO: 132913 - DNA, 805 bp, Homo sapiens
  misc_feature: GYAE6OF01EPW3T.9.34.D01.1.454.CMB.1.raw
  modified_base (140)..(140): a, c, t, g, unknown or other
  misc_feature (140)..(140): n is a, c, g, or t
  modified_base (754)..(754): a, c, t, g, unknown or other
  misc_feature (754)..(754): n is a, c, g, or t
  modified_base (772)..(773): a, c, t, g, unknown or other
  misc_feature (772)..(773): n is a, c, g, or t
  modified_base (782)..(782): a, c, t, g, unknown or other
  misc_feature (782)..(782): n is a, c, g, or t
  modified_base (791)..(791): a, c, t, g, unknown or other
  misc_feature (791)..(791): n is a, c, g, or t
  modified_base (799)..(799): a, c, t, g, unknown or other
  misc_feature (799)..(799): n is a, c, g, or t
  modified_base (801)..(801): a, c, t, g, unknown or other
  misc_feature (801)..(801): n is a, c, g, or t
  modified_base (804)..(804): a, c, t, g, unknown or other
  misc_feature (804)..(804): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattcacgcaaactccgtggaggggccncttcatcatctccagagacaatcccagaacatactgtctctgcactcaactaccgtgagacggacgagacacggtcttattttacgttcgtggtcgacggtaagggacggtactaagttacggtaggggtaacgttacgttacgttttaccgaccttacccccgtcgactacggtaccgtaaccgttacgttttacggtaacggtttaccggggtccgggggggtaacccccggggttaacccgttcggggtcccgtaccccggttacccttcccgttaccggaccggtccccttaccccggaaaccggtaacccgggtaccctaccggtttccccgggttacccccgtttcccccggacgggtaccccgttccccggtacgtacccccgtaccggggaagggtcccctaaccccggtacccgttacccgggaagaccggtaccccgaacggttaccgggtccccgggtacccgtaggggtccctccgggtaccgtacgggtaaccgtaacggtacctttaccgtcccggaagttaccgttactaccgtacggtagggaccgggtaccgggttacgaaccgggttaccggaacgggttccgaacttaggacgtnacggtacctgggaacccnnggtactcgncgggatcgntacgcagngntgng

SEQ ID NO: 132914 - DNA, 861 bp, Homo sapiens
  misc_feature: GYAE6OF01AU0UO.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtctctctcctcctcactctcctcgctcactgcacgagggtcctgggccctagtcttgttctgacgcacgcccgtccctcgacggtcgtccggtccggggaccccgaggggccgaggtacgggtccacctacttccgtcggtcgacctacggtaggaacggtacgtcctacgaaacgcggtccgggtactacgttagtgtacttacgtacctaccgtacggtaaccaactaccgtacgaacggtaccaccgtacccaagtaccagtaccttagttacacgtaacaacgtagtaacggaccggacccgtacccgtaccgggtaccgggtaccccgtacggtaaccgtaccgtttccccgtaccgggtacccttaaccggacgttcgggttaccgaccgtacgaccgttcctaaccggttccccgttacggaccctacgaccgtttaccggtaccgggtaccgggtacctacccggtagggtccgttaacggggtaacgtagggttacggacgttacgttaaccgttaaccgtttaccggtttaaacgtcccgggttaaccgttaccggttaacgttaacgggtacgggtaaccgtaaaccgggggtttaccgttaaacccgggttaacggttaaccgtttcgggttacccgggtttaaaccccggttaacggggggtaaaaccggtaccccgggtttaaaaaccggggttccccgggttaaaccccggtacccgggttacccgggg

SEQ ID NO: 132915 - DNA, 706 bp, Homo sapiens
  misc_feature: GYAE6OF01B0BBH.9.34.D01.1.454.CMB.1.raw
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
  modified_base (687)..(687): a, c, t, g, unknown or other
  misc_feature (687)..(687): n is a, c, g, or t
  modified_base (697)..(697): a, c, t, g, unknown or other
  misc_feature (697)..(697): n is a, c, g, or t
tcagtgatacgtctcacgaccggtgctcgatttagatcgtctgtgttgggtttgggggaggcttggtccagcctggggagtccctgcgactctcctgtgtgcctctggattcacctttgagacctatgccttgaccgtgggtccgccaggctccgagggggagggactggagtgggtcgcaggcatcgctggtggcggtcatgacacattctacgacaaactccgngagggccnttcatcatcncagagacaacttccaagaacatactgtctntgcaactacaatacctgaaggaggacggtacggacgaccggtaccttagttttactttcgtgtcgtacggaaaggtggactaagtaacgtagggggtaacttacggttactttcgaacttcccctacgacgtacgtcgtacttactttgacgttacgggcggggacccggggtaacctcgggtccgtccgtctccgtccgaccgtaccgtcccaaccggaaccggtcccgttaccgtcccgggttccccttccccggtaccgtacccctacccccgtccgtaacccgaacggtaccgtcccgtaccggttacccgggtccgggacccgtacgccgggtacccgggtcccgtcgggtacctccggtcccgttacgggacgtaacggacccttacgtacccgtaagtacttaacncggtaaacgnggtaccggg

SEQ ID NO: 132916 - DNA, 960 bp, Homo sapiens
  misc_feature: GYAE6OF01ARSSH.9.34.D01.1.454.CMB.1.raw
  modified_base (200)..(200): a, c, t, g, unknown or other
  misc_feature (200)..(200): n is a, c, g, or t
tcagtgatacgtctcacgaccggtgctcgatttagatcgtctgtgttgggtttggggctctgcttcagctgtgggcacaagaggcagcactcaggacaatctcaagcatggcctggtcctcctctcctcctcactctcctcgctcactgcacgtacggtccgtggaccctcgtctgttctcgacgccacgccccgcctanacgtcgtccggtacggggccccgagggcaggtaccgggtccaaccgacgttaccgtcggtacgactaaccggttagggaaacgttcgtaccctaacccgaacgtacggtccggggtaccttaacggtttacgtacggtaacttaccgtaaccgtaccggttaaccgggtaaacccctaaaccgttaaacccgttacccggaaaacggaaaccctacccggaaaccccctaaaaggttacctaacgtaccttaaacgttttaacgacgtaaaactaaaccgaggtaaccggtaaaccgtcccgggtaccccgtacggggtaaccgggttcccgaaccggtaacccggtttccgttacccggtacccggtacccgttaaccgaacggttcccgtaggacccttaaccgcgtacccgtaaccgtcccccgttcccggtaacggaccctaacgttcgggtaacccgttcgggacccttaccggttaagggtaccgaaccgggtaaggtccggttaaccggggacctacgggttaccttaaaccggtttacgttaacccggtcggttaaccccgtacgggttttaacgggtacggtttacccgaaacggggttacccgtttaaaacccgggttacccttaaaaccgggttaccggttaccccggttttacggttacccggggttaaaccgggtttaaaaccccgggggccggtttaaaccccgggttacccgggtcccccgggtttaaaacccggtacccccggg

SEQ ID NO: 132917 - DNA, 795 bp, Homo sapiens
  misc_feature: GYAE6OF01A4QNM.9.34.D01.1.454.CMB.1.raw
  modified_base (648)..(648): a, c, t, g, unknown or other
  misc_feature (648)..(648): n is a, c, g, or t
tcagtgatacgtctcacgaccggtgctcgatttagatcgtctgtgttgggtttgggacaagaggcagcactcaggacaatactccagcatggcctggtcctcctctcctcctcactctcctcgctcactgccacagggtcctgggcccagtctgttctgacgcagcccgccctcgagtggtcctcggggcccccaggggtccaggacgggtccaccactccgtacggtcgacgtaccgttggtaaccgttcggccttacccaaaccgtacggttccgggggactaacggtttatccggaagttcggtaacccaccgttacgggttaaccccaaacctaacccgtttacccgaaacggtaaacccgtaccggaaccccccctaaaaggtcccaaacttttaccgtaacgttttaactacggtaaaccctaaacgtacgttaacggaacgggtccccggtccccgttacgggtaacccgggggttacccctaggaacccggttacgttacccgtcccggtacccttaccgtaacgttccgtacggaccactaactccgacgtcccctccgtcggaccctatcccgtaccgtcgggtcctaccgtacggtccttaggaggtctacggacgtactacggtacttacgttacncggtctacgttcgtaatgaacgtaggtacgaaccgttaagtacctctcggttaccgtacggtaccgtacggaaccggtcggtaccctacccggttccggtacggtcccaccgtaccccggaacgacccctaaccgcgttcgtacccg

SEQ ID NO: 132918 - DNA, 817 bp, Homo sapiens
  misc_feature: GYAE6OF01B124K.9.34.D01.1.454.CMB.1.raw
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggtctttttctcgtggtctgttttaaaaggtgtccagtgtgaggttcaactggttggagtcgtgggggaggcgtttggtccaggcccgtagggggtacgtccccgtgccgacttccttcctggtggttcggccttcgtagggtactttcacccttttggaacgtaccttaattcggtaccctttcggaccccgttcggggtcccccgcccggacggtccgtaccggaggggggaacgggtaccgtaggggacgggttcggggttaccggcgagggtcgaacgttccggccgttggggtcggtccgggtcaagtcggaacctaacgtctttacccgtaccgtaaccgaaaaccgttcccgggtacgggtaacggggggcccgtccgtttaccgaacttccgttaaacttcccgttaccgaacgggaaacgtaaacccgtaaacctttacccccgaaaggtaaaccctaacttaaaccgttcgttaccttacgtcgtaaccctaaaccttaccaaaaccgttaacccgtaagggtaaccggaacggggtacccgaaacgggaccgaaccggtaccttaacgttttacgtttccgtggttagacggtaacgggaggtacagttagttagggaaacgttacgttagtttacgaccttcccgtcgtaccg

SEQ ID NO: 132919 - DNA, 655 bp, Homo sapiens
  misc_feature: GYAE6OF01ESEWU.9.34.D01.1.454.CMB.1.raw
  modified_base (563)..(563): a, c, t, g, unknown or other
  misc_feature (563)..(563): n is a, c, g, or t
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (597)..(598): a, c, t, g, unknown or other
  misc_feature (597)..(598): n is a, c, g, or t
  modified_base (604)..(604): a, c, t, g, unknown or other
  misc_feature (604)..(604): n is a, c, g, or t
  modified_base (608)..(609): a, c, t, g, unknown or other
  misc_feature (608)..(609): n is a, c, g, or t
  modified_base (613)..(613): a, c, t, g, unknown or other
  misc_feature (613)..(613): n is a, c, g, or t
  modified_base (618)..(618): a, c, t, g, unknown or other
  misc_feature (618)..(618): n is a, c, g, or t
  modified_base (627)..(627): a, c, t, g, unknown or other
  misc_feature (627)..(627): n is a, c, g, or t
  modified_base (630)..(630): a, c, t, g, unknown or other
  misc_feature (630)..(630): n is a, c, g, or t
  modified_base (635)..(636): a, c, t, g, unknown or other
  misc_feature (635)..(636): n is a, c, g, or t
  modified_base (639)..(639): a, c, t, g, unknown or other
  misc_feature (639)..(639): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (655)..(655): a, c, t, g, unknown or other
  misc_feature (655)..(655): n is a, c, g, or t
tcagtgatacgtctcacgaccggtgctcgattttagatcgtctgtggttgggggtttgggggggcacgttatgatgtacactggtaccaacaacttccaggaacagccccaaagtcatcattttatgaccaacatgaacgcggccctcgacgggggtccctggaccgattcctccggcctccaagtctggcacatccagtccttccgtcggccatcacgtcgggctccgaggctgaggatgacggctgacttattacgtcgccgtagtcgttatacgacacgcacgccgtaggaagtaacggttgtaacggttagttaccggggacgggaacgggaacctaagtcctacggtacccggttcgttacggggtaccaacggtacccggtaaacggtcccgtacccgcccccgtttacgggtccaaccgttttcccttacggtttccccccaacccctttcccgtacgaaacccgggttaccgttaacgtccgtaaccggttacgggaccgggtcccggggtaccgttacggggaaccgaacgggtccgtaccggtaagtcggacncgatacgnagtgcntncnncncncgactatacgnnagcgcncgcnngtgngtcgngcgacgcgngcncgcgnngcncgtcncncncncncgn

SEQ ID NO: 132920 - DNA, 586 bp, Homo sapiens
  misc_feature: GYAE6OF01AI49V.9.34.D01.1.454.CMB.1.raw
  modified_base (236)..(236): a, c, t, g, unknown or other
  misc_feature (236)..(236): n is a, c, g, or t
  modified_base (565)..(568): a, c, t, g, unknown or other
  misc_feature (565)..(568): n is a, c, g, or t
  modified_base (570)..(586): a, c, t, g, unknown or other
  misc_feature (570)..(586): n is a, c, g, or t
tcagtgatacgtctcacgaccggtgctcgatttagatcgtctgtgttgggtttggggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggnggcatatgggaagtacgtattttcgactccctccgcagtcgactactttgattacgtcgggggccgggtaacccgtggtccgccgtcctcctcacgccctccacccgaacggggccccacgttccggtcccttcccccgtcggccctaccccttcctacccgaacgacgccctacccgtccggtcgggggccacgacggccgggccccgtgggccgtcgcccgtcgggtaccgaacggtacccttaccgtttaccgacggtaccggttactcctacgtgggacggccggggccgtagggaccgtaaacggggcccgacgacgttaggcnnnngnnnnnnnnnnnnnnnnn

SEQ ID NO: 132921 - DNA, 606 bp, Homo sapiens
  misc_feature: GYAE6OF01BZIZN.9.34.D01.1.454.CMB.1.raw
  modified_base (141)..(141): a, c, t, g, unknown or other
  misc_feature (141)..(141): n is a, c, g, or t
  modified_base (199)..(199): a, c, t, g, unknown or other
  misc_feature (199)..(199): n is a, c, g, or t
  modified_base (567)..(567): a, c, t, g, unknown or other
  misc_feature (567)..(567): n is a, c, g, or t
  modified_base (577)..(577): a, c, t, g, unknown or other
  misc_feature (577)..(577): n is a, c, g, or t
  modified_base (588)..(588): a, c, t, g, unknown or other
  misc_feature (588)..(588): n is a, c, g, or t
  modified_base (593)..(606): a, c, t, g, unknown or other
  misc_feature (593)..(606): n is a, c, g, or t
tcagtgatacgtctcacgaccggtgctcgatttagatcgtctgtgttgggtttggattcacgttgcagatgtaggtctgggtcgcaggcatcgctgggtggcggtcatgacacattctacgcaaactccgtggaggggccncttcatcatctccagagacaattcccagaacatactgtctctgacaactcaataaccngagaggcgaggacacggctatttattctgtgacgaggagctatagtgggaagtacgttagttttcgactccctcgcagtcgacttactttagacttacggtcgggggtacccgggaacccgtcggttaccgccgttaccgtccgtacgacgtccctaccccaccggaaaccgggcccctaagtccggttcccttcccccggtagccccgtacccctccgaacccgaaacgcgacccgtacccgtcggacgggggtccaaccgcggcccgggtcccgttcggcgtcgtccgtacggtacaaacggtaccttaaccttccggaagtactacgtacgtagacggccggtacggcgtacggaccgaggtacncgaagtagcnacgtgcagtancagtnnnnnnnnnnnnnn

SEQ ID NO: 132922 - DNA, 635 bp, Homo sapiens
  misc_feature: GYAE6OF01EBTDK.9.34.D01.1.454.CMB.1.raw
  modified_base (106)..(106): a, c, t, g, unknown or other
  misc_feature (106)..(106): n is a, c, g, or t
  modified_base (284)..(284): a, c, t, g, unknown or other
  misc_feature (284)..(284): n is a, c, g, or t
  modified_base (534)..(534): a, c, t, g, unknown or other
  misc_feature (534)..(534): n is a, c, g, or t
tcagtgatacgtctcacgaccggtgctcgatttagatcgtctgtgttgggtttgggggaggcttggtccagcctggggagtccctgcgactctcctgtgtggcctntggattcacctttgagacctatgccttgacctgggtccgccagggctccgaggggagggactggagtgggtcgcaggcatcgctggtggcggtcatgacactattctacgacaaactccgtagacggggcctcttcatcactctccagagacaacttccaagaacatactagtctctnactaactacaactaaccgtgaggacggcgaacggacgacggtacttattttatttccgtgtacgacggaagggacggactagtaggtagggaaacgttacgttatttacgaacttcccgacgtcacgtacgtacctagtttacgtacgttacgggtccggggtacccggtacccgtggtcccgtccgtcttcctacgcctacctaccgaaccgaccgggcctaccgtccggttaccctcccgtcgtcccnccctaccaccaacacgacctaccgtgcggacacgcgccggtccgtcggctacgtcgtagacgtacgaccttcgtaccgacgtactactacgtgcggacggg

SEQ ID NO: 132923 - DNA, 813 bp, Homo sapiens
  misc_feature: GYAE6OF01AUQEQ.9.34.D01.1.454.CMB.1.raw
  modified_base (252)..(252): a, c, t, g, unknown or other
  misc_feature (252)..(252): n is a, c, g, or t
  modified_base (759)..(759): a, c, t, g, unknown or other
  misc_feature (759)..(759): n is a, c, g, or t
  modified_base (764)..(764): a, c, t, g, unknown or other
  misc_feature (764)..(764): n is a, c, g, or t
  modified_base (769)..(769): a, c, t, g, unknown or other
  misc_feature (769)..(769): n is a, c, g, or t
  modified_base (776)..(776): a, c, t, g, unknown or other
  misc_feature (776)..(776): n is a, c, g, or t
tcagtgatacgtctcacgaccggtgctcgatttagatcgtctgtgttgggtttgggattcacgttgcagatgtaggtctgggtcgcaggcatcgctggtggcggtcatgtacacattctacgcaaactccgtgacggggccgtcttacatcactcgtcctaggagactacttcccagaaccatacctgtctctgaccaactcgaactaccgtgacgacggccgaggtacaccggtacctatttttacttcgnggttcggaccgtaaggacgacttacttaggtagggtaagtaccgttacgttttccggactcccctaccggctacggtacggaacgttacttttaggacttttacggggtccgggggacccgggtaacccgttcggttaccgtcccgtttccgtacccgtacggaccggttccctacccgtaaccggaaccgggtaccccttaacgtttcccggggttaccccgttttccccccggaggggttacccctaacccccggttccgtaaacccggaaacggtaccggtacccgtaaccccggttccgggtaacggggggacccttaaccgggaccggtaccccggggtcccggttacgggacccgttaccggtccgggttacgggtaacccgtaaacggtacccgttaaccgttaacccggaacgggtaccctttacgaccgtaaccgtagggaccgggtccgggtacgtacgggtacccggaaggtccgtactaacgtggctgacgcgcngtacncgttnccgttanccgattcaagttccgagtccaagggtcaacgggtcag

SEQ ID NO: 132924 - DNA, 173 bp, Homo sapiens; identical to SEQ ID NO: 132720
  misc_feature: GYAE6OF02ID88N.9.34.D01.1.454.CMB.1.raw
  modified_base (173)..(173): a, c, t, g, unknown or other
  misc_feature (173)..(173): n is a, c, g, or t

SEQ ID NO: 132925 - DNA, 463 bp, Homo sapiens
  misc_feature: GYAE6OF02GC6R2.9.34.D01.1.454.CMB.1.raw
  modified_base (455)..(463): a, c, t, g, unknown or other
  misc_feature (455)..(463): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctggggcacagcggccctgggctgcctggtcaaggactacttccagacgtatcactgagcgggctggcaaggcgcatagnnnnnnnnn

SEQ ID NO: 132926 - DNA, 386 bp, Homo sapiens
  misc_feature: GYAE6OF02GI0LD.9.34.D01.1.454.CMB.1.raw
  modified_base (383)..(386): a, c, t, g, unknown or other
  misc_feature (383)..(386): n is a, c, g, or t
tcagtgatacgtctcacgaccggtgctcgatttagatcgtctgtgttgggtttggggggcacgttatgatgtacactggtaccaacaacttccaggaacagccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccaccctcctcagacgtatcactgagcgggctggcaaggcgcatagnnnn

SEQ ID NO: 132927 - DNA, 243 bp, Homo sapiens
  misc_feature: GYAE6OF02GBUE9.9.34.D01.1.454.CMB.1.raw
  modified_base (217)..(243): a, c, t, g, unknown or other
  misc_feature (217)..(243): n is a, c, g, or t
tcagtgatacgtctcacgaccggtgctcgatttagatcgtctgtgttggggtttgggctgactattactgccagtcgtatgacagtggcctaagtaacatcgtcttcggaactgggaccaaggtcaccgtccgtgggtcagcccaaggccaacccactgtcactctgttcccgccctcctcagacgtatcactgagcgggctggcaaggcgcatagnnnnnnnnnnnnnnnnnnnnnnnnnnn

SEQ ID NO: 132928 - DNA, 504 bp, Homo sapiens
  misc_feature: GYAE6OF02GVGI3.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccagcagcttccaggaacacgtccccaaaccctcatctatggtaatagtaatcggccctcacggggtccctgaccgattctctggctccaagtctggcacctcagccctccctggccatcactgggcttcgaggctgagatgaggctgtattattactgtccacttcctatgacagcagcctaggacgtaagttgtggtattcgggacggagggaccagcgtacgg

SEQ ID NO: 132929 - DNA, 580 bp, Homo sapiens
  misc_feature: GYAE6OF02GWHKL.9.34.D01.1.454.CMB.1.raw
tcagtgatacgtctcacgaccggtgctcgatttagatcgtctgtgttggggtttggggaggcttggtccagcctggggagtccctgcgactcctcctgtgtggcctcctcggacttcacctttgagacctatgccttggacctgggtccgccgaggctccgaggggagggactggagtggggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgattccctcgcagtcgactactttgattacgtggggccggggaacctggtccgccgtctcctcacgcctccaccgaacgggcccatccggtccttcccccgtggccaccctcctccaacgcgccaccgtcgtcgggggccacgagccggcccgtgggcctcggcccgttcggtcaacgggaccttaccttccgaacggtaccgttactccgtacgtggacgg

SEQ ID NO: 132930 - DNA, 468 bp, Homo sapiens
  misc_feature: GYAE6OF02G794O.9.34.D01.1.454.CMB.1.raw
  modified_base (462)..(468): a, c, t, g, unknown or other
  misc_feature (462)..(468): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatactgggaagtacgattttcgatccctccgcagtcgacactttgattacgtggggccggggaacctggtcgccgtctcctcacgcctccaccaagggcccatcggtcttcccctgggccaccctcctccaagacgcaccgtctggggcacgagccggccctgggctgcctggtcaaggctacttccagacgtatcactgagcgggctggcaaggcgcagtagnnnnnnn

SEQ ID NO: 132931 - DNA, 474 bp, Homo sapiens
  misc_feature: GYAE6OF02G97LI.9.34.D01.1.454.CMB.1.raw
  modified_base (452)..(452): a, c, t, g, unknown or other
  misc_feature (452)..(452): n is a, c, g, or t
  modified_base (457)..(474): a, c, t, g, unknown or other
  misc_feature (457)..(474): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctccaccaaggcccatcggtcttccccctggcaccctcctccaacgacgcacctctcgggggcacgagcggccctgggctgcctggtcaaggactactccagacgtatcactgagcggctggcaaggcgnatagnnnnnnnnnnnnnnnnnn

SEQ ID NO: 132932 - DNA, 535 bp, Homo sapiens
  misc_feature: GYAE6OF02JBOZ6.9.34.D01.1.454.CMB.1.raw
  modified_base (319)..(319): a, c, t, g, unknown or other
  misc_feature (319)..(319): n is a, c, g, or t
  modified_base (393)..(393): a, c, t, g, unknown or other
  misc_feature (393)..(393): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacacgcccccaaagtcatcatttangacaacatgaagcggccctcgacggggtcccctgaccgattctccggctccaagtctggcacatcagcctcccngccatcacgtgggctccgaggctgagatgaggctgacttattactgcctagtcgtatcgactaggtcggaccttaaagtaactacgttccgttacgttaccgggaacgttcgggaaccctaagggtccctacccggttccgg

SEQ ID NO: 132933 - DNA, 557 bp, Homo sapiens
  misc_feature: GYAE6OF02GXXPO.9.34.D01.1.454.CMB.1.raw
  modified_base (370)..(370): a, c, t, g, unknown or other
  misc_feature (370)..(370): n is a, c, g, or t
tcagtgatacgtctcacgaccggtgctcgatttagatcgtctgtgttgggtttgggcatgtgtgagttttgtcacaagatttgggctcaactttcttgtccaccttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccattttattctgtgcgaaggnggcatagtgggagtacgtattttcgatccctccgcagtcgactactttgattacgtgggccgggaacctggtccgccgtctcctcgacgtcctccaccgacgggcccagtccggtcccttcccctcggccctaccccgttcctacccaacgacgccaccgtcgtcggggccacgacgccggtcccgg

SEQ ID NO: 132934 - DNA, 468 bp, Homo sapiens
  misc_feature: GYAE6OF02HCKV5.9.34.D01.1.454.CMB.1.raw
  modified_base (459)..(468): a, c, t, g, unknown or other
  misc_feature (459)..(468): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaacgagcacctctgggggcacagcggccctgggctgcctggtcaaggactacttccagacgtatcactgagcgggctggcaaggcgcagtagnnnnnnnnnn

SEQ ID NO: 132935 - DNA, 528 bp, Homo sapiens
  misc_feature: GYAE6OF02IHYAL.9.34.D01.1.454.CMB.1.raw
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcagggtccctgaccgattctccggctccaagtctggcacatcagcctccctggccatcactgggctccaggctgagatgagctgactattactgccagccgtatgacagtgcctaagtaacagttccgtcgttcggacttcgggaccaagggtccaccggttcccgtgggtaccgacggccccaacgggcccaaaccccgtactcgtaccc

SEQ ID NO: 132936 - DNA, 528 bp, Homo sapiens
  misc_feature: GYAE6OF02F0QY4.9.34.D01.1.454.CMB.1.raw
  modified_base (456)..(456): a, c, t, g, unknown or other
  misc_feature (456)..(456): n is a, c, g, or t
tcagtgatacgtctcacgaccggtgctcgatttagatcgtctgtgttggggtttggggaggcgttgggtccagcctgggggagtccctgcgactctcctgtgtggcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatccggtcttcccctggccgccctgctccagngcacctcgagagcacagcgcctggctgcctgtcaggactactccagacgtatcactgagcggctggcaacgg

SEQ ID NO: 132937 - DNA, 540 bp, Homo sapiens
  misc_feature: GYAE6OF02GXOC1.9.34.D01.1.454.CMB.1.raw
  modified_base (338)..(338): a, c, t, g, unknown or other
  misc_feature (338)..(338): n is a, c, g, or t
  modified_base (413)..(413): a, c, t, g, unknown or other
  misc_feature (413)..(413): n is a, c, g, or t
tcagtgatacgtctcacgaccggtgctcgatttagatcgtctgtgttgggtttgggacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggaccctcaggggtccctgaccgattcnccggctccaagtctggcacatcagcctcctggccatcactgggcctccaggctgaggatgagctgacttattacngccagtcgtatcgacaggtcggaccttaaagtaacagtccgttcttacgggaactcggggaaccaagggtcctaacccggtccgtcgggtcacggaccccgaaggccccaaaccccgcttagtaccc

SEQ ID NO: 132938 - DNA, 565 bp, Homo sapiens
  misc_feature: GYAE6OF02IHJ54.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgactactttgatttacgtggggccgggaaccgtggtcgccgtctcctcacgcctccaccgaacgggcccagtccggtccttccccctggccaccctcctccaacgcgccacctcgtcggggccacgacgccggcccgtcgggctcggccgtcggtacaacggtacctaccgttccgacgtaccgttactcacgtgacggg

SEQ ID NO: 132939 - DNA, 462 bp, Homo sapiens
  misc_feature: GYAE6OF02H6DGP.9.34.D01.1.454.CMB.1.raw
  modified_base (453)..(462): a, c, t, g, unknown or other
  misc_feature (453)..(462): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaacctggtcgccgtctcctcagcctcaccaaggcccatcggtcttccccctggcaccctcctccaagagcacctctgggggcacagcggccctgggctgcctggtcaaggctacttccagacgtatcactgagcgggctggcaaggcgcatagnnnnnnnnnn

SEQ ID NO: 132940 - DNA, 465 bp, Homo sapiens
  misc_feature: GYAE6OF02GJY4M.9.34.D01.1.454.CMB.1.raw
  modified_base (452)..(465): a, c, t, g, unknown or other
  misc_feature (452)..(465): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccattttatttctgtgcgaaggaggcatatgggaagtacgattttcgatccctccgcagtcgacactttgattactggggccggggaaccctggtcgccgtctcctcagcctccaccaaggcccatcggtcttcccctggcaccctcctccaagagcacctctggggcacagcggccctggctgcctggtcaaggactactccagacgtatcactgagcggctggcaaggcgcatagnnnnnnnnnnnnnn

SEQ ID NO: 132941 - DNA, 633 bp, Homo sapiens
  misc_feature: GYAE6OF02GC3CI.9.34.D01.1.454.CMB.1.raw
  modified_base (245)..(245): a, c, t, g, unknown or other
  misc_feature (245)..(245): n is a, c, g, or t
  modified_base (623)..(623): a, c, t, g, unknown or other
  misc_feature (623)..(623): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggccccagggcaggagggtcaccatctcgtgcactggaagtagctccaacatcggggcacgttangtatgtacacgtcgaaccaactactacgacgaaccaccgaccccgtaagtcactactaatttatacgaacaactagtacgaacggcccgtcccgtacggaccgggtccctacggtaccgtacttcccgtcggtcctaccgtacgtcgtacgacacactcgaccgtccctccgtccgactactaccgacggtcgggcctaccggaggtctaggaggtgaggacggtctacgtacttaacgttacgaccgctaggttacgtagacgtacgtagtccgtaactaagtaactcgttccgttacgtacggacgtacggaccgtaaggtccctaccggtcggtacggaccaaccggacccgtaaaccggacccctaacccggtnttccgtaccc

SEQ ID NO: 132942 - DNA, 465 bp, Homo sapiens
  misc_feature: GYAE6OF02HXKIN.9.34.D01.1.454.CMB.1.raw
  modified_base (453)..(465): a, c, t, g, unknown or other
  misc_feature (453)..(465): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctcaccaaggcccatcggtcttccccctggcaccctcctccaagagcacctctggggcacagcggccctgggctcgcctggtcaaggactacttccagacgtatcactgagcggctggcaaggcgcatagnnnnnnnnnnnnn

SEQ ID NO: 132943 - DNA, 522 bp, Homo sapiens
  misc_feature: GYAE6OF02HCT6A.9.34.D01.1.454.CMB.1.raw
  modified_base (231)..(231): a, c, t, g, unknown or other
  misc_feature (231)..(231): n is a, c, g, or t
  modified_base (457)..(457): a, c, t, g, unknown or other
  misc_feature (457)..(457): n is a, c, g, or t
tcagtgatacgtctcacgaccggtgctcgatttagatcgtctgtgttgggtctggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggccatttattctgtgcgaaggaggcatatgggaagtacgatttcgatccctcgcagtcacactttgattacgtggggccgggaaccctggtcgcgtctcctcacgcctccaccaaggcccatccggtcttcccctggcaccctcctccagacnccacctcgtggggcacgagccggcctgggctcgcctggtcaaggctactccagacgtatcactcg

SEQ ID NO: 132944 - DNA, 583 bp, Homo sapiens
  misc_feature: GYAE6OF02G1YHC.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctcgcagtcgactactttgattacgtggggccggggaaccctggtccgccgtctcctcacgccctccaaccgaacgggcccagttccggtccttcccccgtgggcccgccctgccctcccgagggacgccaccgtccgagacgcacgacggcccggccctggggcctcggcccgttgggtaccaaacgggtaccttaccgttacccgaaggtaccgttatcccgtacg

SEQ ID NO: 132945 - DNA, 545 bp, Homo sapiens
  misc_feature: GYAE6OF02IHLHM.9.34.D01.1.454.CMB.1.raw
  modified_base (395)..(395): a, c, t, g, unknown or other
  misc_feature (395)..(395): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccgagggggagggactgggagtgggtcgcgaggcatcgctggtggcggtcatgacacatttcacgcaaactccgtgacggggccncttcatcatctcagagacaattcccaagaacatactgtctctgcaactcaataacctgagaggcgaggacacggcctatttattctgtgacgaaggacggacagtagtaggggaacgtacggtattttcggaacttccccgtacgtaccg

SEQ ID NO: 132946 - DNA, 494 bp, Homo sapiens
  misc_feature: GYAE6OF02JBTRW.9.34.D01.1.454.CMB.1.raw
  modified_base (348)..(348): a, c, t, g, unknown or other
  misc_feature (348)..(348): n is a, c, g, or t
  modified_base (473)..(494): a, c, t, g, unknown or other
  misc_feature (473)..(494): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccgggaaccctggtccgccgtctcctcagcctcaccaggcccatcggtcttccccnggcaccctcctccaagcgcacctctggggcacgagccggccctgggctgcccgtaggtccaagggactaccgttccagaccgtatccacgtgacgcgggcctggcgtaagggccgcgtataggcnnnnnnnnnnnnnnnnnnnnnn

SEQ ID NO: 132947 - DNA, 559 bp, Homo sapiens
  misc_feature: GYAE6OF02F4VSO.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattacgtggggccggggaacccgtggtcgccgtctcctcacgcctccaccaacgggcccatcggtccttccccctggccaccctcctccaacgacgccacctcgtcgggggccacgacgccggcccgtgggcctcggccctcggtcgaacggtacctaccgttccacgaccgtatccactgacgg

SEQ ID NO: 132948 - DNA, 389 bp, Homo sapiens
  misc_feature: GYAE6OF02GZFOF.9.34.D01.1.454.CMB.1.raw
  modified_base (380)..(380): a, c, t, g, unknown or other
  misc_feature (380)..(380): n is a, c, g, or t
  modified_base (386)..(389): a, c, t, g, unknown or other
  misc_feature (386)..(389): n is a, c, g, or t
tcagtgatacgtctcacgaccggtgctcgatttagatcgtctgtgttgggtttggggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggcccaaccccactgtcactctgttccccgccctcctcagacgtatcactgagcgggctggcaaggcncatagnnnn

SEQ ID NO: 132949 - DNA, 469 bp, Homo sapiens
  misc_feature: GYAE6OF02HA7ZE.9.34.D01.1.454.CMB.1.raw
  modified_base (454)..(469): a, c, t, g, unknown or other
  misc_feature (454)..(469): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatggaagtacgatttcgatcctccgcagtcgacactttgattactggggccgggaacctggtcgccgtctcctcagcctccaccaagggcccatcggtcttcccctggcaccctcctccaagagcacctctgggggcacgagcggcccgtgggctgcctggtcaaggactacttccagacgtatcactgagcggctggcgaaggcgcgatagnnnnnnnnnnnnnnnn

SEQ ID NO: 132950 - DNA, 558 bp, Homo sapiens
  misc_feature: GYAE6OF02H8QOJ.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccaggggagggactggagtgggtcgcaggcatcgctggtggcggtcatgacacattctacgcaaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgactactttgatttacgtggggccgggaaccctggtcgccgtctcctcacgcctccaccaacggcccagtccggtccttccccgtggcccaccctcctaccaagacgcaccgtcgtcggggcacgacgccggccgtgggctcggcctggtaccaacggacttaccgttccgacgacgtactccactacgg

SEQ ID NO: 132951 - DNA, 392 bp, Homo sapiens
  misc_feature: GYAE6OF02HCFNX.9.34.D01.1.454.CMB.1.raw
  modified_base (385)..(392): a, c, t, g, unknown or other
  misc_feature (385)..(392): n is a, c, g, or t
tcagtgatacgtctcacgaccggtgctcgatttagatcgtctgtgttgggtttgggggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggcccaacccactgtcactctgttccccaccctcctcagacgtatcactgagcggctggcaaggcgcatagnnnnnnnn

SEQ ID NO: 132952 - DNA, 502 bp, Homo sapiens
  misc_feature: GYAE6OF02J1GW6.9.34.D01.1.454.CMB.1.raw
  modified_base (291)..(291): a, c, t, g, unknown or other
  misc_feature (291)..(291): n is a, c, g, or t
  modified_base (483)..(483): a, c, t, g, unknown or other
  misc_feature (483)..(483): n is a, c, g, or t
  modified_base (488)..(502): a, c, t, g, unknown or other
  misc_feature (488)..(502): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgattccctccgcagtcgactactttgattacgngggggccgggaacccgtggtccgccgtcctcctcacgccctccaccgaacggggcccagtccggtccttcccccgtggccaccccgtcctcccaagacgccacctcgtcgggggcacgagccggcccgtgggcctgccctgggtcaagggtactaccttccgagacgtatcactgagcggctggcaggcacntacgnnnnnnnnnnnnnnn

SEQ ID NO: 132953 - DNA, 571 bp, Homo sapiens
  misc_feature: GYAE6OF02HJ49Z.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattacgtggggccgggaacctggtcgccgtctcctcacgcctccaccaacgggcccagtccggtccttccccgtggccgccctgcctccgaggacgccacctccgagacgcacacggccggccctggggcctcggcccgttgggtacccgaagggtacccttaaccgttcccgaaggtacccgttatcccgtaaccg

SEQ ID NO: 132954 - DNA, 513 bp, Homo sapiens
  misc_feature: GYAE6OF02JEQ1B.9.34.D01.1.454.CMB.1.raw
  modified_base (452)..(452): a, c, t, g, unknown or other
  misc_feature (452)..(452): n is a, c, g, or t
  modified_base (507)..(507): a, c, t, g, unknown or other
  misc_feature (507)..(507): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcgaggggtccctgaccgattctccggctccagtctggcacatcacgccctcctggccatcacgtgggctccgaggctgagatggacggctgacttattacgtgcctagtcgtatgacagtcggacctaagtaacntcgtctacggactggaccaaggtccacgtctggtcacgcccaaggcccaaccctntcgtac

SEQ ID NO: 132955 - DNA, 464 bp, Homo sapiens
  misc_feature: GYAE6OF02HBHGZ.9.34.D01.1.454.CMB.1.raw
  modified_base (455)..(464): a, c, t, g, unknown or other
  misc_feature (455)..(464): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccggagacaattcccagaacatactgtctctgcaactcaataacctgagaggcgaggacacggccatttatttctgtgcgaaggaggcatatgggaagtacgattttcgatcctccgcagtcgacactttgattactggggccggggaaccctggtcgccgtctcctcagcctcaccaagggcccatcggtcttcccctggcaccctcctccaagacgcacctctgggggcacagcggccctgggctgcctggtcaaggactacttccagacgtatcactgagcgggctggcaaggcgcatagnnnnnnnnnn

SEQ ID NO: 132956 - DNA, 551 bp, Homo sapiens
  misc_feature: GYAE6OF02IT1KP.9.34.D01.1.454.CMB.1.raw
tcagtgatacgtctcacgaccggtgctcgatttagatcgtctgtgttgggtttgggcatgtgtgagttttgtcacaagatttgggctcaactttcttgtccaccttggtccagcctggggagtccctgcgactctcctgtgtggcctctggattcaccttttgagacctatgccttgacctgggtccgccaggctccaggggagggactggagtgggtcgcaggcatcgctggtggcggtcatgacacattcacgcaaactccgtgaggggccgcttcatcatctccagagacaattcccagaacatactgtctctgcaacttaataacctgagagcgagacacggcctatttatttctgtgacgaaggagcatagtgggaagtacgatttacgatccctcgcagtcgactacttgattacgtggggcccgggaacctcggtcgccgtctcctcagccctccaccgaacggcccactccggtccttccccgtggcctaccctccctaccacgacgccgacctcgtcggggaccacgacgccggccctcggg

SEQ ID NO: 132957 - DNA, 428 bp, Homo sapiens
  misc_feature: GYAE6OF02HZB04.9.34.D01.1.454.CMB.1.raw
  modified_base (303)..(303): a, c, t, g, unknown or other
  misc_feature (303)..(303): n is a, c, g, or t
  modified_base (423)..(423): a, c, t, g, unknown or other
  misc_feature (423)..(423): n is a, c, g, or t
  modified_base (425)..(428): a, c, t, g, unknown or other
  misc_feature (425)..(428): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactatactgccagtcgtatgacagtggacctaagtaacntcgtcttcggaactgggaaccaaggtcaccgtcctgggtcacgcccaaggcccaaccccatcgtcactctcgttccccgccctcctcacgacgtatcactgagcgggctggcaggcgcangnnnn

SEQ ID NO: 132958 - DNA, 504 bp, Homo sapiens
  misc_feature: GYAE6OF02I7010.9.34.D01.1.454.CMB.1.raw
  modified_base (264)..(264): a, c, t, g, unknown or other
  misc_feature (264)..(264): n is a, c, g, or t
  modified_base (313)..(313): a, c, t, g, unknown or other
  misc_feature (313)..(313): n is a, c, g, or t
  modified_base (431)..(431): a, c, t, g, unknown or other
  misc_feature (431)..(431): n is a, c, g, or t
  modified_base (446)..(446): a, c, t, g, unknown or other
  misc_feature (446)..(446): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttangatgtacactggtaccaacacttcaggacagccccaaagtcatcattangacacatgaagccgccctcgaggggtccctgaccgattctcccggctccaagtctggcacatcacgcctccctggccatccacgtgggctccgagctgagatgagctgacttattacngccagtcgtatgacngtcggctaagtaacattccgtacgttcggacttcgggacctaagggtccacccgtccg

SEQ ID NO: 132959 - DNA, 474 bp, Homo sapiens
  misc_feature: GYAE6OF02HK7MO.9.34.D01.1.454.CMB.1.raw
  modified_base (454)..(474): a, c, t, g, unknown or other
  misc_feature (454)..(474): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatggaagtacgattttcgatccctccgcagtcgacactttgattactggggccgggaaccctggtcgccgtctcctcagcctccaccaagggcccatcggtcttcccctggcaccctcctccaagacgcacctctgggggcacagcggccctgggctgcctggtcaaggactactccagacgtatcactgacgcgggctggcaaggcgcatagnnnnnnnnnnnnnnnnnnnnn

SEQ ID NO: 132960 - DNA, 493 bp, Homo sapiens
  misc_feature: GYAE6OF02I47IW.9.34.D01.1.454.CMB.1.raw
  modified_base (474)..(493): a, c, t, g, unknown or other
  misc_feature (474)..(493): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctcgcagtcgacactttgattacgtggggccggggaaccctggtccgccgtctccctcagccctccaccaaggggcccatccggtccttccccctggcccacccctcctccaagacgccaccctcgtcgggggcacgagccggccctgggctgcctggtcaaggctacttccagtacgtatcactgacgcgggctggcaaggcgcagtagnnnnnnnnnnnnnnnnnnnn

SEQ ID NO: 132961 - DNA, 464 bp, Homo sapiens
  misc_feature: GYAE6OF02F7QIW.9.34.D01.1.454.CMB.1.raw
  modified_base (446)..(446): a, c, t, g, unknown or other
  misc_feature (446)..(446): n is a, c, g, or t
  modified_base (452)..(464): a, c, t, g, unknown or other
  misc_feature (452)..(464): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctccaccaaggcccatcggtcttccccctggcaccctcctccaagacgcacctctggggcacagcggcctgggctgcctggtcaaggctactccagacgtatcactgagcgggctggcaaggcncatagnnnnnnnnnnnnn

SEQ ID NO: 132962 - DNA, 602 bp, Homo sapiens
  misc_feature: GYAE6OF02H19TC.9.34.D01.1.454.CMB.1.raw
  modified_base (232)..(232): a, c, t, g, unknown or other
  misc_feature (232)..(232): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgctggcatcgctggtggcggtcatgacacattctacgcaaactccgtgaggggccncttcatcatctccagagacaattcccaagaacatactgtctctgcaactcaataacctgagaggcgaggacacggcctatttattctgtgcgaaggaggcaatagtaggaagtacgtatttcgactccctcgcagtcgactactttgaactttcgcggggccgggaaccgtcggtccggtccgtcctcctccacgccctccaaccgaacgggcccacgttccggttcccgttccccgtcggcccacccctccctacccgaacgacgccacccgttcgtcggggacaccgacgccggcccgtcgggccgtcgccgtcggtaccgaacggtaccttacgttacccgtaagtaccgtactaccgtacgtacgg

SEQ ID NO: 132963 - DNA, 476 bp, Homo sapiens
  misc_feature: GYAE6OF02JAXX3.9.34.D01.1.454.CMB.1.raw
  modified_base (459)..(476): a, c, t, g, unknown or other
  misc_feature (459)..(476): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctcgcagtcgacactttgattacgtggggccgggaaccctggtcgccgtctcctcagcctcaccaaggcccatcggtccttcccctggccacccgtcctccaagacgcacctcgtcggggccacgacgccggccctgggctcgcctggtcaacggctactccagacgtatcatgagcggctggcaaggcgcatagnnnnnnnnnnnnnnnnnn

SEQ ID NO: 132964 - DNA, 496 bp, Homo sapiens
  misc_feature: GYAE6OF02H03EP.9.34.D01.1.454.CMB.1.raw
  modified_base (451)..(451): a, c, t, g, unknown or other
  misc_feature (451)..(451): n is a, c, g, or t
  modified_base (477)..(477): a, c, t, g, unknown or other
  misc_feature (477)..(477): n is a, c, g, or t
  modified_base (484)..(496): a, c, t, g, unknown or other
  misc_feature (484)..(496): n is a, c, g, or t
tcagtgatacgtctcacgaccggtgctcgatttagatcgtctgtgttgggtttgggattcacgttgcagtatggtaggtcgtgggtcgcaggccagtcgctggtggcggtacatgacacattctacgcaaactccgtgaggggccgcttcatcatctccagagacaattcccagaacatactgtctctgcaactcaataaccgtcgaggaggcgaggacacggccatttatttctcgtcgcgaaggaggccatactgggaagtacgaattttcgatcctccgcagtcgacactttgattacgtggggcccggggtaaccgtggtccgccgtacgtcctcgacgtcctccacgaggcccatcggtctccccctggccaccctcctaccgaagacgcacctcgtcggggcacgagccgcctgggctgcctggtcaaggctacttcagacgtancactgagcggcgtggactaacgggcncagtagnnnnnnnnnnnnn

SEQ ID NO: 132965 - DNA, 465 bp, Homo sapiens
  misc_feature: GYAE6OF02FKM0L.9.34.D01.1.454.CMB.1.raw
  modified_base (455)..(465): a, c, t, g, unknown or other
  misc_feature (455)..(465): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctggggcacagcggccctgggctgcctggtcaaggactacttccagacgtatcactgagcgggctggcaaggcgcatagnnnnnnnnnnn

SEQ ID NO: 132966 - DNA, 565 bp, Homo sapiens
  misc_feature: GYAE6OF02GBK5C.9.34.D01.1.454.CMB.1.raw
  modified_base (276)..(276): a, c, t, g, unknown or other
  misc_feature (276)..(276): n is a, c, g, or t
tcagtgatacgtctcacgaccggtgctcgatttagatcgtctgtgttgggtttgggcatgtgtgagttttgtcacaagatttgggctcaactttcttgtccaccttggtccagcctggggagtccctgcgactctcctgtgtggcctctggattcacctttgagacctatgccttgacctgggtccgccaggctccgagggggagggactgggagtgggtcgcaggcatcgctggtggcggtcatgacacattcacgcaaactccgtgaggggccncttcatcatctccagagacaattcccagaacatactgtctctgcaactcaataacctgagaggcgagacacggctatttattctgtgacgaaggaggcatagtgggaagtacgtatttcgactccctcgctagtcgactacgtttgacttacgtcggggaccgggaaccgtggtccgccgtctcctcgacgcctccaccgacggcccacgtccgtccttccccgtcggccctaccctcctacccaacgaccgaccacccgtcgtacggggcaccgacgcccggtcccgg

SEQ ID NO: 132967 - DNA, 164 bp, Homo sapiens
  misc_feature: GYAE6OF02I3PTB.9.34.D01.1.454.CMB.1.raw
  modified_base (164)..(164): a, c, t, g, unknown or other
  misc_feature (164)..(164): n is a, c, g, or t
tcagtgatacgtctcacgaccggtgctcgatttagatcgtctgtgttgggtttggtggtctccactcccgccttgacgggctgccatctgccttccaaccccactgtcactctgttcccgccctcctcagacgtatcactgagcgggctggcaaggcgcatagn

SEQ ID NO: 132968 - DNA, 465 bp, Homo sapiens
  misc_feature: GYAE6OF02GVKBF.9.34.D01.1.454.CMB.1.raw
  modified_base (427)..(427): a, c, t, g, unknown or other
  misc_feature (427)..(427): n is a, c, g, or t
  modified_base (454)..(465): a, c, t, g, unknown or other
  misc_feature (454)..(465): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagacgcacctctgggggcacagccggccctgggctgcctggtcaaggctactccagacgtancactgagcggctggcaaggcgcatagnnnnnnnnnnnn

SEQ ID NO: 132969 - DNA, 535 bp, Homo sapiens
  misc_feature: GYAE6OF02HRIXE.9.34.D01.1.454.CMB.1.raw
  modified_base (379)..(379): a, c, t, g, unknown or other
  misc_feature (379)..(379): n is a, c, g, or t
  modified_base (433)..(433): a, c, t, g, unknown or other
  misc_feature (433)..(433): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccagcagcttaccaggaaaacgtcccccaaaccctcatctataggtaatagtaatccggccctcgacggggtccctggacccgattctctggcctccaagtctggcacctcagccctcccnggcccatccacgtgggccttcgaggctaggaggatggaggctagatttactacngacccactcctatgacagcagtccgtgagtaagtggtgtattcgggacggaggaccaagcctgaccgttctaggtccaggcccaaggcctaccgcccctcgg

SEQ ID NO: 132970 - DNA, 560 bp, Homo sapiens
  misc_feature: GYAE6OF02I0PIQ.9.34.D01.1.454.CMB.1.raw
  modified_base (231)..(231): a, c, t, g, unknown or other
  misc_feature (231)..(231): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccncttcatcatctccagagacaattcccagaacataactgtctctgcaactcaataacctgagaggcgaggacacggccagtttattctgtgcgaaggaggcagtatggaagtacgtattttcgatccctcgcagtcgacactttgattacgtggggccgggaacctggtcgccgtctcctcacgcctccaccgaacgggcccagtccggtccttccccgtgccaccctcctaccagacgctacctcgtcggggctacgacgccgacccgtgggccgtcgccgtggacgtaacgtaccgttacgttccgagtaccgtaactccgactacgg

SEQ ID NO: 132971 - DNA, 497 bp, Homo sapiens
  misc_feature: GYAE6OF02I7HCW.9.34.D01.1.454.CMB.1.raw
  modified_base (449)..(449): a, c, t, g, unknown or other
  misc_feature (449)..(449): n is a, c, g, or t
  modified_base (479)..(497): a, c, t, g, unknown or other
  misc_feature (479)..(497): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccattttatttctgtgcgaaggaggcatatggaagtacgatttcgatccctccgcagtcgacactttgattacgtggggccggggaacccgtggtccgccgtctcctcacgcctccaccaacggcccactccggtccttccccctcggccaccctccctccaacgacgccaccctcgtcgggggcacgacgccggcccgtgggctgcctggtcaacggactacttccagacgtancactgacgcgggctcggcaggcgcagtagnnnnnnnnnnnnnnnnnnn

SEQ ID NO: 132972 - DNA, 529 bp, Homo sapiens
  misc_feature: GYAE6OF02G7BBF.9.34.D01.1.454.CMB.1.raw
  modified_base (417)..(417): a, c, t, g, unknown or other
  misc_feature (417)..(417): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacacgaccccaaagtcatcatttatgacaacatgaagcgcctcgacggggtccctgaccgtattctccggctccgaagtctggcacatcacgcctccctggccatcacgtgggctccgaggcngaggatgaggctgacttattactgacctagtcgtagtgacgtaggtcggacctaagtaactagtcgttacgttacggaacgttcgggaacctaacgggtccacccggtccgg

SEQ ID NO: 132973 - DNA, 556 bp, Homo sapiens
  misc_feature: GYAE6OF02GW741.9.34.D01.1.454.CMB.1.raw
  modified_base (245)..(245): a, c, t, g, unknown or other
  misc_feature (245)..(245): n is a, c, g, or t
  modified_base (437)..(437): a, c, t, g, unknown or other
  misc_feature (437)..(437): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacagtcggggcacgttangatgtacactggtaccaacaacttccaggaacacgacccccaaagtcatcatttatgaacaacatgaagcggccctcgacggggtccctgaccgtattcctccggctccaagtctcggcacatcacgccctcccgtggccatccacgtcgggcctccgaggcctggaggatggaggtctagacttattaccngcctagtcgtatgactagtcggaccttaagtaacagtcgttcgtacggacgtgggaacctaaggtccaccggtcgtcgggtacacggacccgaacggaccccaaccctacgtcgtaccc

SEQ ID NO: 132974 - DNA, 514 bp, Homo sapiens
  misc_feature: GYAE6OF02HD92L.9.34.D01.1.454.CMB.1.raw
  modified_base (320)..(320): a, c, t, g, unknown or other
  misc_feature (320)..(320): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaaccaacaacttccaggaacacgcccccaaagtcatcatttangacaacatagaagccggccctcgacggggtccctgaccgattctccggctccaagtctggcacatcacgcctccctggccatcactgggctccgaggctgagntgagctgactattacngccagtcgtatgacaggtggcctaagtaacagttcgttcgttacggaacgtcgggaccaacggtccaccggtccg

SEQ ID NO: 132975 - DNA, 175 bp, Homo sapiens
  misc_feature: GYAE6OF02HAYNY.9.34.D01.1.454.CMB.1.raw
  modified_base (174)..(175): a, c, t, g, unknown or other
  misc_feature (174)..(175): n is a, c, g, or t
tcagtgatacgtctcacgaccggtgctcgatttagatcgtctgtgttgggtttgggggaagaggaagactgacggtccccccaggagttcaggtgctgggcacagcggccctgggctgcctggtcaaggactacttccagacgtatcactgagcgggctggcaaggcgcatagnn

SEQ ID NO: 132976 - DNA, 563 bp, Homo sapiens
  misc_feature: GYAE6OF02F8XZH.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatagtgggaaagtacgtatttcgactcccctcgcagtcgactactttgattacgtggggccgggaacctggtcgccgtctcctcacgcctccaccgacggccagtcgtccttccccgtggcccaccctcctaccaacgcgccacctcgtcggggcacgagccggcccgtgggctcggccgtgggtaccaacggtaccttacgttaccgacggtaccgtactccgacgtacggg

SEQ ID NO: 132977 - DNA, 558 bp, Homo sapiens
  misc_feature: GYAE6OF02GCOAI.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatagtgggaagtacgtattttcgatccctcgcagtcgacactttgattacgtggggccgggaaccgtcggtcgccgtctcctcacgcctccaccacggcccagtccggtccttccccgtcgccaccctcctccaagacgccaccgtcgtcggggcacgacgtcggcccgtggctcggccgtcggtacaacggtactacgttaccgacggtacgtactcgactggacgg

SEQ ID NO: 132978 - DNA, 574 bp, Homo sapiens
  misc_feature: GYAE6OF02G5J7T.9.34.D01.1.454.CMB.1.raw
  modified_base (232)..(232): a, c, t, g, unknown or other
  misc_feature (232)..(232): n is a, c, g, or t
  modified_base (329)..(329): a, c, t, g, unknown or other
  misc_feature (329)..(329): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggccattttattctgtgcggaaggnggcatagtgggaagtacgtatttcgattcccctcgcagtcgactactttgatttacgcggggccgggaaccgtggtcgccgtctcctcacgtcctccaccgacggacccacgttccggttccttcccccgtcggccctaccctccctacccagacgctaccgtcgtcggggcacgcgccggccgtcggcgtcgtccgtcggtaccgaacggtacctaccttccgacgtacgtactacacgtacgg

SEQ ID NO: 132979 - DNA, 548 bp, Homo sapiens
  misc_feature: GYAE6OF02ICZIS.9.34.D01.1.454.CMB.1.raw
  modified_base (232)..(232): a, c, t, g, unknown or other
  misc_feature (232)..(232): n is a, c, g, or t
  modified_base (327)..(327): a, c, t, g, unknown or other
  misc_feature (327)..(327): n is a, c, g, or t
  modified_base (458)..(458): a, c, t, g, unknown or other
  misc_feature (458)..(458): n is a, c, g, or t
  modified_base (479)..(479): a, c, t, g, unknown or other
  misc_feature (479)..(479): n is a, c, g, or t
  modified_base (492)..(492): a, c, t, g, unknown or other
  misc_feature (492)..(492): n is a, c, g, or t
tcagtgatacgtctcacgaccggtgctcgatttagatcgtctgtgttgggtctggggaggcttggtccagcctggggagtccctgcgactctcctgtgtggcctctggattcacctttgagacctatgccttgacctgggtccgccaggctccaggggagggactgggagtgggtcgcaggcatcgctggtggcggtcatgacacattctacgcaaactccgtgaggggccncttcatcatctccagagacaattcccagaacatactgtctctgcaactcaataacctgagaggcgaggacacggccatttattctgtgcgaaggngcatatggaagtacgatttcgatccctcgcagtcactactttgactttacgtgggggcccggggtaaccctgggtccgtccgtctcctccagtccctccaaccaacgggccccagtcggtcccttccccgnggccgccctgcctccaggacnccgacctccgganacgcagacgcggccctgggcctcgccgtgcaacggcctacttccgagacttatccg

SEQ ID NO: 132980 - DNA, 166 bp, Homo sapiens
  misc_feature: GYAE6OF02H6UO5.9.34.D01.1.454.CMB.1.raw
  modified_base (165)..(166): a, c, t, g, unknown or other
  misc_feature (165)..(166): n is a, c, g, or t
tcagtgatacgtctcacgaccggtgctcgatttagatcgtctgtgttgggtttggtggtctccactcccgccttgacggggctgccatctgccttccaaccccactgtcactctgttcccgccctcctcagacgtatcactgagcgggctggcaaggcgcatagnn

SEQ ID NO: 132981 - DNA, 554 bp, Homo sapiens
  misc_feature: GYAE6OF02G8YK9.9.34.D01.1.454.CMB.1.raw
  modified_base (529)..(529): a, c, t, g, unknown or other
  misc_feature (529)..(529): n is a, c, g, or t
  modified_base (534)..(539): a, c, t, g, unknown or other
  misc_feature (534)..(539): n is a, c, g, or t
  modified_base (541)..(554): a, c, t, g, unknown or other
  misc_feature (541)..(554): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgacttacgtgggggccggggaacccgtggtcgccgtctcctcagcctccaccgaacgggcccagtccggtccttccccctggccacccctcctcccaacgagccaccctcgtcgggggccacgacggccggcccgtggggtcctcggcccgtgggtaccgaaagggtaccttaccgtttcccgaaggtaccgttatccacgttcggaggtccgggcgtcgggaccgaaaggggccgactagtaaggnacgcnnnnnngnnnnnnnnnnnnnn

SEQ ID NO: 132982 - DNA, 498 bp, Homo sapiens
  misc_feature: GYAE6OF02HYOSC.9.34.D01.1.454.CMB.1.raw
  modified_base (142)..(142): a, c, t, g, unknown or other
  misc_feature (142)..(142): n is a, c, g, or t
  modified_base (476)..(476): a, c, t, g, unknown or other
  misc_feature (476)..(476): n is a, c, g, or t
  modified_base (478)..(486): a, c, t, g, unknown or other
  misc_feature (478)..(486): n is a, c, g, or t
  modified_base (488)..(498): a, c, t, g, unknown or other
  misc_feature (488)..(498): n is a, c, g, or t
tcagtgatacgtctcacgaccggtgctcgatttagatcgtctgtgttggggtttgggattcacgttgcagatgtaggtctgggtcgcaggcatcgctggtggcggtcatgacacattctacgcaaaactccgtgaggggccnctttcatcatctccagagacaattcccagaacatactgtctctgcaactcaataacctgagaggcgaggacacggccattttattcgtgtgcgaaggaggcatatgggaagtacgtattttcgatcccctcgcagtcgacactttgattacgtggggccggggaacctggtcgccgtctcctcagcctcaccaacgggcccagtcggtccttcccctggccaccctctccaagacgcacctcgtggggcacgagccgcctgggctgcctggtcaaaggactacttccgagtacgtatcactgagcgggctgggacaaaggccgacaatagctancnnnnnnnnngnnnnnnnnnnn

SEQ ID NO: 132983 - DNA, 545 bp, Homo sapiens
  misc_feature: GYAE6OF02FLS28.9.34.D01.1.454.CMB.1.raw
  modified_base (381)..(381): a, c, t, g, unknown or other
  misc_feature (381)..(381): n is a, c, g, or t
  modified_base (535)..(535): a, c, t, g, unknown or other
  misc_feature (535)..(535): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgattccctcgcagtcgacactttgattacnggggccgggaccctggtcgccgtctcctcagccctccaccgacggcccagtccggttccttccccgtgccaccctcctaccaagcgccacctcgtcggggcacgcgccgcccgtgggctcgccgtggtcaacggtacctacgtccagaccgtanctactgacgg

SEQ ID NO: 132984 - DNA, 474 bp, Homo sapiens
  misc_feature: GYAE6OF02GVMC5.9.34.D01.1.454.CMB.1.raw
  modified_base (445)..(445): a, c, t, g, unknown or other
  misc_feature (445)..(445): n is a, c, g, or t
  modified_base (461)..(474): a, c, t, g, unknown or other
  misc_feature (461)..(474): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccgggaaccctggtcgccgtctcctcagcctccaccaagggcccatcggtcttccccctggccaccctcctccaacgacgccacctcgtgggggccacgagccggccctgggctgcctggtcaaggctacttccagacgtatcactgagcggntggcaggcgcagtagnnnnnnnnnnnnnn

SEQ ID NO: 132985 - DNA, 497 bp, Homo sapiens
  misc_feature: GYAE6OF02F1RD4.9.34.D01.1.454.CMB.1.raw
  modified_base (289)..(289): a, c, t, g, unknown or other
  misc_feature (289)..(289): n is a, c, g, or t
  modified_base (445)..(445): a, c, t, g, unknown or other
  misc_feature (445)..(445): n is a, c, g, or t
  modified_base (468)..(468): a, c, t, g, unknown or other
  misc_feature (468)..(468): n is a, c, g, or t
  modified_base (476)..(497): a, c, t, g, unknown or other
  misc_feature (476)..(497): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattacgnggggccgggaacctggtcgccgtctcctcacgccctccaccaacgggcccagtccggtccttcccccgtggccacccctcctcccaacgacgccaccgtcgtcgggggcacgacgccggccctgggctgcctggtcaaggctactccgagacgtancactgacgcgggctggcaaggcncgagtagnnnnnnnnnnnnnnnnnnnnnn

SEQ ID NO: 132986 - DNA, 782 bp, Homo sapiens
  misc_feature: GYAE6OF02HQLWN.9.34.D01.1.454.CMB.1.raw
  modified_base (237)..(237): a, c, t, g, unknown or other
  misc_feature (237)..(237): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggcctccgaggggagggactggagtgggtcgcaggcatcgctggtggcggtcagtgacactattctacgcaaactccgtgacggggccncttcatcatctcagagacacttccagacatactgtctctcgacaactcaactaaccgtggaacggacgggacggaacgggaccgaccgggtaccttaagttttacttttcgttcggtacggacgggtaagggtacggtactaagttaaggtaggggtaaacgttaacggttacgttttaccggaacgttccccgtaccggacgtacggtaccgtaacgttacgtttggtaacgtttacgggtaccggggggtacccggggtaacccggttcggggtccggtcccggttccgttcccgttacgaccggtcccgtaccccgtaaccggaaccgggtacccgtacgttcccggttccccgtttcccccgtcggtaccccttaccccgttcccgtaacccgtaacggtaccgtacccgtacccgttaccgggtcgggggacctaacggaccgggtcccgggtacccggttcgggtaccgtccggtcccggttacgggtaccgtaacggtaccttaccgttaccgacggtaccgtacgtccgtacgtcgg

SEQ ID NO: 132987 - DNA, 479 bp, Homo sapiens
  misc_feature: GYAE6OF02IRV3I.9.34.D01.1.454.CMB.1.raw
  modified_base (469)..(479): a, c, t, g, unknown or other
  misc_feature (469)..(479): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggctatatggaagtacgattttcgatcctcgcagtcgacactttgattactgggccggggaacctggtcgccgtctcctcagcctccaccaacgggccatcggtccttcccctggccaccctcctccaagacgaccaccgtctacgggggcacgagccggccctgggcctggccctgggtcaaggacctacttccagacgtatcactgacgcggctggcgaagcgtacatacgnnnnnnnnnnn

SEQ ID NO: 132988 - DNA, 580 bp, Homo sapiens
  misc_feature: GYAE6OF02HBK60.9.34.D01.1.454.CMB.1.raw
  modified_base (383)..(383): a, c, t, g, unknown or other
  misc_feature (383)..(383): n is a, c, g, or t
  modified_base (454)..(454): a, c, t, g, unknown or other
  misc_feature (454)..(454): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgacgaaggaggcatagtgggaagtacgattttcgatccctcgcagtcgactctttagattacgnggggccgggtaaccctggtcgccgtctcctcacgcctccaccgaacgggcccacgtccggtccttccccgnggcccaccctccctaccaacgacgccaccgtcgtcgggggccacgaccggccgcccgtgggcctcggcccgtcggtacgaacggtccttaccgttccgacgtaccgttactccgtacgtggacggg

SEQ ID NO: 132989 - DNA, 583 bp, Homo sapiens
  misc_feature: GYAE6OF02HVX70.9.34.D01.1.454.CMB.1.raw
  modified_base (377)..(377): a, c, t, g, unknown or other
  misc_feature (377)..(377): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacacgacccccaaagtcatctatttatgacaacatgaagcgcctcgacgggtccctgaccgtattccgtccggctaccaagtctggacacatcacgccctccnggccatcacgtgggcctccgaggctaggaggtatggaggctacgacttaacttactgccagttcgtatcgacgtagtcgaaccttaagtaaccagttccgttacgttacggacgttacgggaaccgtaacggtaccgacccggttccggtacgggccaaccggaccccggaaacggaccccctaaaccccgtccgtacgttacccg

SEQ ID NO: 132990 - DNA, 545 bp, Homo sapiens
  misc_feature: GYAE6OF02F0RD1.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccggggaacctggtcgccgtctcctcacgcctccaccgaacgggcccatccggtccttccccctggccaccctcatccaagcgcacctcgtggggcacgacgccggccctgggcctcggcctggtccaacggtacctacttccagtaccgtatccactcgg

SEQ ID NO: 132991 - DNA, 555 bp, Homo sapiens
  misc_feature: GYAE6OF02GYY5O.9.34.D01.1.454.CMB.1.raw
  modified_base (407)..(407): a, c, t, g, unknown or other
  misc_feature (407)..(407): n is a, c, g, or t
  modified_base (468)..(468): a, c, t, g, unknown or other
  misc_feature (468)..(468): n is a, c, g, or t
  modified_base (509)..(509): a, c, t, g, unknown or other
  misc_feature (509)..(509): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtggggttcaactgttggagtctgggggaggcttggtccagcctggggagtccctgcgactctcctgtgtggcctctggattcacctttgagacctatcgccttgaccctgggtccgccaggctccgagggggaggactgggagtggggtcgcagggcagtcgcgtgggtggcggtcagtcgacacatttcaacgacaaacgtccgtaggacggggccncttcatcatcctccagagacaacttccaagaacatactcgtctctgcaactcaaactaccngacgaggacgagacacgctatttattctgtcgacggaaggnggacagtagtaggaatacgtacttttcgacttcccgtccgatacgg

SEQ ID NO: 132992 - DNA, 599 bp, Homo sapiens
  misc_feature: GYAE6OF02G16OW.9.34.D01.1.454.CMB.1.raw
  modified_base (231)..(231): a, c, t, g, unknown or other
  misc_feature (231)..(231): n is a, c, g, or t
  modified_base (482)..(482): a, c, t, g, unknown or other
  misc_feature (482)..(482): n is a, c, g, or t
  modified_base (588)..(588): a, c, t, g, unknown or other
  misc_feature (588)..(588): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattcacgcaaactccgtgaggggccncttcatcatctccagagacaacttcccagaacatactgtctctgacaactcaaactaacctgagaggcgaggacacggcctattttattctgtgacgaaggagcagtagtgggaatacgtattttcgactcccgtcgctagtcgaactactttgacttacggtcgggggacccgggtaacctcgggtccgcccgttctcccgtcacgtccctaccgaaccgacgggccctagtcccggttcccttccccgngccctaccctcctaccgaagccgaccaccgtcggtcggggaccacgacggcccggccgtgggctcggccgtggtaccgaacgtacctacgtccgagtaccgttacncacgtggacgg

SEQ ID NO: 132993 - DNA, 582 bp, Homo sapiens
  misc_feature: GYAE6OF02FW4KS.9.34.D01.1.454.CMB.1.raw
  modified_base (381)..(381): a, c, t, g, unknown or other
  misc_feature (381)..(381): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatagtgggaagtacgtattttcgatccctcgcagtcgactcttgattacgnggggaccgggaccgtggtcgccgtctcctcacgcctccaccaacgggcccacgtccggtccttccccgtcggccctacccctcctacccaacgacgccaccgtcgtcgggggccacgacggccggcccgtcgggcctcggtccgtacggtcgaacggtacctaccgttccgaacgtaccggtactacctacgtggtacggg

SEQ ID NO: 132994 - DNA, 664 bp, Homo sapiens
  misc_feature: GYAE6OF02I210F.9.34.D01.1.454.CMB.1.raw
  modified_base (301)..(301): a, c, t, g, unknown or other
  misc_feature (301)..(301): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggcccccagggcaggagggtcaccatctcgtgcactggaagtagcctccaacagtcggggcacgttatgatgtacactggtaccaacaactccaggaacacgccccaaagtcatcatttangacaacatagaagccggccctcgacggggtcccctagaccgtactttccgtcccggactaccaagtcgtggctacatccacgtccctccctcgggccctactccgacgtcgggcctacctagggccttagggaaggtagtacgggacgggtccttaggacctttaatttaaccgtcggaccctaggttcgttaatacggaaccgtggtaccgggtaccttaaaggtaacctacgttccgttacgttaccggtaaccggttcggggaaacccgtaacgggtttacccacccggggttcccgtacggggttaccgaccggtaccccgaaaccggtcccccaaacccgttaccgtccgttaacccg

SEQ ID NO: 132995 - DNA, 471 bp, Homo sapiens
  misc_feature: GYAE6OF02JCS0S.9.34.D01.1.454.CMB.1.raw
  modified_base (452)..(456): a, c, t, g, unknown or other
  misc_feature (452)..(456): n is a, c, g, or t
  modified_base (458)..(471): a, c, t, g, unknown or other
  misc_feature (458)..(471): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctccaccaagggcccatcggtcttccccctggccaccctcctccaagcgcacctctcgggggcacagcgccctgggctgcctggtcaggactactccagacgtatcactgagcggctggcaggcgcatgnnnnngnnnnnnnnnnnnnn

SEQ ID NO: 132996 - DNA, 568 bp, Homo sapiens
  misc_feature: GYAE6OF02GGC1H.9.34.D01.1.454.CMB.1.raw
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacagtcggggcacgttatgatgtacactggtaccaacaacttccaggaacagcccccaaagtcatcatttatgacaacatgaacgcggccctcgacggggtccctgaccgattcctccggctaccgaagtcctggcacatcacgccctcccgtcggcctactccgacgtcgggcctccgaggctggagatggaggctgacttattactcgcctaggttcgtatcggactaggtcggaccttaaagtaacacttcgtcgttaccggagtcgggtaaccgaaggtccacccggttccgtgggtaccacggacccgaacggaccccaacccgtacgtcgtaccc

SEQ ID NO: 132997 - DNA, 632 bp, Homo sapiens
  misc_feature: GYAE6OF02IUXP7.9.34.D01.1.454.CMB.1.raw
  modified_base (300)..(300): a, c, t, g, unknown or other
  misc_feature (300)..(300): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaatagctaccaacagtcggggcacgttatgatgtacactggtaccaacaacttccaggaacagacccccaaagtcatcatttangacaacatagaagcgccctgacggggtcctacgaccgtacttcgtccggcctaccgaagtctcggtcaactactcacgtccctacccgtcggacctactccaccgtcgggcctaccgacggctaggaggtagtacggacggtcttagaccttacgttactcgtaccaggttcgtagtcgacgtagttcggtaccttaaacgtaactacgttacgttaccgttacggtaaccgtacgggtaacccgtaacgggtacccgtaccggttcccgtacgggttaccgtaacggacccggaaaccggtaccccaaacccccgtacgttacgtaccccg

SEQ ID NO: 132998 - DNA, 739 bp, Homo sapiens
  misc_feature: GYAE6OF02GSF9M.9.34.D01.1.454.CMB.1.raw
  modified_base (340)..(340): a, c, t, g, unknown or other
  misc_feature (340)..(340): n is a, c, g, or t
tcagtgatacgtctcacgaccggtgctcgattttagatcgtctgtgttgggggtttaggggacaagaggctagcactcagggacaatactccagcatggcctaggtctcctctcctcctcgaccgtctcctcgctcactcgcacaggtcctggcccagtctggttctggaccgcacgccgccctcaggtcgtctcggggcccccacgggcaggacgggtcaccgacgtctcgtgcactggaatacgtctccaacgagtcgggactacgttatgtacgtagtaactactggtaaccaactaacgttcaggaacacgacccccaaagtcatcaactttaacncgacaacatagaacgcgacctcgacgggtccctacgaccgtacgttccgtccggacttaccgtaacgtcgtacggacctaccgaacgtccaacggtccccttacccgtcggaccctactcccgaacgttccgggacctcccgtaaggccgtacggacggtacgtcggacgtcgtacgtaccttaggttacctcgtacctacggttacgtacgtacggtaaccgtaaggttccgggtaaccttaaaggtaacgtacggttaccggttacgtttaacgggacgtttacggggaacccggttaagggttcccgttaacccggggttcggttaccgggtaaccggtaacccgggtaacccgtaaaccgggtacccccaacccggttacgttccggtaaccccg

SEQ ID NO: 132999 - DNA, 680 bp, Homo sapiens
  misc_feature: GYAE6OF02FFV0N.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgcctcagtgtctggggccccagggcagagggtcaccatctcgtgcactggaaacctcaccaacattgagagcaattatgtttcctggtaccagcagcctcccaaggaacgacgacccccaaaactccctcattctatcgaacaatagaactaaaccgaccctagaacggggtactttcccgtacgtacccgtttctctcgtccctccgtaagtctgggcctcggtcacgccctacccgtggccactccgacccgggactccacggaccggtcgggggaaccgcggtaccctaatttacgttacgtggaccggtaaactaggttaggggtaacttaaccgtagggtttaggagggtttcggggtttacgggggtaccgtttttccgggggaacccgggggtaacggggtaaccccggtagggtacccgttaggggtaaccggtcccgggttaacccggttacggggtaccgtaccggggtacccccgtaaacgggg

SEQ ID NO: 133000 - DNA, 639 bp, Homo sapiens
  misc_feature: GYAE6OF02FJO0O.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggcctatttattctgtgcgaaggaggcatagtaggaagtacgtattttcgactccccgtcgctacgtcgactactttgactttacgtcgggggtacccgggtaaccctcgggtccgcccgttcttcccgtcacgtccctaccgaccgaacgggtcccacgttccggtcccttccccgtggccctacccgtccgtaccaacgacgaccgtacccgttcggtcggggaccaccgtacggtcccgggtcccgtacggggccgtcggcccgttacgggtaccgtaacggtacccttaccgttacccggaacggtaccggttactaccgacggtacggg

SEQ ID NO: 133001 - DNA, 454 bp, Homo sapiens
  misc_feature: GYAE6OF02GMTC1.9.34.D01.1.454.CMB.1.raw
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
  modified_base (424)..(454): a, c, t, g, unknown or other
  misc_feature (424)..(454): n is a, c, g, or t
tcagtgatacgtctcacgaccggtgctcgatttagatcgtctgtgttggggtttggggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactggctccaggctgaggatgaggctgactattactgccagtcgtatgacagtggcctaagtaacntcgtcttcggaactgggaccaaggtcacgtctgggtcagcccaaggccaacccactgtcactcctgttccccnccctcctcagaccgtatcactgagcgggctgggcaaggcgacatacgnnnnnnnnnnnnnnnnnnnnnnnnnnnnnnn

SEQ ID NO: 133002 - DNA, 835 bp, Homo sapiens
  misc_feature: GYAE6OF02IYF3P.9.34.D01.1.454.CMB.1.raw
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtcgtcggggccccagggcaggacgggtccaccatctcgtgccacgtggaagtagcctaccaacagtccggggccaacggttatggattcggtaacacgttcggtaaacccaacgtaaccttccgaagggtaaccaaccgaccccccaaaagtccaacttacaattttatacgaacctaaacgtacgtacgaaacggccggtaccccttacggaccgggggttcccctacgggtacccgtaacgtttcccgtacccggtccgttacccgtaacggttcccgttacggggacccaacctaaccgtaccgaaccggtcccccgtttaccccgtacggggtacccctaaagttcccgaaccggttccgggggtacccgttaacccgacggggttcccttaacggggaaccgggtaacggttacgggaaaccgggtccgttaacggtaacccgtttaacttttaaccggtaccgttacccggttaacggtttaaccgggttaacgtaggtaacccgttaacgggtaccggtaacccgtttaaaaggttaacccgttaaacgttacccgggttttaccgttaacccgggtaacggtttaaccgggaacccggttaaccggtttacccggaaccccggttacccgggg

SEQ ID NO: 133003 - DNA, 569 bp, Homo sapiens
  misc_feature: GYAE6OF02JHL4Y.9.34.D01.1.454.CMB.1.raw
  modified_base (140)..(140): a, c, t, g, unknown or other
  misc_feature (140)..(140): n is a, c, g, or t
  modified_base (226)..(226): a, c, t, g, unknown or other
  misc_feature (226)..(226): n is a, c, g, or t
  modified_base (366)..(366): a, c, t, g, unknown or other
  misc_feature (366)..(366): n is a, c, g, or t
  modified_base (540)..(540): a, c, t, g, unknown or other
  misc_feature (540)..(540): n is a, c, g, or t
  modified_base (544)..(546): a, c, t, g, unknown or other
  misc_feature (544)..(546): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (555)..(558): a, c, t, g, unknown or other
  misc_feature (555)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(569): a, c, t, g, unknown or other
  misc_feature (564)..(569): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaatacctgagaggcgaggacacggcctattttattcngtgcgaaggaggcatagtggaagtacgtatttcgactccctccgcagtcgaactactttgacttacggtcggggaccggtaaccgtggtccgtccgtctcctcgacgcctccaccgaacggccacgtccgtcccttcccncggccaccctcctacacgacgctaccgtcgtcggggccacgacggccggtcccgtacgggtcctcggtccgtacggtaccgaaacggtaaccgttaccgttacccgacgtaaccgttactaccgtacgttcggacgggccgggtcgtcggaacgaacggtccgacacgtacgancgcnnncgncncgcnnnncngncnnnnnn

SEQ ID NO: 133004 - DNA, 584 bp, Homo sapiens
  misc_feature: GYAE6OF02HXDUS.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggagcatatgggaagtacgattttcgatccctcgcagtcgactacttgattacgtggggcccggggtaaccctcgggtccggccgttctccctcgacgcctacccaccgaacggcccagtccgtaccttcccccgtgtcccacccctcctacccaagacgccaccgtccgtcggggccacgacggccgcccgtcggcgtcggcccgtggtaccgaacggtacctaccgttccgacggtaccgtactccgtactcggacgg

SEQ ID NO: 133005 - DNA, 583 bp, Homo sapiens
  misc_feature: GYAE6OF02FITD7.9.34.D01.1.454.CMB.1.raw
  modified_base (232)..(232): a, c, t, g, unknown or other
  misc_feature (232)..(232): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggccatttatttctgtgcgaaggaggcatatgggaagtacgtattttcgatccctcgcagtcgactactttgatttacgtcggggacccggggaacccgtggtccgccgtctccctcacgccctccaccgaacggcccatccggtccttcccctcggccaccctcctaccaacgacgccacctcgtcgggggcacgacgccggcccgtcgggcgtcggtcccgtcggtccgaacggtaccttaccgttaccgacggtaccgttatacctacgtggacgg

SEQ ID NO: 133006 - DNA, 601 bp, Homo sapiens
  misc_feature: GYAE6OF02IXQ76.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccagggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcagtatgggaagtacgattttcgatccctccgcagtcgactactttagatttacgtggggccggggtaacccgtgggtccgccgtctccgtcctacgcctccaccgacgggccctagtccggtccttccccgcggtccaccctcaactccaacgacgccacctcgtcgggggcctaacgacggcccgggacccgtcgggaccgtcggtcccgttacgggtaccgaacggtaccttaccgttccaaggtaccgtaactacccacgtacggg

SEQ ID NO: 133007 - DNA, 596 bp, Homo sapiens
  misc_feature: GYAE6OF02HUC1K.9.34.D01.1.454.CMB.1.raw
  modified_base (141)..(141): a, c, t, g, unknown or other
  misc_feature (141)..(141): n is a, c, g, or t
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (339)..(339): a, c, t, g, unknown or other
  misc_feature (339)..(339): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
  modified_base (548)..(548): a, c, t, g, unknown or other
  misc_feature (548)..(548): n is a, c, g, or t
  modified_base (556)..(556): a, c, t, g, unknown or other
  misc_feature (556)..(556): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (592)..(592): a, c, t, g, unknown or other
  misc_feature (592)..(592): n is a, c, g, or t
  modified_base (594)..(595): a, c, t, g, unknown or other
  misc_feature (594)..(595): n is a, c, g, or t
tcagtgatacgtctcacgaccggtgctcgatttagatcgtctgtgtttgggtttgggattcacgttgcagatgtaggtctgggtcgcaggcatcgctggtggcggtcatgacacattcacgcaaactccgtggaggggccncttcatcatctccagagacaattcccagaacatactgtctcagcaactcaataacngagaggcgaggacacggctatttattcngtgacggaaggagcagtagtagggaacgtacgtattttcgactccccgtaccgcgaagttcgaactacttttgaattaccgtggggacccgggtaaccgttcggcgccgttccncctacacgcctaccacgacggccagtcggtcctaccccgngccacccttccanaacgcgcaccttcgcggggacacgacgccggtccgngggcctcggccgtgggtacaaacgggtacccttaccggtaccgaacgtaccgttacaccgtacgtaggacgggtaccgggcgtacggaaccggaacgggttaccgacgaacggttacggngagcgagngcacgacgacgacatagcgtacgacgacncngagcncnnc

SEQ ID NO: 133008 - DNA, 546 bp, Homo sapiens
  misc_feature: GYAE6OF02FZ4FQ.9.34.D01.1.454.CMB.1.raw
  modified_base (521)..(521): a, c, t, g, unknown or other
  misc_feature (521)..(521): n is a, c, g, or t
  modified_base (524)..(525): a, c, t, g, unknown or other
  misc_feature (524)..(525): n is a, c, g, or t
  modified_base (527)..(528): a, c, t, g, unknown or other
  misc_feature (527)..(528): n is a, c, g, or t
  modified_base (530)..(531): a, c, t, g, unknown or other
  misc_feature (530)..(531): n is a, c, g, or t
  modified_base (533)..(546): a, c, t, g, unknown or other
  misc_feature (533)..(546): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatagtgggaagtacgattttcgactccctccgcagtcgacactttgattactggtcggccggggtaaccctggtcgccgtctcctcacgcctccaccaacggcccatcggtccttcccctcggccaccctccctaccgaacgacgcctaccctcgtcgggggcacgacggccggcccgtcgggctcggcccgttggtaccgaaacgggtaccttaccgttcccaaggtaccgtactacactggacggccgggcgttcgggaccgaacgggccgacgtagtagnacnncnngnngnnnnnnnnnnnnnn

SEQ ID NO: 133009 - DNA, 469 bp, Homo sapiens
  misc_feature: GYAE6OF02JDEOM.9.34.D01.1.454.CMB.1.raw
  modified_base (181)..(181): a, c, t, g, unknown or other
  misc_feature (181)..(181): n is a, c, g, or t
  modified_base (219)..(219): a, c, t, g, unknown or other
  misc_feature (219)..(219): n is a, c, g, or t
  modified_base (265)..(265): a, c, t, g, unknown or other
  misc_feature (265)..(265): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (411)..(411): a, c, t, g, unknown or other
  misc_feature (411)..(411): n is a, c, g, or t
  modified_base (417)..(419): a, c, t, g, unknown or other
  misc_feature (417)..(419): n is a, c, g, or t
  modified_base (421)..(421): a, c, t, g, unknown or other
  misc_feature (421)..(421): n is a, c, g, or t
  modified_base (423)..(424): a, c, t, g, unknown or other
  misc_feature (423)..(424): n is a, c, g, or t
  modified_base (427)..(469): a, c, t, g, unknown or other
  misc_feature (427)..(469): n is a, c, g, or t
tcagtgatacgtctcacgaccggtgctcgatttagatcgtctgtgttgggtttggggggcacggttatgatgtacactggtaccaacaacttccaggaacagccccaaagtcatcatttatgacaacatgaagccggcctcaggggtccctgaccgattctccggctccaagtctggcacntcagcctccctggcccatcactgggcctcaggctgagntgagctgactatactgccagtcatgacaggtgacctaaagtaaccngtcgttcttacggaactggggaaccaaggtccaaccggttcctggggtaccaagacccccgaaggtccccaacccacgttgtccacttcctcgtccccaccttcnagtaaccgtntaccgagtcgaggcggactggaccaaggtcnatgacnnntnannacnnnnnnnnnnnnnnnnnnnnnnnnnnnnnnnnnnnnnnnnnnn

SEQ ID NO: 133010 - DNA, 579 bp, Homo sapiens
  misc_feature: GYAE6OF02JOAGJ.9.34.D01.1.454.CMB.1.raw
  modified_base (329)..(329): a, c, t, g, unknown or other
  misc_feature (329)..(329): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaactaacctgagacggcgaggacacggcctatttattctgtgcgaaggnggcagtagtgggaatacgattttcgactccctcgcagtcgactcttgattacgtggggccgggaccgtggtcgccgtctcctcgacgcctccaccgacggcccacgtccggttccttccccgtcggccacccgtcctccgtaacgacgccaccgtcgtcggggaccacgacgccggcccgtgggcctcggccgtcggtacgaacggtaccttaccgtccgacggtaccgtactaccgtacgtgtaccggg

SEQ ID NO: 133011 - DNA, 769 bp, Homo sapiens
  misc_feature: GYAE6OF02GPF11.9.34.D01.1.454.CMB.1.raw
  modified_base (244)..(244): a, c, t, g, unknown or other
  misc_feature (244)..(244): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
tcagtgatacgtctcacgaccggtgctcgatttagatcgtctgtgttgggtttggggtacgtaaggaggcgagcactcaggacaatctccagcatggcctggtctcctctcctcctcactctcctcgctcactgcacagggtcctgggcccagtctgttctgacgcagccgccctcagtgtccgtcggggcccccaaggggccagtagggtcaccgtatcctgtgacactggaatggctccaanacgtcggggacctacggttatagtatggactacgtggtaaccaactaaccttcaaggacaacgaccccaaagtccaatctatttanacgtanaacatagaagccggtcctaacgcggggtcccctagggaaccccgtagtttcccgtccgggtaccgtacccgaacggtttcccgtacgggtacctaccgaacttcccgtaacgtccccgttaccccgttcgggaaccccttacgtacccgtaacggttaccgggccgttacccgggacggtccgtaggggaacgtacggtacgggacggtcgaggttaacttacgttaccgtagccctaggttacgtatcggtactaacgggttcggtaacccttaaaggtaaacctaacgttccgggtttaccttaccggggtaaccgttacggggaacccgttaaccggggtaccttacccggggtaccgttagggggttaccccaacggaacccccgttaaccgggaccccaaaccccccggttagtacccggtttaaccc

SEQ ID NO: 133012 - DNA, 634 bp, Homo sapiens
  misc_feature: GYAE6OF02FZBO1.9.34.D01.1.454.CMB.1.raw
  modified_base (428)..(428): a, c, t, g, unknown or other
  misc_feature (428)..(428): n is a, c, g, or t
  modified_base (477)..(477): a, c, t, g, unknown or other
  misc_feature (477)..(477): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaataacctgagaggcgaaggacacggcctattttatttctgtgacgaaggaggcatagtgggaagtacgtattttcgactcccgtcgcagtcgactactttgatttacgtcgggggaccggggtaaccctgggtccgccgtctcctcncgtccctccgaaccgacgggccctacgtcccggttccctttccccccgngggtcccctacccctccctaccgaaacggcgccctacccgttcggtcggggccacgacggtcccgggcccgtgggcctcggcccgttacgggtaccgaaacgggtacctttaaccgttcccgaacggtaccgttactaccgtaccgtgggtaccggg

SEQ ID NO: 133013 - DNA, 555 bp, Homo sapiens
  misc_feature: GYAE6OF02F051C.9.34.D01.1.454.CMB.1.raw
  modified_base (320)..(320): a, c, t, g, unknown or other
  misc_feature (320)..(320): n is a, c, g, or t
  modified_base (398)..(398): a, c, t, g, unknown or other
  misc_feature (398)..(398): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaactgttggagtctgggggaggcttggtccagcctggggagtccctgcgactctcctgtgtcggcctctggattcacctttgagacctatgccttgacctgggtccgccaggctccgaggggngggactggagtgggtcgcaggcatcggctgggtggcggtcagtgacactattctacgcaaacgtccgtgacggggccncgttcatcatctccagacgacaactcccaagaacatactgtctctgcaactcaactaaccgtgagacggcgacggacacggctagtttacttctgtcgcggaaggagactaagtagtagggtaacgttacgtagtttacgacgttacccctcgtacg

SEQ ID NO: 133014 - DNA, 574 bp, Homo sapiens
  misc_feature: GYAE6OF02GKBWD.9.34.D01.1.454.CMB.1.raw
  modified_base (141)..(141): a, c, t, g, unknown or other
  misc_feature (141)..(141): n is a, c, g, or t
  modified_base (228)..(228): a, c, t, g, unknown or other
  misc_feature (228)..(228): n is a, c, g, or t
  modified_base (539)..(539): a, c, t, g, unknown or other
  misc_feature (539)..(539): n is a, c, g, or t
  modified_base (550)..(551): a, c, t, g, unknown or other
  misc_feature (550)..(551): n is a, c, g, or t
  modified_base (555)..(556): a, c, t, g, unknown or other
  misc_feature (555)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
  modified_base (572)..(574): a, c, t, g, unknown or other
  misc_feature (572)..(574): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaaactccgtgaggggccncttcatcatctccagagacaattcccagaacatactgtctctgcaactcaaataacctgagaggcgaggacacggccattttattcngtgacgaaggaggcaatagtgggaagtacgtattttcgatccctccgcagtcgacactttgattacgtcggggaccgggaacctggtccgccgtctcctcacgcctccaaccgaacgggcccagtccggtccttccccgtggccaccctcctaccaacgacgaccacctcgtcggggcacgacgccggcccgtgggcctacggccgtcgggtaccgaaacggtaccttaaccgttccaacggtaccgttaactaccgaacgttaggacggccgggtcgtacgggtacgaacgggccgtacgtaacgtacgntagctcgatgnnagcnncncncnncncncnncnnn

SEQ ID NO: 133015 - DNA, 468 bp, Homo sapiens
  misc_feature: GYAE6OF02GOAD1.9.34.D01.1.454.CMB.1.raw
  modified_base (454)..(468): a, c, t, g, unknown or other
  misc_feature (454)..(468): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagcccccaaagtcatcatttatgacaacatgaagcggccctcaggggtcccctgaccgattctccggctccaagtctggcacatcagccctccctggcccatcactgggctccaggctgaggatggaggctgactattactgcccagtcgtatgacagtcggcctaagtaacatccgtcttcggaactgggaccaaggtccaccgtctgggtcagccccaaggcccaaccccactcgtccacttcctcgttccccgccctccctacacgtaccgtatccacgtgacggccgggctcgggacaacgggcaccgatacgnnnnnnnnnnnnnnn

SEQ ID NO: 133016 - DNA, 626 bp, Homo sapiens
  misc_feature: GYAE6OF02HW58C.9.34.D01.1.454.CMB.1.raw
  modified_base (309)..(309): a, c, t, g, unknown or other
  misc_feature (309)..(309): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcacatggagtttggctgacctggctttttctcgtggctagtttaaagtgtccagtgtgagttcaatgtggagtcgtggggagcgttggtcgagcgtgggcgtcccgtgcgactctccgtgtgtggcctcgtggtacttccaccgttttgagtacctagtcggtccttgaccgtgggtccnccaggcctccgaggggaggactggngtcggcgngaggcagttccggngtcggtcggacgtcagtcgactcgtacgtaccgacgaccgtaacgtccggtaggtaccgggtcctacgtacgtactccgtactccgtaccgaagaccgtaactaaccttaccgaactaactacgtcttcgttcgaccgtcaactaacgtacctaacgtacgtagacgtacggcgtaacgacgcgttacgttaagttctacgtcggtacgacggaacggtactagtagtaacggtggttaacgtacgttcgttccgacgttccacggtacg

SEQ ID NO: 133017 - DNA, 623 bp, Homo sapiens
  misc_feature: GYAE6OF02HMU2P.9.34.D01.1.454.CMB.1.raw
  modified_base (327)..(327): a, c, t, g, unknown or other
  misc_feature (327)..(327): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctgggccccagggcagagggtcaccatctcgtgcacgtggaagtagctccaacagtcggggcacgttatgatcgtacactggtaacccaactaacttccaaggaaccacgacccccaaagtcatcatttangacacatagaacgccgccctcgacggggtccctaggaccgtacttccgtccggaccttacccaagttccgtcgacctaacatccgaacgcccttccccgtggcctactccgaccgtcgggacctccgacggtcctagggaggtacgtgacggtacttagtacgtttaacgttacgtacgcccgtaaggttcgtagtcgacgtacggttcggtaaccgtaacgtaactacgttaccgtaccgttaccgggtaaccgttacggggtaaccctaacgggttcccgaccggtttacccgg

SEQ ID NO: 133018 - DNA, 638 bp, Homo sapiens
  misc_feature: GYAE6OF02G1Q07.9.34.D01.1.454.CMB.1.raw
  modified_base (273)..(273): a, c, t, g, unknown or other
  misc_feature (273)..(273): n is a, c, g, or t
tcagtgatacgtctcacgaccggtgctcgatttagatcgtctgtgttgggtttgggcatgtgtgagttttgtcacaagatttgggctcaactttcttgtccaccttggtccagcctggggagtccctgcgactctctgtgtggcctctggattcacctttgagacctatgccttgacctgggtccgccaggctccgaggggaggactggagtgggtcgcaggcatcgctggtggcggtcatgacacattcacgcaaactccgtgacggggccncttcatcatctccagagacaatcccaagaacatactgtctctcgacaactcaactaacctgaagacggacgaaggacgacggcctaattttactttcgtgtagacgaaaggaggacatagtaggggaagtacggtattttcgactcccctcgacctacgtacgactacgttagtacgtttacggtcgggggtacccgggtaaccgtcggtccggtccgttcctcctcgacgtccctcccgaaccgaacggcccacgttccggtccctttacccccgtggtacccctaccccgttcccgtacccgaacggaccgtacccgaacccgttccgggtacggggaccacccggacgtcccgggtccccgg

SEQ ID NO: 133019 - DNA, 717 bp, Homo sapiens
  misc_feature: GYAE6OF02JGG4T.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcacctttgagacctatgcccttgacctggggtccgccgaggctccgagggggagggtacttgggaggtgggtcgtcgagggcatcgctgggtggcggtcatggacactattcgtacggcaaacgtccggtagaggggccgtcgttcatccatctccagtagacaacttcccaagtaaccatacgtgtctacttagctaaacttcaattaaccgtgacgaggcgaggaacaccggtcctaagtttacgttctaggtacgtcggaagggacggactaagtaagtagggaaacgttacggtaattttacgactttccccgtacgacgtacgtcgtaactacgtttaggtaactttaccggtacgggggacccgggtaacccgttgggtaccgacccggtaccttcccgtacgtaccgcctaacccaccgaacgggtccctacgttcccgggtacctttcccccgtaggccctaacccgttccgtaacccgaacggtaccgccgtaacccgtcgggtccgggaaccacggcgccggtaccgtcgggcgtcggcgttacggaaccgtacggtaccttacgtccgacggtacggtacctacgaccgtacgg

SEQ ID NO: 133020 - DNA, 688 bp, Homo sapiens
  misc_feature: GYAE6OF02HEIM6.9.34.D01.1.454.CMB.1.raw
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaactgttggagtcgtgggggagcgttggtccagccgtgggggacgtccctgcgactctcctgtgtcggcctcgtggattcacctttgacgtacctatgccttcggaccgttcgggtcccgccgaggcctccggagggggacgggacgtgggaggtcggggtcgcgagggcagtccggcgtgggtcggcggtcagtgaacactatttctaacgacctaaaccgtccggtagggacgggggtccctctttacacttacctacttcctaccgaaggaacgaacctaactttaccccaaagaacctactacgttcgtacctctcgacctaacttaccaaacttaaccgtaggacggacggacggtaacgggaccaccgggtaccttaacttttacgtttcgtaggttacggacgggtaaagggacggtacgtaaggtacggtaaggggtaacgttaacggttagtttttaccggaccttaccccgtaccgtaccg

SEQ ID NO: 133021 - DNA, 711 bp, Homo sapiens
  misc_feature: GYAE6OF02HTFMW.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccgaggggagggactgggagtgggtcgcaggcatcgctggtggcggtcatgacacattctacgcaaactccgtgaggggccgtcttcatcatctccagagacaattcccagaacatactgtctctgcaactcaatacctgagaggcgaggacacggcctagtttattctgtgcgaaaggaggcatagtaggaagtacgtattttcgacttccccgtcgactacgtcgaactacgtttgaactttaccgggtcggggggtacccggggtaacccgttcgggtccggtcccgtccttcccgttccgaccgtccctacccgaacccgaacgggacccctaacgttcccggtttccccgtttccccccgtaccgggtaccccttacccccgttcccctaccccgtaaacggacgtacccgtaaccccgttccggtccggggggaccaaccggtacggccccgggaccccggttcgggtcccgtcggtcccgttacgggtaaccgaaccgggtaacccttaccgttacccgtaacggtaccggttaactaccgtacgtacggg

SEQ ID NO: 133022 - DNA, 612 bp, Homo sapiens
  misc_feature: GYAE6OF02FX7CP.9.34.D01.1.454.CMB.1.raw
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (593)..(594): a, c, t, g, unknown or other
  misc_feature (593)..(594): n is a, c, g, or t
  modified_base (596)..(598): a, c, t, g, unknown or other
  misc_feature (596)..(598): n is a, c, g, or t
  modified_base (600)..(600): a, c, t, g, unknown or other
  misc_feature (600)..(600): n is a, c, g, or t
  modified_base (604)..(604): a, c, t, g, unknown or other
  misc_feature (604)..(604): n is a, c, g, or t
  modified_base (606)..(612): a, c, t, g, unknown or other
  misc_feature (606)..(612): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctattttatttctgtgcgaaggaggcagtagtgggaagtacgtattttcgatccctcgcagtcgactactttgattacgtgggggcccgggtaaccctggtccgccgtctcctcacgccctaccaccgaacgggcccagttccggtcctttcccccgtgggcccctaccccgttcctacccgaaagaccgaccacccgttcggtcgggggccaaccgacggcccggtccccgtggggccttcgggcccgttgggtaccgaaaacgggtacccttaccgtttaccccgaacgtacggttaactccgaacgttgggaacggtccggggtcctacggggacaaacggggcccgacgtaaacggtggacgtngcgngngcgnngnnngngcgncnnnnnnn

SEQ ID NO: 133023 - DNA, 480 bp, Homo sapiens
  misc_feature: GYAE6OF02FUX85.9.34.D01.1.454.CMB.1.raw
  modified_base (225)..(225): a, c, t, g, unknown or other
  misc_feature (225)..(225): n is a, c, g, or t
  modified_base (472)..(480): a, c, t, g, unknown or other
  misc_feature (472)..(480): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattcngtgcgaaggaggcatatgggaagtacgattttcgatccctccgcagtcgacactttgattacgtggggccggggaaccctggtcgccgtctcctcagcctccaccaagggcccatcggtcttccccctggccacccctcctccaagacgccacctcgtcgggggccacgacgccggccctgggcctcgccgtggtcgaaggacctacttccagaccgttatcactgagcgggctggcaggcgcatgnnnnnnnnn

SEQ ID NO: 133024 - DNA, 771 bp, Homo sapiens
  misc_feature: GYAE6OF02JJ9B6.9.34.D01.1.454.CMB.1.raw
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtccgtcggggccccagggcaggacgggtccaccatcctcgtgccacgtggaagtcgctaccaacagtcggggcacgttatgatgtacactggtaaccaacaacttccaggaacacgacccccaaagtcatctatttatacgacaacatagaacgtaccggccctagacggggtccctaggaccgtattccttacccgggcctttaccgaaacggttcgtacggaccaacacgttaccgaacgtcccctccccgtaacgggtcccaacgttccctaaccggttcggggaccccttacccggaacgggtccgttaggaacggtacgttacgggacggtcgttaggtaaaccctttacgttaaccgtcgtaaccccgtaaggttaccggtaagttccggaaaccgtaacgtccgggtaaccttaaaacggtaacctaagtttcccgggttacttaaccggggtaaccgttacggggtaacccgtaaaaccggggtttcctaacccgggttacccttacggggggtaaccaacccggttaaccccccgggaaaaccggtaccccccggtaaaacccccttcggttaccccgttaaccccg

SEQ ID NO: 133025 - DNA, 611 bp, Homo sapiens
  misc_feature: GYAE6OF02G1DNA.9.34.D01.1.454.CMB.1.raw
  modified_base (557)..(557): a, c, t, g, unknown or other
  misc_feature (557)..(557): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgagggccgcttcatcatctccagagacaattcccagaacatactgtctctgcaactcaataacctgagaggcgaggacacggcctatttattctgtgcgaaggaggcagtagtggaagtacgtagtttcgactccgtccgcagtcgactacttgtacttacggtcggggaccggtaccgtcggtccgtccgtctccgtcgtacgccctaccgaccgtaacggtccctacgtccggtcccttccccgtcgtccctacccttccgtaccgaacgacgtacctaccgtcggtcggggaccacgacgccggtccgtcgggcgtcgccgtcggtacgaacggtaccttaccgttccgagtaccgttacgtaccgtacgtcggacggtccggtcgtcggacgacgggccgtacgtaagtacgctgtacgcgngtctcgacgtacgtcgtactcgacgtcgtgtcgtacgtcgtacgctcgtagtcg

SEQ ID NO: 133026 - DNA, 677 bp, Homo sapiens
  misc_feature: GYAE6OF02G0CCE.9.34.D01.1.454.CMB.1.raw
  modified_base (264)..(264): a, c, t, g, unknown or other
  misc_feature (264)..(264): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctgggccccagggcagagggtcaccatctcgtgcactggaagtagctaccaacatcggggcacgttangatgtacacgtcggtaccagcagccttccaggaacacgtacccccaaaccctcatctataggtaatagtaactcggaccctacgtacggggtccctagaccgtatttcgtccgtaggcctaccaacgtctcggaccacccgtcagtcccctcccgtggcccactccgaaccgttggggtccctttacggacgggtacgtaggtaacgggtattcggaacgggtcttaggtaactttttaagttaccgtaccgtaccctaacccgttacccgttaaagtccgtaaaccgtaggtaccctaacggtccccgttaaggtaaacgggtaaacgggtttcggtttaacggggtttaaccggtttccggggaaaccggggttaaccgggggaaaccctaacggttcccgtaacccgggg

SEQ ID NO: 133027 - DNA, 564 bp, Homo sapiens
  misc_feature: GYAE6OF02FOHTV.9.34.D01.1.454.CMB.1.raw
  modified_base (474)..(474): a, c, t, g, unknown or other
  misc_feature (474)..(474): n is a, c, g, or t
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccaggggagggactggagtgggtcgcaggcatcgctggtggcggtcatgacacattctacgcaaaactccgtgaggggccgcttcatcatctccagagacaattcccagaacatactgtctctgcaactcaataacctgagaggcgaggacacggccattttatttctgtgcgaaggaggcatagtggaagtacgattttcgatcccctcgcagtcgacactttgatttacgtggggccgggaaccctggtcgccgtctcctcacgcctccaccaacgggcccagtccggtcctcccctggccaccctcctaccaacgacnccacctcgtcggggccacgagccggcccgtgggcctcggcccttgggtaccaacggaccttaccgttccaaggaccgtactccacgtcgg

SEQ ID NO: 133028 - DNA, 701 bp, Homo sapiens
  misc_feature: GYAE6OF02JGFWR.9.34.D01.1.454.CMB.1.raw
tcagtgatacgtctcacgaccggtgctcgatttagatcgtctgtgttgggtttggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctgggccccagggcagagggtcaccatctcgtgcactggaagtagctccaacatcggggacacgttatgatggtacactggtaaccaacgaacttccgaggaacacgacccccaaagtcaactcgtaatttatagaacaacatacgaaacgccggtacccctcgaacgggggttcccctaggtaacccgacgtttccgtacccgggccttacccgaacgttccgtcgggaccaaccgtaacttcccgaacggtccccttaccccggtagggtacccctaacgttcccgtacgtttacggggccctttaccgaacgggtccgttacggaacgggtacgttacgggaacgggttccttacgggtaaccttacgtttaaccgtggtacccgtaaggttaccgtagtacgacgtacggtacgggttaaccctaaagggtaacctacgttaccgttaccgtttaccggaaccggtacgggtaacccaagggttcccgaaccggtttcccgg

SEQ ID NO: 133029 - DNA, 692 bp, Homo sapiens
  misc_feature: GYAE6OF02IIKTP.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtgtctcgggggccccagggcaggtagggtcacctatcctcgtgccaacgtggaacgtacgcgtaccaacgacgtcggggccaacgttatgtatagtacacgtggtaaccaacgaaccttacaggaaacacgacccccaaaagtccaaactctaatttacgtagtaacaacaataggaacggaccggccctacgacggggttaccctgacccgtactttaccgccggtacctaccgtaaagttcgtggtacaactacgtccaacgtcccgtcccctcggtaccctatacccgtaccgtcggggtcctacccgaacgggtcgttaggaacggtagtacggaacgtccgttacggtaacttaacgttacgtacgtaccgttacgtacgttaacgtacggacgtacggttacggaccgttaaagttaaccgtaacgtacgtttacgttaccggaaccggttacgggtaacccgtaacgggttaccgtacccggttacccggg

SEQ ID NO: 133030 - DNA, 626 bp, Homo sapiens
  misc_feature: GYAE6OF02HWBTU.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattcacgcaaactccgtgaggggccgcttcatcatctccagagacaattcccagaacatactgtctctgcaactacaataacctgagaggacgaggacacggctatttattctgtgacgaaggaggacatagtagggtaagtacgtattttacgacttcccctcgactacgtacgactactttgactttacggcgggggaccgggtaaccgtggtccgccgttctcctcgacgtccctaccaaccgacggcccacgttccggttcccttcccctggaccctaccctccaccaacggcgacctaccgtcggtacggggcacgacggcccgccgtgggtccgtcggcccgttagggtacctaacggtaccgttaacccgttaccgaacgggttaccgttaccgtaccgacgtaggtaccgggg

SEQ ID NO: 133031 - DNA, 533 bp, Homo sapiens
  misc_feature: GYAE6OF02G9VAU.9.34.D01.1.454.CMB.1.raw
  modified_base (350)..(350): a, c, t, g, unknown or other
  misc_feature (350)..(350): n is a, c, g, or t
  modified_base (513)..(533): a, c, t, g, unknown or other
  misc_feature (513)..(533): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgtatttcgatccctcgcagtcgacactttgattacgtggggccgggaacctggtccgccgtctcctcagcctccaccaacggccagtcgtccttccccnggccaccctcctccaacgacgccacctcgtcgggggacaccgaggccggcccgtcgggctcggccctaggtaccgaaacggaccttaaccttaccgaacgtaacgttactacccgtacgttcgaacggtccgggcgtacggccgtaaaggccgacagtacgannnnnnnnnnnnnnnnnnnnn

SEQ ID NO: 133032 - DNA, 483 bp, Homo sapiens
  misc_feature: GYAE6OF02F5M5E.9.34.D01.1.454.CMB.1.raw
  modified_base (464)..(483): a, c, t, g, unknown or other
  misc_feature (464)..(483): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccattttatttctgtgcgaaggaggcatatgggaagtacgattttcgatccctccgcagtcgacactttgattactggggccggggaaccctgggtcgccgtctcctcagcctccaccaacgggcccatccggtcttccccctggccacccctcctccaagacgcacctctgggggcacagcggccctgggctgcctggtcaaggactacttccagacgtatcactgacgcggctggcaaggcgcatagnnnnnnnnnnnnnnnnnnnn

SEQ ID NO: 133033 - DNA, 661 bp, Homo sapiens
  misc_feature: GYAE6OF02HSKRF.9.34.D01.1.454.CMB.1.raw
  modified_base (331)..(331): a, c, t, g, unknown or other
  misc_feature (331)..(331): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaaactccgtgaggggccgtcttcatcatctccagagactaattcccagaacatactgctctgcaactcaataacctgagagcgaggacacggctatttatttctggtgcggaaggnggacatagtaggggtaagtacgatttttcgactcccctccgcacgtcgactacttttgactttacggtcgggggcccggggaacccgttgggtcccgtcccggttcctcccgtacgacgtccctaccgaacccgtaacggggcccctaacgttcccggtccctttcccccgtcggccctaccccttccgtacccaacgcgaccaacccgtcgtcgggggccaccgacggcccggacccgttcggggcttccgggcccgttacgggtaccgaacggttaccgtttaaccgtcccgaacggtaccgttacgtcccgtacgttgaacccgggg

SEQ ID NO: 133034 - DNA, 784 bp, Homo sapiens
  misc_feature: GYAE6OF02FOIHC.9.34.D01.1.454.CMB.1.raw
tcagtgatacgtctcacgaccggtgctcgatttagatcgtctgtgttgggtttgggggctctcgcttcagcttgtgggcacaagaggtcgtaggcacctcacggacgaattcctccagtctactggccctggtctcctctcctccgtcactctcctcgctcactgcacagggtctgggcccaggtctggttctgacgctagtaccgcctcagtgtcgtcggggcccagggcaggtagggtcgaccgaggtcgtcgtgcacgtcggaaggttcgctaccaacgtacgtcgggctacgttatgtacttgtactacgtcggtaaccctaactaaccgttaccgaacggaaccgtaccgacccccgtaaagtccgacgttacctaacgtttaacgtacggaaccgaaacgtacgttacggaacgggtcccggtaccctacggaccggggttccctaggtaaccgtacgtttccgtacccggtacctaaccgtaacggttcgtacggactacgtacgtcgtacggtacccttccgtacgggtacctacgtaccgtaccgtcggtcctaccgacggtacgtacgggacgtacgtacgggaacggtaccgtacgtaaccttacgttaaccgtacgtaaccgtaaggttaaccgtaacgttacggttacgaggtaccgggttaaccgtaaaccggttaaccgtaccggtttaccggtttaaccggtttaacgggttaaccggttaccgggttaaacccgtacgggtttacccgtaaacccgggttcccgggg

SEQ ID NO: 133035 - DNA, 763 bp, Homo sapiens
  misc_feature: GYAE6OF02IS6ON.9.34.D01.1.454.CMB.1.raw
  modified_base (162)..(162): a, c, t, g, unknown or other
  misc_feature (162)..(162): n is a, c, g, or t
  modified_base (181)..(181): a, c, t, g, unknown or other
  misc_feature (181)..(181): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttcncgtggctgttttaaaaggngtccagtgtgaggttcaactgttggagtcgtgggggaggtcttggtccaggccgtaggggacgtcccgtgaccgactctcctgtcgtcggcctcgtggacttcacctttggacgtaccctatcgtcccttgaccgtcgggcccgccacggcctccggaggggggacgggacgtcggggagggtcggggtccgacgacggtaccagttccgtcggtgggttccgggcggtcctagtgtaaccaccgtactttactaacgaccgtaaaaccgttccgggtagggaacgggggcccttaccgtttacgacttccgtaactttaccgtaccccgaaggaacgtaacctaaaccgttaccccaaagtaaaaccctacgttaaccgttgtacccttagtaccgtacccaaaccgttaccaaacttaaccgtaaggtaaccgggtaggaccggtaacggaacccgtaaccggtacccgtttaaatttttaccgtttacgtcggttaacggacggtaaagggtcgtacctaaaggtacggtaaggggtaactacggtttaacgtttacggaccttaccccgtacgtacgg

SEQ ID NO: 133036 - DNA, 473 bp, Homo sapiens
  misc_feature: GYAE6OF02GV650.9.34.D01.1.454.CMB.1.raw
  modified_base (226)..(226): a, c, t, g, unknown or other
  misc_feature (226)..(226): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (461)..(473): a, c, t, g, unknown or other
  misc_feature (461)..(473): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttcngtgcgaaggaggcatatgggaagtacgattttcgatccctccgcagtcgacactttgattactcggggccgggaacctggtcgcgtctcctcagcctccaccaacgggcccatcggtccttccccctggccaccctcctccaagacgccacctcgtggggcacacgcggccctgggctgccgtgtcaaggactacttccagcgttacncactgngcggctggcaaggcgcatagnnnnnnnnnnnnn

SEQ ID NO: 133037 - DNA, 583 bp, Homo sapiens
  misc_feature: GYAE6OF02GLS3G.9.34.D01.1.454.CMB.1.raw
  modified_base (263)..(263): a, c, t, g, unknown or other
  misc_feature (263)..(263): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggcttacctggctttttctcgtggctgttttaaaaggtgtccagtgtgaggttcaactgttggagtctgggggaggcttggtccagcctggggatccctgcgactctcctgtgtggcctntggattcacctttgagacctatgccttgacctgggtccgccaggctccgagggggaggactgggagtgggtcgcgaggcagtcgctgggtggcggtcatgacacatttcacgcaaactccgtagacggggccctctcatcatcctccgagagactaattcccaagaaccatacctgttcctctagacctaactctaaactaaccgtgaaggacggccgaaggtaccgaccggtcctaattttactttctggttgaccggaagggcggtacaagttagcgggtaattacggtattttccggaacttccctccggatacggg

SEQ ID NO: 133038 - DNA, 611 bp, Homo sapiens
  misc_feature: GYAE6OF02H7A0G.9.34.D01.1.454.CMB.1.raw
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctcagagacaattcccagaacatactgtctctgacaactcaataacctgagaggcgaggacacggctattttattctgtgacgaaggaggcatagtagggaagtacgtattttcgactccctcgactacgtcgactactttgacttacggtcgggggaccgggtaaccgtcgggtccgtcccgtctcctcgacgccctaccaccgaacggcccacgtccggttccttccccgtcgccctacccctccctaccgaacgccgtaccaccgtccggtacggggccacggacgccggcccgtcgggcctcggtccgtcggtaccgaacggtaccttaccgttaccgacgtaccgtactcgtacgtaggtacggg

SEQ ID NO: 133039 - DNA, 601 bp, Homo sapiens
  misc_feature: GYAE6OF02JA9M5.9.34.D01.1.454.CMB.1.raw
  modified_base (237)..(237): a, c, t, g, unknown or other
  misc_feature (237)..(237): n is a, c, g, or t
  modified_base (591)..(591): a, c, t, g, unknown or other
  misc_feature (591)..(591): n is a, c, g, or t
  modified_base (597)..(597): a, c, t, g, unknown or other
  misc_feature (597)..(597): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactgggagtgggtcgcaggcatcgctgggtggcggtcatgacacattctacgacaaactccgtgaggggccncttcatcatctccagagacactcccagaacatactgtctctgacaactacaatacctgagaggcgaggacacggcctatttatttctgtgacggaagggagcatagtagggaagtacgtagttttcgacttccctcgctagtcgactactttgtagttaccggtcgggggacccgggtaacccgttcggtccgtccgttccgtccctacaccgtccctaccgaccgaccggccctagtcccggtcccttccccgcgccctaccctcctaccacgacgcctaccgtcggacgggccacgcggccgccgtggctcgtccgtaggtacgaacgtccttaaccgtcgagtaccgtacnctacgngcgg

SEQ ID NO: 133040 - DNA, 690 bp, Homo sapiens
  misc_feature: GYAE6OF02GDS12.9.34.D01.1.454.CMB.1.raw
  modified_base (233)..(233): a, c, t, g, unknown or other
  misc_feature (233)..(233): n is a, c, g, or t
tcagtgatacgtctcacgaccggtgctcgatttagatcgtctgtgttgggtctgggggaggcttggtccagcctggggagtccctgcgactctcctgtgtggcctctggattcaccttttgagacctatgccttgaccctgggtccgccaggctccaggggagggactggagtgggtcgcaggcatcgctggtggcggtcatgacacattctacgcaaactccgtgagggccncttcatcatctccagagacaattcccagaacatactgtctctgcaactcaataacctgagaggcgaggacacggcctattttacttcgtgtgacgaagggaggcaagtagtagggaaacgttacggtaattttccgaacttccccgtccgacgtacggtaccgaactacgtttagaactttaccggtcggggggaccccgggtaacccgtgggtacccgtcccggttctcccctcgaccgtccctcccgaacccgtaaccggggcccaacgttcccggttcccttccccccgtggtaccccgaccccgttccctaacccgaacggtactcccgtaacccgtcggtcggggacctacggaccgtcccggacccgtgggcccgtcgtcccggttacggtccgtaaacggtaccctttaccgttacccgtaacgtaccgtaaccgtccgtaccgtacggg

SEQ ID NO: 133041 - DNA, 605 bp, Homo sapiens
  misc_feature: GYAE6OF02HHRMK.9.34.D01.1.454.CMB.1.raw
  modified_base (572)..(572): a, c, t, g, unknown or other
  misc_feature (572)..(572): n is a, c, g, or t
  modified_base (574)..(575): a, c, t, g, unknown or other
  misc_feature (574)..(575): n is a, c, g, or t
  modified_base (577)..(577): a, c, t, g, unknown or other
  misc_feature (577)..(577): n is a, c, g, or t
  modified_base (580)..(580): a, c, t, g, unknown or other
  misc_feature (580)..(580): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (589)..(589): a, c, t, g, unknown or other
  misc_feature (589)..(589): n is a, c, g, or t
  modified_base (592)..(592): a, c, t, g, unknown or other
  misc_feature (592)..(592): n is a, c, g, or t
  modified_base (594)..(595): a, c, t, g, unknown or other
  misc_feature (594)..(595): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (603)..(604): a, c, t, g, unknown or other
  misc_feature (603)..(604): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctatttattctgtgacgaaggaggcatagtagggaagtacgtattttcgactccctccgcagtcgactactttgacttacggtcgggggacccgggtaacccgtgggtccgccggtcctcctcacgccctccaccgaacgggcccacgtccggtcccttcccccgtcggccctaccccgttccctaccgaaacggacgccctaacccgttcggtcgggggaccaacgacggcccgggcccgtcgggcctcggcccgtggtaccgaaacgggtacttaccgtccgaacgtacgttacgtcctacgtggacggccgggacgtcgggacgaacgggtccgacgtaacgtacggactagcngnngngcncgngcncgngcngnngngngngnnc

SEQ ID NO: 133042 - DNA, 487 bp, Homo sapiens
  misc_feature: GYAE6OF02I6UAX.9.34.D01.1.454.CMB.1.raw
  modified_base (464)..(464): a, c, t, g, unknown or other
  misc_feature (464)..(464): n is a, c, g, or t
  modified_base (466)..(487): a, c, t, g, unknown or other
  misc_feature (466)..(487): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccattttattctgtgcgaaggaggcatatggaagtacgattttcgatccctccgcagtcgacactttgattactggggccgggaacctggtcgccgtctcctcagcctccaccaagggcccatcggtccttccccctggccaccctcctaccaagagccacctcgtgggggcacgacgcggcccgtcggctgcctggcaaggacttacttccagacgtatcactgacgcgggctggcgaaggcgcatagngnnnnnnnnnnnnnnnnnnnnnn

SEQ ID NO: 133043 - DNA, 577 bp, Homo sapiens
  misc_feature: GYAE6OF02GIYP0.9.34.D01.1.454.CMB.1.raw
  modified_base (554)..(554): a, c, t, g, unknown or other
  misc_feature (554)..(554): n is a, c, g, or t
  modified_base (557)..(566): a, c, t, g, unknown or other
  misc_feature (557)..(566): n is a, c, g, or t
  modified_base (568)..(577): a, c, t, g, unknown or other
  misc_feature (568)..(577): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctattttatttctgtgcgaaggaggcatagtgggaagtacgtattttcgactccctccgcagtcgactactttgattacgtcgggggaccgggtaaccgtgggtccgccgtctcctcacgccctccaccgaacgggcccacgtccggttcccttcccccgtcggaccctaccccgtccctacccgaacgacgccctacccgtccggtcgggggaccaccgacggcccgggtcccgtcggggcctcggcccgtcgggtaccgaaacggtaccttacctcccgaagtaccgtatccacgtggacggccgggtctcgggacgaacggccgacgtacgtagcngcnnnnnnnnnngnnnnnnnnnn

SEQ ID NO: 133044 - DNA, 648 bp, Homo sapiens
  misc_feature: GYAE6OF02GJZ71.9.34.D01.1.454.CMB.1.raw
  modified_base (313)..(313): a, c, t, g, unknown or other
  misc_feature (313)..(313): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtcgtcggggccccagggcaggagggtcaccatctcgtgcacgtggaagtacgctccaacagtcggggactacgttatgagtgtacacgtcggtaaccaacaacttccaaggaacacgaccccaaagtcatctatttangaacaacataggaacgccggaccctacggacgggtcccgtagaccgtacttccgtaccggcctaccgtaagttcgtacggaccacgtacgtaccacggtcccttcccgtcgaccctaactccgacgtcgggccgtccgacgggtcgtacgggacggtacgcggacgtcgtacgtacttaacgttacctcgcctacgttacgttagacgtacgtacggtcgtaaccgttaaagactacgttacgtaccgttacggacgtacgggaaccgtacgggtaccctccggttcgtacgggtcacccggaccgaaccggtacccaacccgtactcgtacccg

SEQ ID NO: 133045 - DNA, 645 bp, Homo sapiens
  misc_feature: GYAE6OF02HCYJ8.9.34.D01.1.454.CMB.1.raw
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
tcagtgatacgtctcacgaccggtgctcgatttagatcgtctgtggttgggtctgggggaggcttggtccagcctggggagtccctgcgacctctcctgtgtggcctctggattcaccttttgagacctatgccttgacctgggtccgccaggctccgaggggagggactgggagtgggtcgcaggcatcgctgggtggcggtcatgacacattctacgcaaactccgtgaggggccncttcatcatctcaganacaattcccagaacatactgtctctgctaactcaataacctgagaggcgaaggaccacggacctattttacttctgtgacgaaggaggcagtagtagggtaacgtacggtagttttccgaactttccccgtcgactagtccgactactttgacgtttcggtcgggggaccggtacctggtccgccgtctcctcacgtcctccgaccgacggcctacgttccggtcccttccccgtggcccctacccgttcctacccgaagtccgtaccgtacccggttccgggtacggggcctaacggcgggtcccggcccgttcgggaccgtcggtaccggtcggtaaccgaacggtacccttacgttaccgtacggttactaccgtacgtacgtccggg

SEQ ID NO: 133046 - DNA, 549 bp, Homo sapiens
  misc_feature: GYAE6OF02F3SVK.9.34.D01.1.454.CMB.1.raw
  modified_base (226)..(226): a, c, t, g, unknown or other
  misc_feature (226)..(226): n is a, c, g, or t
  modified_base (505)..(505): a, c, t, g, unknown or other
  misc_feature (505)..(505): n is a, c, g, or t
  modified_base (526)..(526): a, c, t, g, unknown or other
  misc_feature (526)..(526): n is a, c, g, or t
  modified_base (529)..(549): a, c, t, g, unknown or other
  misc_feature (529)..(549): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctatttattcngtgcgaaggaggcatagtgggaagtacgtattttcgactcccctcgcagtcgactactttgattacgtgggggcccgggaaccctgggtccgccgtctcctcagccctccaccgaacgggcccagtccggtcccttccccctggccacccctccgtacccaaagacgcctacccgttcggtcgggggccaacgaggcccggtccccgtggggcctacggcccgttggtacaaacgggtaccttaccttaccgagtaccgtatccacgtcgagcgggtcnggaccgaaggccgatagtagnacnnnnnnnnnnnnnnnnnnnnn

SEQ ID NO: 133047 - DNA, 586 bp, Homo sapiens
  misc_feature: GYAE6OF02FLJD2.9.34.D01.1.454.CMB.1.raw
  modified_base (329)..(329): a, c, t, g, unknown or other
  misc_feature (329)..(329): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaaactccgtgaggggccgcttcatcatctccagagacaattcccagaacatactgtctctgcaactcaataacctgagaggcgaggacacggccatttatttctgtgcgaaggngcatagtagggaagtagtattttcgattccctcgcagtcgactactttgattacgtggggacccggggaccctggtcgccgtcctcctcagccctcccaccgaacgggcccagtccggttccttcccccgtcgcccaccccttccctcccgaacgacgccacccgttccgtcgggggccacgacggccggcccgtcgggcctcggccgtcggtacaacggtacctacgttccgacggtaccgtatccacgtggacgg

SEQ ID NO: 133048 - DNA, 615 bp, Homo sapiens
  misc_feature: GYAE6OF02HNNJF.9.34.D01.1.454.CMB.1.raw
  modified_base (308)..(308): a, c, t, g, unknown or other
  misc_feature (308)..(308): n is a, c, g, or t
  modified_base (345)..(345): a, c, t, g, unknown or other
  misc_feature (345)..(345): n is a, c, g, or t
  modified_base (369)..(369): a, c, t, g, unknown or other
  misc_feature (369)..(369): n is a, c, g, or t
  modified_base (445)..(445): a, c, t, g, unknown or other
  misc_feature (445)..(445): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagcccgccctcagtgtctcggggccccagggcagagggtcaccatctcgtgcactggaagtacgctaccaacatcggggcacgttatgatgtacacgtggtaccaacaacttccaggaacacgcccccaaaagtcagtacatttacngacaacatgaagcgccctcgacgggtccctgaccgtnttcgtccggctcgaagtctggcanactcgacgcctccaggccaatcacgtcggcctccgaggccgtgaggtctaggacggcttaggtaattacgtttacncgtacccacgttaccgtagtacgtaacacgcctacggtccctaagggaacggtaagtttggttacgggttacgtttccggggacgggtaacgggaacctaacgccggttacggaccccgttacggttacggtaccgaaccggtacccgaaccgggtccgttacccccggg

SEQ ID NO: 133049 - DNA, 954 bp, Homo sapiens
  misc_feature: GYAE6OF02IQB4N.9.34.D01.1.454.CMB.1.raw
  modified_base (251)..(251): a, c, t, g, unknown or other
  misc_feature (251)..(251): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgacaaactccgtagagggccgcttcatcatctccaganacaattcccagaacatactgtctctgcaactcaaataacctgaagaggacgaggaccacgggacctaattttaactttctgttgaccggtaaagggaggtaccaagttagtacggggaaacgttacgtaacgttttttacgaacttcccccgtaccggacgtaacggtacccggtaactaaccgttttagtacgttttaaaccgggtacgggggggtaccccgggggggttaaaacccccgtttcgggggtacccgggttacccccggtttaccccgttaccccgttaccggtaaaccggttacccccgttaacccccgaaaaccccgggtaaaaccggggggtaccccccttaaaccgggttttaccccggggtttaccccccgttttaccccccccggttaccgggtaaccccgtaaccccccccgtttaccccgtttaacccccgaaaaaccgggttaccggtaaccccgttaaacccccggttaccgggtttaaccggggggggtacccttaaacccgggaaacccggggtaccccgggtaacccccgggttcgggggttaaccccgttcccgggttaaccccgggtttacggggtaaacccggttaaaaccgggttaccccgttttaacccggtttaccccgtaacgggttaaaccccgttaaccgttaacccggtaccggttaacggtaaccggggg

SEQ ID NO: 133050 - DNA, 536 bp, Homo sapiens
  misc_feature: GYAE6OF02GKOR4.9.34.D01.1.454.CMB.1.raw
  modified_base (465)..(465): a, c, t, g, unknown or other
  misc_feature (465)..(465): n is a, c, g, or t
  modified_base (500)..(500): a, c, t, g, unknown or other
  misc_feature (500)..(500): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaactgttggagtcgtgggggaggcttggtccagccgtgggggatccctgcgactctcctgtgtggcctctggattcacctttgagacctatgccttgacctgggtccgccaggctccgaggggaggactgggagtggggtcgcgaggcagtcgctgggtggcggtcatgacacattcacgacaaactccgtggacggggcctcttcatcatctccagacgacaacttcccaagaacatactgtctctcgacaactcaatacctagagngcgagacacgctatttattctgtgcggaaggcganatagtaggaacgtcgtatttcgacttccctcgtacg

SEQ ID NO: 133051 - DNA, 876 bp, Homo sapiens
  misc_feature: GYAE6OF02H3YPY.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcacgccgccctcagtcgtcgtcggggccccagggccaggacgggtcaccatcctcgtgcacgtggaagtacgcctaccaaacgagtaccggggaactccggacttaagttcggtttacgtaacctacgttcgggtaaccctaggaccgtaacggtccttaacccggaaagggtaaacccctacccggtttaaccccccccaaaaacccctttctaaacgttccgttaaaggttaacgggttaaaattaacggttaaaccgttccccgggtaccccgtttacggaacccggggggttccccctttaaggtaacccggttatttcccgttaccggttacgggtacccttaaccgtaaacggtttcccgttacgggaccctaccccgttacgacccgtcccccgttccgtccggaccctaacgtccgtaaccgggtttcggggtccctttacggaacgggtcgttaacggggtaacgtaggtaccgggtaacgggtcctttaacgggttaaaactttttccggtttaaacccgccgttaaccccttaacgtttaccggttaagtaccgggaacctacggaaccgttacgtaacccgggttaaggtaaagggttaaacgggttcggggttaccgggtttaacgggtaccccgggggtaaggggtaaacccgggtaaccgtacgggtaccgttaacccggg

SEQ ID NO: 133052 - DNA, 581 bp, Homo sapiens
  misc_feature: GYAE6OF02FJ2A5.9.34.D01.1.454.CMB.1.raw
  modified_base (241)..(241): a, c, t, g, unknown or other
  misc_feature (241)..(241): n is a, c, g, or t
  modified_base (321)..(321): a, c, t, g, unknown or other
  misc_feature (321)..(321): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggcccccagggcagacgggtcaccatctcctgcactgggancagctccaacatcgggaatcgctatgttgtacactaggtaccaacaacttccaggaacacgccccaaagtcatcatttangacaacatagagcggccctcgacgggtccctgaccgtattcgtccggctccaagtccgtaggcacatcacgtccctcccgtcggccactccacgtcgggccttccgaggctggaggtatggacggctagtacttaacgttactcgtaccgtagtacgttagtacgacgtacggtcggtaaccgttaaacggtaactacgttaccggttacgtttacccggaacggttacggggaaccgtaacgggtaccgtaaccccggg

SEQ ID NO: 133053 - DNA, 548 bp, Homo sapiens
  misc_feature: GYAE6OF02JIZOX.9.34.D01.1.454.CMB.1.raw
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (482)..(482): a, c, t, g, unknown or other
  misc_feature (482)..(482): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaactgttggagtcgtgggggaggcttgggtccaggccgtgggggactccctgcgactctcctgtgtggcctctggattcacctttgagacctatgccttgacctgggtccgcaggctccgaggggaggactgggagtgggtcgcgaggcagtcgctggtgcggtcatgacacntcacgcaaactccgngacggggccnttcatcatcncaganacaatccagaacatctgtctactcgcaactcaaactacctagagaggcgacggacacggactatttacttcngttagcggaaacggagactacgtaagtacgggaagttacggtattttaccgacttcccgtacgtac

SEQ ID NO: 133054 - DNA, 667 bp, Homo sapiens
  misc_feature: GYAE6OF02IH99J.9.34.D01.1.454.CMB.1.raw
  modified_base (323)..(323): a, c, t, g, unknown or other
  misc_feature (323)..(323): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaaactccgtgaggggccgcttcatcatctccagagacaattcccagaacatactgtctctgcaactcaaataaccctgagaggacgaggacacggacattttactttntgtgacgaaggaggcaatagtgggaaagttacgtatttttcgactcccctcgcacgtcgactacttttgatttaccgtggggaccgggaaccgtcggtaccgccgtctacctccagtccctccaaccgaacgggccctaacgttccggttcccttccccgtcggccctacccctccgtacccaagcgaccctaccgtacggttcggggccaacgtacggccgggtcccgtcggggccgttcggcccggttaccgggtacgtaaaacccggggttcctttaaaacccggtttcccgaacggttaacccggttaaccgttaccgtaccggttacgggaacccgggg

SEQ ID NO: 133055 - DNA, 643 bp, Homo sapiens
  misc_feature: GYAE6OF02I0RG6.9.34.D01.1.454.CMB.1.raw
  modified_base (609)..(609): a, c, t, g, unknown or other
  misc_feature (609)..(609): n is a, c, g, or t
  modified_base (615)..(615): a, c, t, g, unknown or other
  misc_feature (615)..(615): n is a, c, g, or t
  modified_base (630)..(630): a, c, t, g, unknown or other
  misc_feature (630)..(630): n is a, c, g, or t
  modified_base (639)..(639): a, c, t, g, unknown or other
  misc_feature (639)..(639): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtcgcgaaggagactatagttagggaacgttacgtagttttacgattccccctccgacgtacgtacgactaccgttttaggactttaacggtcggggggacccgggacccttggtccggcccgtctccgtcgacgtccctaccgaccgaaggccccagttccgtccttccccgtggccctaccctcctccgaacgtacgactacccgtcgcggggacacgtaggcccggtcccgtgggccttacggtcccgttagggtaccgtaaacgggtaccttaacccgttaccgaggtaacccggttacttaccgtaccgttacggaacggccgggtcgtacgggcctaaacgggtcgaccggtaactacggcgcgcgcgcgcgacgcgngcgacncgacgacgagacgcncgacgcgcncgac

SEQ ID NO: 133056 - DNA, 948 bp, Homo sapiens
  misc_feature: GYAE6OF02GS3I8.9.34.D01.1.454.CMB.1.raw
tcagtgatacgtctcacgaccggtgctcgatttagatcgtctgtgttggggtttgggggctctgcttcagctgtgggcacaagaggcagccactcaggaccaatctccagcatggcctggtctcctctcctcctcactctcctcgctcactgacacacgggtcctcgggcccagtctgttctgacgcacgccggccctgaggtgtacgtcggggccccgagggcaggagggtccaccatccgtcgtgacctacgtgggaacgtacgcctaccaaacgtacggtccggggacctaaccggtttatacggtagttcggtaaccgaaccgttacgggtaacccctaaaccgtaaacccgtttacccggaaacgggtaaaccgaccggtaaccccccgtaaaaaggttccgtaaacttaccgttaaagttttaacgtaacggaaaacctaaacgtacgttaacgggaaaccgggtacccgggtaaccccgttaccgggtaaccgggggtttaccccgtaacgggtaacccggttaaccgttttccccgggtaccccggggtacccgtttaaccccggtaaacggtttcccggtaccggggtacccgaaacccgtacgttacccgtaaaccgttcccccgttacccccggttacggggtaaccccttaaacgttacccgtaaccgggttaccgggtacccgttacccgggtaacgggtcccggttaagggaaaccgggttacgttacgggtacgggttacccgttacggtaacccgtttaacgttacccgttaaccggtacccgttaacgggttaccgttaacggtaccggtaacgttacgggtaccgggttaacccgttaaacggttaaccgtacgtttacccggttacgttaaccgggtaacggttacccggggtaacccgtaaccgggttccccgtaacccggttccggg

SEQ ID NO: 133057 - DNA, 644 bp, Homo sapiens
  misc_feature: GYAE6OF02GAPTK.9.34.D01.1.454.CMB.1.raw
  modified_base (140)..(140): a, c, t, g, unknown or other
  misc_feature (140)..(140): n is a, c, g, or t
  modified_base (377)..(377): a, c, t, g, unknown or other
  misc_feature (377)..(377): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataacctgagaggcgaggacacggccatttattctgtgacgaaggagcatatagggaagtacgtattttcgactccctccgcagtcgactactttagactttacggtcgggggaccgggtaaccctgggtccgccgtctcctcacgtccctaccaccgaacgggccctagttccggtcccttccccnggccctacccgtcctaccgaacgtcgccaccgtcggtcggggacaccgacggccggcccgtggggcttcggccgtgggtaaccaacggtaccttaaccgttcccgaagaccggttaactcccgtacgtaggaccgggtccggggtacgttacgggaccggaaacgggtcccgtaacgggtacgttaacgggacgcgtacgtacgtacgtcgacgtacgtacgtacgtacgacgtacgcgcgacgtacgacgacgtcgtacacgtacg

SEQ ID NO: 133058 - DNA, 607 bp, Homo sapiens
  misc_feature: GYAE6OF02HGLM5.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctgggccccagggcagagggtcaccatctcgtgcactggaagtagctccaacatcggggcacgttatgatgtacactggtaccaactacttccaggaacagaccccaaagtcatcatttatgacaacatagaacgcgcctcgacggggtccctagaccgtattctccggctccgaagtctacggtcacgtactaccagccctacccgtggaccacgtccacgtggaccttccagggccttagacggacgttagacgggtacttacgtaccgttaacttacgtcgacccgtaaggttccgtagttacggacgtaggttacggtaaccctaaaggttaaccgtaagttaccggtttacgttaccgggtaaccgtacggggtaaccccgtaagggttacctacccggttaccgg

SEQ ID NO: 133059 - DNA, 529 bp, Homo sapiens
  misc_feature: GYAE6OF02I3LQH.9.34.D01.1.454.CMB.1.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (456)..(456): a, c, t, g, unknown or other
  misc_feature (456)..(456): n is a, c, g, or t
  modified_base (463)..(463): a, c, t, g, unknown or other
  misc_feature (463)..(463): n is a, c, g, or t
  modified_base (471)..(471): a, c, t, g, unknown or other
  misc_feature (471)..(471): n is a, c, g, or t
  modified_base (495)..(495): a, c, t, g, unknown or other
  misc_feature (495)..(495): n is a, c, g, or t
  modified_base (523)..(523): a, c, t, g, unknown or other
  misc_feature (523)..(523): n is a, c, g, or t
  modified_base (526)..(526): a, c, t, g, unknown or other
  misc_feature (526)..(526): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggaggactggagtgggtcgcaggcatcgctggtggcggtcatgacacattcacgcaaactccgtgagggccncttcatcatctccaganacatccagaacatactgtctctgcaactcaataacctgagaggcgaggacacggacctatttattctgtgacgaaggagacagtagtagggaagtacgtattttcggacttcccgtcgcacggtcgactactttgacttacggtcggggaccgggtaccgtggtccgccgtctccgtcacgcctaccacgacggccagtccgtcctcccngcctccncacaagcncacgtcgcgggacacgcgcgccgngctgcctggacagctacgtcgagcgtancangcg

SEQ ID NO: 133060 - DNA, 684 bp, Homo sapiens
  misc_feature: GYAE6OF02IYFLU.9.34.D01.1.454.CMB.1.raw
  modified_base (318)..(318): a, c, t, g, unknown or other
  misc_feature (318)..(318): n is a, c, g, or t
  modified_base (425)..(425): a, c, t, g, unknown or other
  misc_feature (425)..(425): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttctgacgcagccgccctcagtgtcgtggggccccagggcaggacgggtcaccatctcgtgcactgggaacgtgctaccaacagtcggggctacgttatgatgtacactggtaaccaactaacttccaggaaccacgaccccaaagtcatctatttatagaacaanatgaacgcgccctacgacgggtccctcgacgtacttccgtccgactccaagtctaggcaactactacaccgcccgtacccgtcggaccacttccgacgtccgggtcncccgtaggtcgtaggaacggtatacgggaagtcgtacgttaacgttactttacgtaccggaccgtacggttacgtttagtaacggtacgtaacgggttaccggtaaccgttaaaacgttaaccgttaccggtaccgtttaacggttaccgggaacgttaccggggaacccgttaacggtacccgtaccgggttaccgtcgggttaacccacggtaccccggaaaccggtaccccctaaaccccgtagtaccgtaccccg

SEQ ID NO: 133061 - DNA, 621 bp, Homo sapiens
  misc_feature: GYAE6OF02F3AFU.9.34.D01.1.454.CMB.1.raw
  modified_base (280)..(280): a, c, t, g, unknown or other
  misc_feature (280)..(280): n is a, c, g, or t
tcagtgatacgtctcacgaccggtgctcgatttagatcgtctgtgttgggtttgggcatgtgtgagttttgtcacaagatttgggctcaactttcttgtccaccttggtccagcctggggagtccctgcgactctcctgtgtggcctctggattcacctttgagacctatgccttgacctgggtccgccaggctccagggggagggactgggagtgggtcgcaggcatcgctgggtggcggtcatgacactattctacgcaaactccgtggacggggccncttcatcatcctaccagacgactaattcccaagaacatactgtactctgacaactcaaataacctgagaggcgaagacaccggcctaattttacttctggtcgacggaaaggcggctaagtaggtagggaaagttacgtattttacgacttcccgtcgctacggtcactactttagaactttacggtcgggggtacccgggtaacccttgggtccgtcccgttctcccgtacacgccctaccgaaccgaacgggccctagtcccgttccctcccgcgtaccctccctcctaccgaacgccgacctaccgtcgggtacgacccacggaccggccggtcccgg

SEQ ID NO: 133062 - DNA, 565 bp, Homo sapiens
  misc_feature: GYAE6OF02GXPC4.9.34.D01.1.454.CMB.1.raw
  modified_base (158)..(158): a, c, t, g, unknown or other
  misc_feature (158)..(158): n is a, c, g, or t
  modified_base (189)..(189): a, c, t, g, unknown or other
  misc_feature (189)..(189): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (529)..(536): a, c, t, g, unknown or other
  misc_feature (529)..(536): n is a, c, g, or t
  modified_base (538)..(565): a, c, t, g, unknown or other
  misc_feature (538)..(565): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagcccccaaagtcatcatttangacaacatgaagcggccctcgaggggtcccngaccgattcctccggctcccaagtctggcacatcagccctcccgtggccatcacgtgggcctccgaggctgaggatggaggctagacttattacngccagtcgtatgacngtcgactaagtacatcgtacttcggaacgtggaaccaaggtccaccggttcctggggtaccacggtaccccgaaacggcccctaaacccccgagtttcgtaccgtacccttccttcccgggttccccctccccttacccgacgaacgttaacccgttacgtaccctaacggtcggggaacgggacccggggtcttacggggaaccgtaacggggcccgtacaaagttcgnnnnnnnngnnnnnnnnnnnnnnnnnnnnnnnnnnnn

SEQ ID NO: 133063 - DNA, 636 bp, Homo sapiens
  misc_feature: GYAE6OF02H3T32.9.34.D01.1.454.CMB.1.raw
  modified_base (377)..(377): a, c, t, g, unknown or other
  misc_feature (377)..(377): n is a, c, g, or t
  modified_base (553)..(553): a, c, t, g, unknown or other
  misc_feature (553)..(553): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaaactgttggagtcgtgggggaggcgttggtccagcctgggggatcccgtgcgactctcctgtgtggcctcgtggtattcacctttgagacctatgccttgacctgggtcccgaccaggcctccgagggggacggacgtgggtgtcggggtcgacgaggcagtcgctgggtggacggtcngttcggactacacttcgtaacgctaaaactcccgtaggacgggggcctcttccaatcagtcctccgaagacgactaaacttcccaagaacaactaacgtcgtctcttcgactaactcaaattaacccgagaagacgggacgacggaaccttaccgggaccttaagtttactttcgngttacggaccgaaagggtacgacgaagttaacgtggggtaaagtaaccggtatttttaccgggaacttccccgttacgaccgg

SEQ ID NO: 133064 - DNA, 622 bp, Homo sapiens
  misc_feature: GYAE6OF02JDQ43.9.34.D01.1.454.CMB.1.raw
  modified_base (191)..(191): a, c, t, g, unknown or other
  misc_feature (191)..(191): n is a, c, g, or t
  modified_base (286)..(286): a, c, t, g, unknown or other
  misc_feature (286)..(286): n is a, c, g, or t
  modified_base (558)..(558): a, c, t, g, unknown or other
  misc_feature (558)..(558): n is a, c, g, or t
tcagtgatacgtctcacgaccggtgctcgatttagatcgtctgtgttgggtttgggcatgtgtgagttttgtcacaagatttgggctcaactttcttgtccaccttggtccagcctggggagtccctgcgactctcctgtgtggcctctggattcaccttttgagacctatcgccttgaccctggggtccnccaggcctccgagggggaggactgggagtggggtcgcaggcatcgcgtgggtggcggtcatgacactattctacgcaaactccgtgacggggccncgttcatcatctccagacgactaacgttcccagaacatactgtctctgacaactcaataacctgagtaggacaggacacggcctaattttacttctgttagacggaaaggcgactagtagtagggtaatacggtattttacgactacccgtcgactacggtcacgtactttagtactttacggttcggggacccgggtaaccgttggtacccggtccgttccgtcctacgcgtccctaccgacgaaccggcctacgtccggtcctaccccgngaccctacccgtctaccgacgtaccgcctaccggtcggtacgggccacgtacggccggtcccgg

SEQ ID NO: 133065 - DNA, 645 bp, Homo sapiens
  misc_feature: GYAE6OF02I3JNP.9.34.D01.1.454.CMB.1.raw
  modified_base (239)..(239): a, c, t, g, unknown or other
  misc_feature (239)..(239): n is a, c, g, or t
  modified_base (447)..(447): a, c, t, g, unknown or other
  misc_feature (447)..(447): n is a, c, g, or t
tcagtgatacgtctcacgaccggtgctcgatttagatcgtctgtgttggggtttgggggaggcttggtccagcctgggggagtccctgcgactctcctgtgtggcctctggattcacctttgagacctatgccttgacctgggtccgccaggctccagggggagggactggagtggggtcgcaggcatcgctggtggcggtcatgacacattctaacgcaaaactccgtgagggggccncttcatcactctccagagacaattcccagaacatactgtctctgcaactcaaataacctagagaggcgaggacacggccagtttatttctgtgcgaaggacggcatagtggggaacgtagaattttcggatccctccgcagtacgacctactttggattacgtcgggggacccggggtaacccgtcggtccgcccgtctccgtcgacncccgtccaacccgaacgggacccgtactcgggtccttcccccgtaccggcccaccctaccctaccaaacgacgaccctacctccgtacgggggacctaccgaacggaccggcccgtcgggcctcggtacccgtacgggttacgaaacggtacgtaaccttacccgaacgtaaccttagtaccgacgtaggtaaccggg

SEQ ID NO: 133066 - DNA, 577 bp, Homo sapiens
  misc_feature: GYAE6OF02FS743.9.34.D01.1.454.CMB.1.raw
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (565)..(566): a, c, t, g, unknown or other
  misc_feature (565)..(566): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(577): a, c, t, g, unknown or other
  misc_feature (572)..(577): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgactctttgattacgtgggggccggggaaccctggtccgccgtctcctcagcctccacaacgggcccatcggtccttcccctcgcgaccctcctccaacgacgcaccgtccgtggggccgaacacgccgggtccccgtacgggtcgtacgcccgtcggtaccgaaacgggaccttaaccgttacccgtaacggtaaccgttaacgtaccgtaccttacggacgggccggggtccgtacgggacggaaacggccggacctagttaaccggngcgagngncgagacgngcgncnngngncnnnnnn

SEQ ID NO: 133067 - DNA, 604 bp, Homo sapiens
  misc_feature: GYAE6OF02FG5AF.9.34.D01.1.454.CMB.1.raw
  modified_base (486)..(486): a, c, t, g, unknown or other
  misc_feature (486)..(486): n is a, c, g, or t
tcagtgatacgtctcacgaccggtgctcgatttagatcgtctgtgttggggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacggcaaacctccgtggaggggccgcttcatcatctccagacgacaattcccagaacatactgtctctgcaactcaataacctgagaggcgagacacggcctatttactttctgtagacgtaagggaggacatagtggggaacgtacgtagtttttcgacttcccctccgactagtccgtaactacttttagactttacgtcggggcccggggtaaccctggtccgtccgtctccgtcacgccctaccaccgaggcccagtccggtccttccccgngacctacccgtcacaccaagacgaccactcggtgggaccaccgagcccggacctgggccgttcgtccgtacggtctaacggtaccttaccgttaccgaagaccgtactcgacgtacgg

SEQ ID NO: 133068 - DNA, 673 bp, Homo sapiens
  misc_feature: GYAE6OF02HV05M.9.34.D01.1.454.CMB.1.raw
  modified_base (288)..(288): a, c, t, g, unknown or other
  misc_feature (288)..(288): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacgagggtcctgggcccagtctgttctgacgcagcccgccctcagtgtcgtggggcccccagggccaggagggtcaccatctgtgcactaggaagtagctaccaacagtcggggctacgttatgatcgtacactaggaccaaacactaccgaagaacncgaccccaaagtcatctatttangaacaanatgaagccgcctcgacgggcccctgaccgtattccgtccggactaccgtaagtcctaggaccaacatccacgtccccgtcccgtacggcctaacgtcctaacggtccgggccttaccggaacggtccgttaggaagggtactacggtacgggacttacggaaacctttagttaaacccgtgaacccgtaggttaccgttaacgtacgaaacgtacggttacggaaccttaaaagtaaaccgtacgttccggtttacgttaaccgggaacgttcgggaaaccgtaaacggtccgtaccggtcccgttagggtccaacggacccgaaacccggtcccaaacccgtcgtacgtacccg

SEQ ID NO: 133069 - DNA, 563 bp, Homo sapiens
  misc_feature: GYAE6OF02GA9ES.9.34.D01.1.454.CMB.1.raw
  modified_base (218)..(218): a, c, t, g, unknown or other
  misc_feature (218)..(218): n is a, c, g, or t
  modified_base (272)..(272): a, c, t, g, unknown or other
  misc_feature (272)..(272): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (502)..(502): a, c, t, g, unknown or other
  misc_feature (502)..(502): n is a, c, g, or t
tcagtgatacgtctcacgaccggtgctcgatttagatcgtctgtgttgggtttgggcatgtgtgagttttgtcacaagatttgggctcaactttcttgtccaccttggtccagcctggggagtccctgcgactctcctgtgtggcctctggattcacctttgagacctatgccttgacctgggtccgccaggctccaggggaggactggagtgggtcncaggcatcgctggtgcggtcatgacacattctacgcaaactccgtgaggggccnttcatcatctccagagacaattcccagaacatactgtctctgcaactcaaataacctgaagaggcgaaggacacggcctattttatttcngtgcgaaaggnggcatagtgggaagtacgtattttcgacttccctcgctagtccgactactttgattacgtcggggaccgggaaccctggtccgccgtctcctcacgcctccgaccagggcccagtcgtcccttccccgnggccctaccctcctaccaacgacgcccaccgttcggtccggggacacgacggccggtcccg

SEQ ID NO: 133070 - DNA, 520 bp, Homo sapiens
  misc_feature: GYAE6OF02HM36B.9.34.D01.1.454.CMB.1.raw
  modified_base (352)..(352): a, c, t, g, unknown or other
  misc_feature (352)..(352): n is a, c, g, or t
  modified_base (482)..(520): a, c, t, g, unknown or other
  misc_feature (482)..(520): n is a, c, g, or t
tcagtgatacgtctcacgaccggtgctcgatttagatcgtctgtgttgggtttgggggggcacgttatgatgtacactggtaccaacaacttccaggaacagcccccaaagtcatcatttatgaacaacatgaagccggccctcaggggtcccctgaccgattcctcccggctacccaagtctggcacatcagccctccctggccatcacgtgggcctccgaggctgaggatgaggctgacttattactcgcctagtcgtatgacagtggacctaagtaacatcgtcttcggaactggaaccaggtccaccgtccgtagggtcacggaccccgaacggacccccaaaccccncgttacgtccaaccttcccgttaccgtttaccccccaaccccctttcctacgaaccgtaaccgtttactcctaacgtcggagggcccgggtctacggggacctaaacggggccctagtaacgtagctagnnnnnnnnnnnnnnnnnnnnnnnnnnnnnnnnnnnnnnn

SEQ ID NO: 133071 - DNA, 618 bp, Homo sapiens
  misc_feature: GYAE6OF02IA9LI.9.34.D01.1.454.CMB.1.raw
  modified_base (595)..(595): a, c, t, g, unknown or other
  misc_feature (595)..(595): n is a, c, g, or t
  modified_base (598)..(603): a, c, t, g, unknown or other
  misc_feature (598)..(603): n is a, c, g, or t
  modified_base (605)..(618): a, c, t, g, unknown or other
  misc_feature (605)..(618): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctattttattctgtgacgaaggagcatagtgggaagtacgtattttcgatcccctaccgcagtcgactactttgattacgtcggggacccggggtaaccctgggtccgtccgttcctcccgtcgacgtccctcctaccgaacggggccctacgtccggttacccttccccccgtggtacccctaccccgttccctacccaaaggtaccgaccctacccgtcggtcgggggaccaccgtacgggcccggtacccgtcggggtcctcggtcccgttcgggtaccaaacgggtaccttacctttcccgaacggtacccgtaactttccgaacttacgggacggccgggtctagggccaacggggcccgacctaagtacgctcncgnnnnnngnnnnnnnnnnnnnn

SEQ ID NO: 133072 - DNA, 620 bp, Homo sapiens
  misc_feature: GYAE6OF02I0VN4.9.34.D01.1.454.CMB.1.raw
  modified_base (236)..(236): a, c, t, g, unknown or other
  misc_feature (236)..(236): n is a, c, g, or t
  modified_base (378)..(378): a, c, t, g, unknown or other
  misc_feature (378)..(378): n is a, c, g, or t
tcagtgatacgtctcacgaccggtgctcgatttagatcgtctgtgttgggtttgggggaggcttggtccagcctgggggagtccctgcgactctcctgtgtggcctctggattcacctttgagacctatgccttgacctgggtccgccaggctccgaggggagggactggagtgggtcgcaggcatcgctgggtggcggtcatgacacattcacgacaaactccgtggaggggccncttcatcatctccagagacatcccagaacatactgtctctcgacaactacaactaacctggagacggcgaggaccacggacctattttattctgtagacggaaggagcagtagtagggaaactacgtattttcgacttcccncgcagtcgactcttgacttacggcggggccgggtacccgtggtccgccgtctcctcacgtcctaccgaccgaacggcccattccggtacccttccccgcgtacccgaccctcctaaccgaacgccgacccgtaccgtcgggtcggggaccacgcggacccggtcccgtcggggcctccgtcccggttcggacgtaacggtaccttaccgtaccgacggtacgttactacgtactggtacggg

SEQ ID NO: 133073 - DNA, 600 bp, Homo sapiens
  misc_feature: GYAE6OF02FKVEJ.9.34.D01.1.454.CMB.1.raw
  modified_base (231)..(231): a, c, t, g, unknown or other
  misc_feature (231)..(231): n is a, c, g, or t
  modified_base (292)..(292): a, c, t, g, unknown or other
  misc_feature (292)..(292): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
  modified_base (598)..(598): a, c, t, g, unknown or other
  misc_feature (598)..(598): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaaccatactgtctctgcaactcaataacctgacgaggcgaggaccacggcctattttatttcnggttgcgaagggaggcatagtgggaagtacgattttcgatccctccgcagtcgacactttnattactgggccggaaccgttggtcgccgtctcctcagcctccaccaacgggcccagtccggtccttcccccgtcggccaccccttcctacccaaacgtacgccaacccttcgtcggggggtaccaccgacgccgggacccctcggggctcgcccgtgggttaccgaaacgggtacctaccgtttcccaggtaccgttaactccaacgtcgaaggtccggggccttacgggcctaaacggggccgtaccgaacttaacggcgactagctcgcncnctcgtncncncncgacgacncgagtnacgtcntc

SEQ ID NO: 133074 - DNA, 645 bp, Homo sapiens
  misc_feature: GYAE6OF02HEY2L.9.34.D01.1.454.CMB.1.raw
  modified_base (241)..(241): a, c, t, g, unknown or other
  misc_feature (241)..(241): n is a, c, g, or t
  modified_base (273)..(273): a, c, t, g, unknown or other
  misc_feature (273)..(273): n is a, c, g, or t
  modified_base (356)..(356): a, c, t, g, unknown or other
  misc_feature (356)..(356): n is a, c, g, or t
  modified_base (396)..(396): a, c, t, g, unknown or other
  misc_feature (396)..(396): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctggggtccgccaggctccgagggggagggactgggagtgggtcgcaggcatcgctggtggcggtcatgacacattctacgacaaaacgtccgtggacggggccncttacatcactcctacagagacacttcccaanaacatactgtcctctgacaactacaaactaacctgaggaaggcgaggacaccggacctattttatttctagtcggacgaaggnggactagtagtagggaaatacgtattttcgactcctccgnacggtcaactactttagtacttacgggcggggacccggggtacccgtcggtccgccgttctcctcgacgtccctaccgaccgacgggaccctacgtccggttcccttccccgtcgccctaccctccctaccgaacgaccgcctaccgtcggccggggaccacggacgcccggtccggcggtccgtcggtcccggttacggtacgaacggttaccttaccttaccgacgtaccgtactcgacgtgacggg

SEQ ID NO: 133075 - DNA, 682 bp, Homo sapiens
  misc_feature: GYAE6OF02F2EK5.9.34.D01.1.454.CMB.1.raw
  modified_base (202)..(202): a, c, t, g, unknown or other
  misc_feature (202)..(202): n is a, c, g, or t
  modified_base (643)..(643): a, c, t, g, unknown or other
  misc_feature (643)..(643): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
  modified_base (651)..(651): a, c, t, g, unknown or other
  misc_feature (651)..(651): n is a, c, g, or t
  modified_base (665)..(665): a, c, t, g, unknown or other
  misc_feature (665)..(665): n is a, c, g, or t
  modified_base (667)..(668): a, c, t, g, unknown or other
  misc_feature (667)..(668): n is a, c, g, or t
  modified_base (679)..(679): a, c, t, g, unknown or other
  misc_feature (679)..(679): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaaactccgtgaggggccgcttcatcatctccagagacaattcccagaacatactgtctctgcaactcaataacctgagnggcgaggacacggccattttattctgtgcgaaggtggcatatgggaagtacgattttcgatccctcgcagtcgactactttgattacggtcgggggacccggtaaccgtcggtccgtccgttcctcctccgacgtccctcccgtaaccgacgggacccgtacgttccggttaccccgtttcccccgtaggtacccccgtaaccccttacccgtacccgtaaacggtaccggaccctacccgttacccgggttcgggggggaccctaacgggtaccgggtccccgggtcccgggttcggggtacccgttcggtaccccggttacgggttaaccgtaaaccgggttaaccttacccgtttaccgaacggtaccgtttaacgccgtacgttacgggacggtccgggcgttacggcggaaacgggccgtacgtagtacgtgtacncgntntcnacgctgcacgtcgngnntcgtcgtgctngtc

SEQ ID NO: 133076 - DNA, 760 bp, Homo sapiens
  misc_feature: GYAE6OF02FLCYP.9.34.D01.1.454.CMB.1.raw
  modified_base (707)..(707): a, c, t, g, unknown or other
  misc_feature (707)..(707): n is a, c, g, or t
  modified_base (715)..(715): a, c, t, g, unknown or other
  misc_feature (715)..(715): n is a, c, g, or t
  modified_base (738)..(738): a, c, t, g, unknown or other
  misc_feature (738)..(738): n is a, c, g, or t
  modified_base (747)..(747): a, c, t, g, unknown or other
  misc_feature (747)..(747): n is a, c, g, or t
  modified_base (752)..(752): a, c, t, g, unknown or other
  misc_feature (752)..(752): n is a, c, g, or t
tcagtgatacgtctcacgaccggtgctcgatttagatcgtctgtgttggggtttggggattcgacgttgcacgatgtaggtctgggtcgcaggcgatcgctgggtccggcggtcatcgtacacgattcctacgcctaaacgtcccgtggacgggggtcccgcgtttccagtcatcctacccagtacgaacaactttccccaacgaactacttacctgttccttcctgtcctaactccaattaacctggaggaggacgaggacaccgacctattttacttctggtcggacggaaggagacagtagtagggaacgtacgtacgttttcgacttcccgtaccgcgacgtacgaacgtacgtttacgaaccgttaccgggtcgggggacccggtacccgttcggtccgtccgttcgttccgtcgaccgtaccctaccgtaacccggtaaccgggacccgtaccggttcccggttcccttaccccggtcgacccgtaccccgtccgtaccgaacggtaccgtaccgtacccggttccggtacggggtacctaccgaccggtcccggtcccggtcgggtcctcggtccggttacgggaccgtaaccggtacttccgtaaccgacggtaacgttactacgttacgtcggtacgtccgggtagtacggaccgtaaggacccgtacgtaacgttccgacgtcgtcgcgagtcgagngttaacgnggtacacgtacgtcggacgtcgngtaacccgntacgngttactcg

SEQ ID NO: 133077 - DNA, 644 bp, Homo sapiens
  misc_feature: GYAE6OF02H86H7.9.34.D01.1.454.CMB.1.raw
  modified_base (616)..(616): a, c, t, g, unknown or other
  misc_feature (616)..(616): n is a, c, g, or t
  modified_base (621)..(621): a, c, t, g, unknown or other
  misc_feature (621)..(621): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctattttacttctgtcgcgaaggagcagtagtagggaagttacgtattttcgacttccctccgacagtaccgactactttcggtattacggtcgggggacccggggtaacccgttcgggtaccggtcccgttcctccgtcgtacgtccctacccgacccgaacggggccctaacgttccggtcccttccccccgtggtaccacccccttcctacccgaacgacgtaccaacccgttccggtcgggggccaccggacggcccgggtacccgtcggggtcctcggaccgttacggtacgaaacggtaccgttacctcccgaacggtacgttactaccgtacgtacggacggaccgggtcgtcggaaccgacgggtccgacgagttacgacagcgagctcagcngcacncgtctcgatgcncgngacnancg

SEQ ID NO: 133078 - DNA, 741 bp, Homo sapiens
  misc_feature: GYAE6OF02H6CG6.9.34.D01.1.454.CMB.1.raw
  modified_base (236)..(236): a, c, t, g, unknown or other
  misc_feature (236)..(236): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgagggggagggactggagtgggtcgcaggcatcgctgggtggcggtcatgacacattctacgacaaactccgtgacgggccncttcatcatctcagagacaattccagaacatactgtctctgcaactcaataacctagagacggcgaggacgacggccctattttactttcgtgttgacggaacgggaggacaagtaacgtaggggaaacgttaacggtactttttacgaacttccccgttacccgacgtacgtcggtaaccttacgttttacggtaatttacggtacggggggtaccccgggggtaacccgttcggggttaccgtccccggtttcccgtcccttaccggtacgtccccgttaccccgaaacccgaaaccggggaccccctaacggtttccccgggttcccgtttccccccgttacgggccccctaacccccgttccctaccccgtaaacggaccgtacccgtacccgtccggttacgggggtccaaccggacgcccgggtccctcggggccgtacggcccgttggtacgaacgtaccgtaccgttccaggtaccgttagtacctacgtgaccggg

SEQ ID NO: 133079 - DNA, 792 bp, Homo sapiens
  misc_feature: GYAE6OF02H02CC.9.34.D01.1.454.CMB.1.raw
  modified_base (277)..(277): a, c, t, g, unknown or other
  misc_feature (277)..(277): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggtctttttctcgtggcttagttttaaaaggtgtccagtgtgtaggttcaacgttgttggagtcgtgggggaggcgttggtccagccgtggggacgtcccgtgcgactcctccgtgtgtggcctntcggtattcctaccgtttagacgaccttatcgtccttagacccgttcgggtcccgccgacggtcctaccggaggggtacgggacgtgggacggttcgggtccgacgaggactacgtcgtcgtgggtcggtcggtacgagtacgactacgtactttaccgtaacgacctaaaaccgttccggtaggaaccgggggtccctacgtttactaaccgttccgtaaccttcccgttaacccgaagtaacccgaacgttaaaccctttacccgaaacgtaacctaacgttaccgttacgttacctaccgttacctaaccgtaaccgtaaacctaaacgttaacccgttaggaacggtaacgggaccgtaacgggaaccgtacccgggtaacttaacgttttaacgtttccgtacggttcggaacgggtaaacgggtaggtaaccgttaaggtaacgttaacggggtaacgtttacggtttaaccgtttacccggtaccgttaccccggtccgttaacccgg

SEQ ID NO: 133080 - DNA, 904 bp, Homo sapiens
  misc_feature: GYAE6OF02H8SRH.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcaccttttgagacctatgccttgacctgggtccgccaggctccgaggggagggactggaggtgggtcgcaggcatcgctgggtggcggtcatgacacattctacgacaaaccgtccgtggaggggccgcttcactcatctccagagactaattcccagaactatactgtactctgaccaacttacaaacttaacctagaacggacgggacggaacggaaccgacgggtcccttaagtttttaccgttttcgttaggtacggacgggtaaagggacggtacgaaagtttaagggtacggggtaaaacggtttaacgttttagtttttaccggaaccttttaccccccggtacggtacccgtacgggttacccgtaaaccgtttacgttttacggttaacggtttttacccggggtacgggggggtaacccccggggttaacccgggtttccggggttccccgggttccccggttaccctttccccgtaaccgtacccgggttaccccctacccggtaaaaccccggaaccggggtaccccccttaaaccgttccccgggtttaccccccgttttcccccggaccggttacccccgtacccccttacccccgtaacccgtaaacgaacccggttcccgtaccccgttccgggtaccgggggacctaaaccggtaccggggcccgtcccgggttacgggtcccgtcggttcccggttagggtaaacccggtaaccgggttaccctttaccgtaacccggtaacgttaccggttaaccttccggaacgttacgggg

SEQ ID NO: 133081 - DNA, 553 bp, Homo sapiens
  misc_feature: GYAE6OF02HJJX5.9.34.D01.1.454.CMB.1.raw
  modified_base (144)..(144): a, c, t, g, unknown or other
  misc_feature (144)..(144): n is a, c, g, or t
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (343)..(344): a, c, t, g, unknown or other
  misc_feature (343)..(344): n is a, c, g, or t
  modified_base (346)..(346): a, c, t, g, unknown or other
  misc_feature (346)..(346): n is a, c, g, or t
  modified_base (495)..(495): a, c, t, g, unknown or other
  misc_feature (495)..(495): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
  modified_base (531)..(553): a, c, t, g, unknown or other
  misc_feature (531)..(553): n is a, c, g, or t
tcagtgatacgtctcacgaccggtgctcgatttagatcgtctgtgttgggtttgggattcacgttgcagatgtaggtctgggtcgcaggcatcgctgggtggcggtcatgacacatttcacgcaaactccggtggaggggcccncttcatcatctccagagactaattcccaagaacattactgtctgtnacaactnaaatacngagacgngagacacgtctatttattcgngtgacggaaggngactagtagtaggaagtacgtactttcgactccctaccgataggctaactactttagaattaccggacgggggaccggtaacctggtccgccgtctccnncncctaccgaccgaacgggccacgttcggtcccttccccgaggacctaccctctaaccgaaagcgtaccacgttcggacgggactacgacggtccggccgtgggactcgtccgtagtaacgtaaacggtacttacctaccgagtaaccgtnacgacgtagacgggtcgngtagacgagctanatagnnnnnnnnnnnnnnnnnnnnnnn

SEQ ID NO: 133082 - DNA, 464 bp, Homo sapiens
  misc_feature: GYAE6OF02IDW07.9.34.D01.1.454.CMB.1.raw
  modified_base (256)..(256): a, c, t, g, unknown or other
  misc_feature (256)..(256): n is a, c, g, or t
  modified_base (318)..(318): a, c, t, g, unknown or other
  misc_feature (318)..(318): n is a, c, g, or t
  modified_base (437)..(464): a, c, t, g, unknown or other
  misc_feature (437)..(464): n is a, c, g, or t
tcagtgatacgtctcacgaccggtgctcgatttagatcgtctgtgttggggtttggggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctcctggccatcactgggcttcaggctgaggntgaggctgattattactgccctactcccttatgacagcagcctgagaggtgtggtattcggnggaggaccaagctgaccgtctaggtcagcccaaggctcgcccctcggcactctcgttccccaccctcctacacgtactaactcactggacgcgggccgtaggcgaacggcgacatagcnnnnnnnnnnnnnnnnnnnnnnnnnnnn

SEQ ID NO: 133083 - DNA, 546 bp, Homo sapiens
  misc_feature: GYAE6OF02H1FR3.9.34.D01.1.454.CMB.1.raw
  modified_base (238)..(238): a, c, t, g, unknown or other
  misc_feature (238)..(238): n is a, c, g, or t
  modified_base (525)..(546): a, c, t, g, unknown or other
  misc_feature (525)..(546): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaaataacctgagaggcgaggacacggcctatttattctgtgacgaaggnggcatatgggaagtacgtattttcgatccctccgcagtcgactactttgattacgtcggggacccggggtaacccgtggtccggccgtctcctcacgtccctccaaccgaacgggcccagtccggttcccttcccccgtggcccaccctcctaccgaagacgcctacctcggtcggggacacgacggccggtcccgtgggcctcggccgttcggtacgaacggtacctaccgttcccgaaggtaacctactaccacgtggacgcgggctggacaggcgacagtagcnnnnnnnnnnnnnnnnnnnnnn

SEQ ID NO: 133084 - DNA, 569 bp, Homo sapiens
  misc_feature: GYAE6OF02HOHFY.9.34.D01.1.454.CMB.1.raw
  modified_base (140)..(140): a, c, t, g, unknown or other
  misc_feature (140)..(140): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (550)..(569): a, c, t, g, unknown or other
  misc_feature (550)..(569): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataacctgagaggcgaggacacggcctattttatttcgtgtgacgaaggagctaatagtaggggaaagttacgtattttcgacttcccctccgctaggtccgactacttttgaactttacggtcggggggacccggtaaccttgggtacccgtccgttccgtcccgtcgaacgtccctaccgaaccgaacggggaccacgttccggtccctttcccccgtggccctacccttccgacccaaagcgcctacccgtcggtggggaccacgacggcccggcccgtgggcctcggccgtaggtaccaaggtaccctcgttaccgagtaacgtactcgactggaggcggctgggacaggcnangnnnnnnnnnnnnnnnnnnnn

SEQ ID NO: 133085 - DNA, 646 bp, Homo sapiens
  misc_feature: GYAE6OF02HALG7.9.34.D01.1.454.CMB.1.raw
  modified_base (340)..(340): a, c, t, g, unknown or other
  misc_feature (340)..(340): n is a, c, g, or t
tcagtgatacgtctcacgaccggtgctcgatttagatcgtctgtgttgggtcgtgggggaggcttggtccagcctggggagtccctgcgactctcctgtgtggcctctggattcacctttgagacctatgccttgacctgggtccgccaggctccaggggagggactggagtgggtcgcaggcatcgctgggtggcggtcatgacactattctaccgcaaaacctccgtggaggggccgcttcatcatctccagagacaattcccagaacatactgtctctgacaactcaatacctgagaggcgagacacggcctatttacttctgtgacggaggagganatagtaggaagtacgtatttcgactccctcgcagtcgactacgtttgactttcgcgggggtacccggtaacccgtggtccgtcccgtctccgtacgcgtccctacccgacgacggccctagttcccggtacccttcccccgtggcccctaccccttcccgtacccgaacgacgaccctcccgtcggtacggggccaacgtccggcccggtcccgtagggcccgttacgggcccttacggggttaaccaaccgggttaccttaaccgttccgtaaacggttacccgtacttacccggacggtacggg

SEQ ID NO: 133086 - DNA, 644 bp, Homo sapiens
  misc_feature: GYAE6OF02G3Y5J.9.34.D01.1.454.CMB.1.raw
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (330)..(330): a, c, t, g, unknown or other
  misc_feature (330)..(330): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (614)..(614): a, c, t, g, unknown or other
  misc_feature (614)..(614): n is a, c, g, or t
  modified_base (629)..(630): a, c, t, g, unknown or other
  misc_feature (629)..(630): n is a, c, g, or t
  modified_base (632)..(632): a, c, t, g, unknown or other
  misc_feature (632)..(632): n is a, c, g, or t
  modified_base (637)..(638): a, c, t, g, unknown or other
  misc_feature (637)..(638): n is a, c, g, or t
  modified_base (640)..(640): a, c, t, g, unknown or other
  misc_feature (640)..(640): n is a, c, g, or t
  modified_base (642)..(643): a, c, t, g, unknown or other
  misc_feature (642)..(643): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctatttattcngtgcgaaggngcatagtggaagtacgattttcgactccctccgcagtcgactacttgattacgtggggccgggaacccgtggtcgccgtcctcctcgacgcccncctaccgaacgggcccacgtccggtccttcccccgtcgggaccaccccgttcctaccgtaacggacgaccgtacccgtcggttacggggggaccaccggacggtacccgggccccgtcgggtaccgtcggtccccgttcgggtaaccgaaacgggtacccttaaccgttacccgaacggtaaccggtttaaccgtaccgtaaccgtacggtacgggccgggtaaccggttacgggaacggaaccgggtaccgccgttaacggtaagtccgtagccagngngcgngacgcgagacgacgnngngcgcnncncnnc

SEQ ID NO: 133087 - DNA, 796 bp, Homo sapiens
  misc_feature: GYAE6OF02J3K5N.9.34.D01.1.454.CMB.1.raw
  modified_base (236)..(236): a, c, t, g, unknown or other
  misc_feature (236)..(236): n is a, c, g, or t
tcagtgatacgtctcacgaccggtgctcgatttagatcgtctgtgttgggtcgtggggaggcttggtccagcctggggagtccctgcgactcgtcctgtgtggcctctggattcacctttgagacctatgccttgacctgggtccgcaggctccgaggggaggactggagtgggtcgcaggcatcgctggtggcggtcatgacactattctacgacaaacgtccgtgacggggccncttcatcagtctcgagacgacactacccaagaacatactcgtctctgactaactacaatacctgagaggcgaaggtaccaccggtaccttaagttttacgtttccgtaggttacggaaccggaaagggtacggactaaggttaacggagggtaacgttaccgttacgtttaccggaaccgttccccgtacgtactacggttaccgtaaccgttacgtttacggtaaccgtttaccgggtaccggggggggaccccgggtaacccgttgggttaccccggcccgtttacccgttacccgacgttacccgggaaccccttaacccggtaaacccggtaaacccgggttcccttaacccgggttaccggtttccccctccccggtacggaccccttaaccccgtccgtaaccggaaccgtaccggtccctaaccgggttccggggaacgggaccctaacgccgggtcccgtccggtcggtccgtccgtaaccggtacggaaaccgtacgggttaacccttaccggtaaccgccgttacggtaccttaccggtaggtaaccggg

SEQ ID NO: 133088 - DNA, 408 bp, Homo sapiens
  misc_feature: GYAE6OF02IR9QB.9.34.D01.1.454.CMB.1.raw
  modified_base (247)..(247): a, c, t, g, unknown or other
  misc_feature (247)..(247): n is a, c, g, or t
  modified_base (393)..(408): a, c, t, g, unknown or other
  misc_feature (393)..(408): n is a, c, g, or t
tcagtgatacgtctcacgaccggtgctcgatttagatcgtctgtgttgggtttgggggggcacgttatgatgtacactggtaccaacaacttccaggaacagcccccaaagtcatcatttatgacaacatgaagcggccctcaggggtccctgaccgattctccggctccaagtctggcacatcagcctcctggccatcactgggctccaggctgagatgaggctgactattacgtgccagtcgtangacagtggacctaagtacatcgtcttcgaacgtgggaccaaggtcaccgtcctgggtcacggccccaaggcccaaccccactcgtccactctcgttccccacctcctcagtacgtactcactgacgcgggctggcaaggcacatgnnnnnnnnnnnnnnnn

SEQ ID NO: 133089 - DNA, 452 bp, Homo sapiens
  misc_feature: GYAE6OF02HCN1V.9.34.D01.1.454.CMB.1.raw
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
  modified_base (413)..(413): a, c, t, g, unknown or other
  misc_feature (413)..(413): n is a, c, g, or t
  modified_base (419)..(452): a, c, t, g, unknown or other
  misc_feature (419)..(452): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggcccatcactgggctccaggctgaggatgaggctgactatactgccagtcgtatgacaggtcggacctaaagtaacatcgtcttcggaactgggaccaaggtccaccgtctggtcagcccaagcccaacccntgtcactctcgttccccacctctcagactancatgagcggctggacaggcncagtgnnnnnnnnnnnnnnnnnnnnnnnnnnnnnnnnnn

SEQ ID NO: 133090 - DNA, 567 bp, Homo sapiens
  misc_feature: GYAE6OF02FKGNU.9.34.D01.1.454.CMB.1.raw
  modified_base (291)..(291): a, c, t, g, unknown or other
  misc_feature (291)..(291): n is a, c, g, or t
  modified_base (388)..(388): a, c, t, g, unknown or other
  misc_feature (388)..(388): n is a, c, g, or t
  modified_base (520)..(520): a, c, t, g, unknown or other
  misc_feature (520)..(520): n is a, c, g, or t
  modified_base (528)..(528): a, c, t, g, unknown or other
  misc_feature (528)..(528): n is a, c, g, or t
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (564)..(564): a, c, t, g, unknown or other
  misc_feature (564)..(564): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagagcgaggacacggcctatttattctgtgcgaaggaggcattatgggaagtacgatttcgatccctccgcagtcgactactttgatttacgngggggcccgggaaccctggtccgccgtctcctcacgcctccaccacggcccagtccgtccttcccctggcctacccctcctcaagacgccacctcgnggggcacgacgccgcccgtggcctcggccgttggtaccgaacggtaccttaccgttcccgaggtaccgttactccgtacgtaggacggccgggtaccgtcgggacgtaacgggaccgtaccgtagttaacgncgccgtangtcacagcgcgtnacgngngncgtacacgcgtcgtncgc

SEQ ID NO: 133091 - DNA, 550 bp, Homo sapiens
  misc_feature: GYAE6OF02FFF57.9.34.D01.1.454.CMB.1.raw
  modified_base (225)..(225): a, c, t, g, unknown or other
  misc_feature (225)..(225): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (531)..(550): a, c, t, g, unknown or other
  misc_feature (531)..(550): n is a, c, g, or t
tcagtgatacgtctcacgaccggtgctcgatttagatcgtctgtgttgggtttgggattcacgttgcagatgtaggtctgggtcgcaggcatcgctggtggtggtcatgacacattctacgcaaactccgtgaggggccgcttcatcatctccagagacaattcccagaacatactgtctctgcaactcaataacctgagaggcgaggacacggcattttattcngtgacgaaggaggcatagtgggaagtacgattttcgatccctccgcagtcgactactttgattacgtgggggccgggaacctggtccgccgtctcctcacgtcctccaccgaaggggcccatccggtccttcccccgtggccacccttccacccaagcgcacccgtcgtcggggcacgacggccggcccgtgggcctcgcccgttgggtaccaacgggaccttaaccgttccaaggtaccggtaatccgaacgttggacggccgggtcgttacgggacgtaacggcggtacctaagtacgancngnnnnnnnnnnnnnnnnnnnn

SEQ ID NO: 133092 - DNA, 583 bp, Homo sapiens
  misc_feature: GYAE6OF02IG1GY.9.34.D01.1.454.CMB.1.raw
  modified_base (237)..(237): a, c, t, g, unknown or other
  misc_feature (237)..(237): n is a, c, g, or t
  modified_base (559)..(560): a, c, t, g, unknown or other
  misc_feature (559)..(560): n is a, c, g, or t
  modified_base (564)..(568): a, c, t, g, unknown or other
  misc_feature (564)..(568): n is a, c, g, or t
  modified_base (570)..(583): a, c, t, g, unknown or other
  misc_feature (570)..(583): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccattttatttctgtgcgaaggnggcatagtgggaaagtacgtattttcgatcccctccgcagtcgactactttgattacgtcgggggccggggaacccgtgggtccgccgtctcctcgacgccctccaccgaacgggccctacgtccggttcccttcccccgtcggccctaccccgtcctacccgaaacgacgcctacccgtcggtcgggggccaaccgacggcccggtcccgtggggcctcggcccgtcgggtacgaaacgggtaccttaccgttcccgaagtaccgttactccacgttcgacgggccgggacgtcgggacgaacgggccgacgtaagtagcnncgannnnngnnnnnnnnnnnnnn

SEQ ID NO: 133093 - DNA, 812 bp, Homo sapiens
  misc_feature: GYAE6OF02JQ419.9.34.D01.1.454.CMB.1.raw
  modified_base (428)..(428): a, c, t, g, unknown or other
  misc_feature (428)..(428): n is a, c, g, or t
tcagtgatacgtctcacgaccggtgctcgatttagatcgtctgtgttgggtttgggggcgttctgcttcagctgtgggcacaagaggcagcactcaggacaatctcagcatggcctggtctctctcctcctcactctcctcgcctacactgcacagggtcctggggcccaggtcctggttcctgaccgcaggtcccgccctacaggttcgtccggtcgggggcccccaagggggcctaagggacgggttcaccgtacgttcgtccggtgccgtaacgttagggaaacgttacggccttaccgaacgacgttcggggacctacggttaagtcgagttacgtaccagttacggtaacccaactaacctttaccgaacggtaacgaccgtaacccccgaaagtccataccgtattactagacaagagtaanaacggccgtaccgtaccggtacgggtccctacggacccgtattacccgtcggtaccctaccgtaacgtccgtacgggacaacgttaccgcgtaaccgtccccggttacccgtccggaacctacgtaaccgtacccggttaccgggtcccgttaccggtaccgggacgtcgggtaacggtaagttcggaacgtacgtaaccggtaaccttttaaagggtcctttaccgggtaacccgaacggtttaccggtagttaaaccggtcgtaacggttaaccggtaaacccggttaaaagtacctaaccggttaccggtttaaccggacccggttaaacggtaccccgggtaaacgtaacccgggtttcccggaacccgtttacccgggg

SEQ ID NO: 133094 - DNA, 768 bp, Homo sapiens
  misc_feature: GYAE6OF02JK6QK.9.34.D01.1.454.CMB.1.raw
  modified_base (145)..(145): a, c, t, g, unknown or other
  misc_feature (145)..(145): n is a, c, g, or t
  modified_base (230)..(230): a, c, t, g, unknown or other
  misc_feature (230)..(230): n is a, c, g, or t
  modified_base (330)..(330): a, c, t, g, unknown or other
  misc_feature (330)..(330): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccnccaggctccgaggggagggactggagtgggtcgcaggcatcgctggtggcgtcatgacacattcacgcaaactccgtgagggccncttcatcactctccagacgacaacttcccagaacagtactgtctctgcaactcaataacctgagaggcgaggacacgctatttacttcgtgtgcgaaggngacgatagtaggaagtacgtagttttcgacttcccgtacgctacgtacgaccgttaacgtttgtaacgtttacgggtcgggggacccggggtaacccgttcgggtccgtaccccgggttcctcccgtacgtaccggtcccttacccgaaccggaaacccgggtccctaacggttccccgggtttaccctttaccccccggttacgggtacccctacccccgttacccgtacccgtaaaccggtaccgtaccccgttaaccggttcccgggttacgggggtaccccaacggttacccgggcccggtacccggttccggggtcccgttcgggtaaccccggttcgggttaacccgtaaacccggggttaaccctttaacccggttacccggtaacggttaaccggttacccttaccggtaccggttaccggtaccggggg

SEQ ID NO: 133095 - DNA, 553 bp, Homo sapiens
  misc_feature: GYAE6OF02IBL1M.9.34.D01.1.454.CMB.1.raw
  modified_base (483)..(483): a, c, t, g, unknown or other
  misc_feature (483)..(483): n is a, c, g, or t
  modified_base (524)..(524): a, c, t, g, unknown or other
  misc_feature (524)..(524): n is a, c, g, or t
  modified_base (531)..(535): a, c, t, g, unknown or other
  misc_feature (531)..(535): n is a, c, g, or t
  modified_base (537)..(542): a, c, t, g, unknown or other
  misc_feature (537)..(542): n is a, c, g, or t
  modified_base (544)..(544): a, c, t, g, unknown or other
  misc_feature (544)..(544): n is a, c, g, or t
  modified_base (546)..(547): a, c, t, g, unknown or other
  misc_feature (546)..(547): n is a, c, g, or t
  modified_base (549)..(552): a, c, t, g, unknown or other
  misc_feature (549)..(552): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgagggccgcttcatcatctccagagacaattcccagaacatactgtctctgcaactcaataacctgagaggcgaggacacggcctattttatttctgtgcgaaggaggcatagtgggaagtacgtattttcgactccctccgcagtcgactacgtttgattacgtgggggacccgggtaacccgtgggtaccgccgtcctccctcacgccctcccaccgacgggcccacgtccggtaccttccccccgtggccctacccctccctaccgaacgcgcctaccgtcggtcggggcaccgacggccggcccgtgggctcgccgtcggtacgaacggacttactccagtacctacnctacgtgacggcgggactggacgtacgggcgcctaatacgngcagcgnnnnngnnnnnncncnncnnnnc

SEQ ID NO: 133096 - DNA, 815 bp, Homo sapiens
  misc_feature: GYAE6OF02HBN5X.9.34.D01.1.454.CMB.1.raw
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggcttagttttaaaaggtgtccagtgtgaggttcaactgttggagtcgtggggaggcttggtccagccgtggggacgtccctgccgactcctccgtgtcgtggcctcgtggtacttccgtacctttgacgtaccttatcgtccttagacccgttggggtcccgccgacggtcccgttaccggaagggggacgggtaccgttgggaacggttcggggtccgcgagggccacggttccggtcgtggggtaccgggccggttacgacgtggacctaacgttacgtttacccgtaaaccgaacctaaaacccggttcccgggtagggtaacccgggggtcccgttaccgtttaccgtaacgttaccggttaccttaccctaaccggtaaaggaaccggaaaccctttaaccgtttaaccccgaaagggtaaacccacgttaaccgttccggttaccttccgtaccgaccttaaacccgtaacttaaaccgtaaccgtaggaacggacgggtacgaacggaccgtaacggtaccttagttttaccgtttcgtacggttacggacgggtaacggtacggtacgtaacgttaacggtaacggttaacggttaaccggttaggtttttaacccgacccgttacccgtccgttaaccgg

SEQ ID NO: 133097 - DNA, 813 bp, Homo sapiens
  misc_feature: GYAE6OF02I30N7.9.34.D01.1.454.CMB.1.raw
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacgaggtcctgggccctagtcctgttctcgaccgcgacgccgccctcagtcgtccgtcggggacccagggcaggacggtcaaccgtntccgtcgtcggacctacgtcggaaacgtcgcctaaccgaacgacggtccggggtanacggttttatcgtaagtacgtacgacgttacggtaaaccaaactaaccgttacgaaaacggtaaccaccggtaacccccgtaaaaagttcctaaacgtttacgtacgttttaagtaaccggaaaccaagtaacgttaaccggaaccgggtccccggtcccggtttacggaaccggggttcctaccgggtaccgtaccgtttccggtttaccccgggtcttaaaccgggctttaccgtacgaaccgtactaacgtccgtacccgcccgttcgaccgtacgtacgttacgccggtcggtaacctccggtagtacggtacgacggtacgtacgggtacgtcgtaaacttacgttacgttacgcgttacgtacggtacgttcgtaagtccggtacgtaccgtaaacgttaacgaaccgtttcggtaaccgtttacgggtaaccgaaccgggttacggaacccttaaacgggttcccacccgggttcggtaccggaaccgtaccggaaccggtaacccacccctaccggttacgtactaaccccg

SEQ ID NO: 133098 - DNA, 748 bp, Homo sapiens
  misc_feature: GYAE6OF02IITT2.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacgacgggttcctgggccctagtctgttctgacgcacgcccgccctcaggtcgtcgtcgggccccagggcaggaggtcaccatccgtcgtcgctacgtaggaagtacgcctaccgaacgtacgtccgggggactaacggttactagtacgttagtaacctacgttacggttaaacccaaaccttaaccgttacccgaacggtaaaaccgacccggtaaccccccaaagttccaattacctaactttaagtacgaactaacagtacgaacggtccgtacccgtcggacggggtacccgtcgtaccgttacgttcccgtaccggtacctaccgaacgttccgtacggacctactactaccgacgtccccgttacccgtccgaccctacgtaccgtaccggtacgggttccttacggacggtaccgtagggacggtacgtagggtaggtacgttacgttaactttacgttaccgttaccgtacccgttaacttcccgttaacgtacggtacgaccgtaccggtaacgtaccgtaaggtaacggttaagttcgggttacggtttaccggtcgggtaccggggtacggtaaccgaggtacccg

SEQ ID NO: 133099 - DNA, 943 bp, Homo sapiens
  misc_feature: GYAE6OF02IQOVG.9.34.D01.1.454.CMB.1.raw
  modified_base (162)..(162): a, c, t, g, unknown or other
  misc_feature (162)..(162): n is a, c, g, or t
  modified_base (270)..(270): a, c, t, g, unknown or other
  misc_feature (270)..(270): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttcncgtggctgttttaaaaggtgtccagtgtgaggttcaactgttggagtcgtgggggagcttggtccagccgtggggactccctgccgactctcctgtgtcggccttcgnggtacttcctaccgttttgaacgtaccttagtcgtacctttggacccgttggggtccccgaccgtagggtcccgttacccggaagggggggtacggggtaccttaggggtaagggttcggggggtaccgcggaacggggtcctaacggttccgggccggtttagggggttccggggaccgggtttccgtaaggttaccggggtaacctaaccggttaccgttttacccgttaaccgggaaccgtaaaacccgtttcccgggttacgggaaccgggggggtccccttacggtttacgtaccgttacccgtacgtttacccgtacccgtaaacggtaaccggtaaacccgttaaaccgtttaacccccgaaacggttaaaccctaacgttaacccgtttacggttacccgttacccgttacggtaaccctaaacccgttaacccgtaaaacgtttaaaccccggtaaggtaacgggtaaccgggtaaccgggaaaccgggtaaccggtaaccccgggttacctttaacgttttttaaccgtttccgttacgggttacggtaccgggtaaacgggtaccgggtaactaacggttaacgggttaacggggtaacggtttaccgggttaaccttttttacccgggaacccgtttacccccggtacccggttaacccgg

SEQ ID NO: 133100 - DNA, 655 bp, Homo sapiens
  misc_feature: GYAE6OF02IRW7E.9.34.D01.1.454.CMB.1.raw
  modified_base (145)..(145): a, c, t, g, unknown or other
  misc_feature (145)..(145): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtccnccaggctccgaggggaggactggagtgggtcgcaggcatcgctgggtggcggtcatgacacattctacgcaaactccgtgacgggccnttcatcattcnccagagacatcccaagaacatactgtctctgacaactataactaacctgagacgcgtaggacacggcctatttattctagtgacgaaggngacataggnggaagtacgtattttaccgacttccctcgactacgtaccgtacttatttcgaacttttacgggcgggggtaacccggggtacccgtcgggtccggtaccgttcccgtactccgacgtccctacccgaacgtaaccggccctacgttccggtcccttcccgtacggtccctaccctcccgtaacccgaacgcctaccgtaacccgttcggttaccggggactaccgacggtcccggtaccgtcgggtactccggaccgttacggtacctaacgggacttaccgtaccgacgtacgttacaccgtagtaccggg

SEQ ID NO: 133101 - DNA, 537 bp, Homo sapiens
  misc_feature: GYAE6OF02GB12W.9.34.D01.1.454.CMB.1.raw
  modified_base (518)..(537): a, c, t, g, unknown or other
  misc_feature (518)..(537): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatagtgggaagtacgattttcgatccctccgcagtcgactactttgattacgtgggggccgggaaccctggtcgccgtctcctcagcctccaccaacggcccacgtcggtccttcccccgtggccaccctcctccgaagacgcctacctccgtggggggaccaccgacggccgggtccccgtggggcctcggcccgttagggtccaaacgggtaccttaccgttcccgacgtacgttatccgacgtgacgggcgggctcgggacgaaggcgacagtacgnnnnnnnnnnnnnnnnnnnn

SEQ ID NO: 133102 - DNA, 813 bp, Homo sapiens
  misc_feature: GYAE6OF02FKBYW.9.34.D01.1.454.CMB.1.raw
  modified_base (140)..(140): a, c, t, g, unknown or other
  misc_feature (140)..(140): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataacctgagaggcaggacacggtcctattttacgttcctgtcgcgaaggtacggcaatagtgggaagtacgattttcgatccctcgcagtcgtacactttgatttacctggttgaccggggtaacctaggttccgcccggttctcccgtacaacggtcccttaccacccgaaacggggtcccctaacgttcccggtttacccgtttccccccgtagggtaccctaaccccggttaccccttacccgtaaaacgggaaccgtacccgttaaaccccgttccggttacggggggggtaccctaaaccggaacggtacccggggtaacccccggttcgggggtaacccgttccgggtaccccgtttacgggtttaacccggaaaaccgggttaacccgttaaacccgttttaccccggaaacggttaacccggttaaacgttacccgttaaacccgtaggggttaaccgggacccgggggtacgttaccggggtaccgaaaacggggttcccgaaacccgtaacggtttaccggtaagaacggttctaaccgtcgacctagttcgtaaacgccggtataacgtaccggtacgtttacccgtcgacgtacgacgtacgtacgtacg

SEQ ID NO: 133103 - DNA, 706 bp, Homo sapiens
  misc_feature: GYAE6OF02IHIEV.9.34.D01.1.454.CMB.1.raw
  modified_base (653)..(653): a, c, t, g, unknown or other
  misc_feature (653)..(653): n is a, c, g, or t
  modified_base (661)..(661): a, c, t, g, unknown or other
  misc_feature (661)..(661): n is a, c, g, or t
  modified_base (678)..(678): a, c, t, g, unknown or other
  misc_feature (678)..(678): n is a, c, g, or t
tcagtgatacgtctcacgaccggtgctcgatttagatcgtctgtgttggggtttgggattcacgttgcagatgtaggtctgggtcgcaggcatcgctggtggcggtcatgacacattctacgcaaactccgtggaggggccgcttacatcatctcagagacaattccagaacatactgtctctgcaactacaataaccgtgaggaggagaggacacggcctattttattcgtagtggacgaagggagcgtataagtagggtaagtacgtatttcgactcccctcgactagtacgactacgtttagtacgtacggtacgggggcccggggtaacctgggtaccgtcccggtcctccgtacacgtcccgtccaaccgtaacgggccctacgtacccggtaccctttcccccgacggtacccctacccccgtcctaacccgaacggtacgcccgtaccgtacgggtacgggggacctaacggacggcccgggtacccgtcggggtacctaccggccgttacgggtacgaaacgggttaacttaacccgttacccgaaaggtacccgttaacgtaccgtaaccgtacgggacggtacccggggaccgttacgggaacccggaacgggttaccgaaccgtaaggtaacgtcgtaacgngacgacanacgacgacgctacgagngagtagactagacgacgacagtacgacg

SEQ ID NO: 133104 - DNA, 707 bp, Homo sapiens
  misc_feature: GYAE6OF02I7Q42.9.34.D01.1.454.CMB.1.raw
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (424)..(424): a, c, t, g, unknown or other
  misc_feature (424)..(424): n is a, c, g, or t
  modified_base (598)..(598): a, c, t, g, unknown or other
  misc_feature (598)..(598): n is a, c, g, or t
tcagtgatacgtctcacgaccggtgctcgatttagatcgtctgtgttgggtttgggggaggcttggtccagcctgggggagtccctgcgactctcctgtgtggcctctggattcacctttgagacctatgccttgaccgtgggtccgccaggctccgagggggagggacgtggaggtgggtcgcatgcatcgctggtggcggtcatgacacnttctacgacaaactcgtggaggggccncttcatcatcctaccagacgacaacgttcccaagaaactattacctgttcttacgtcgaccaactacctaaactaacctagaaggacgggacgacggaccgaccggtacctaattttactttcgtggtagacggtaaggagcaagtacggaggtaacgtacttacgtttaccacgttcccctcgntacgtaccgaactacgtttgtacctttacggggtaccgggggtacccgggaaacccggttcgggtacccgtccgtaccgtccgtccgtaccgtccctacccgaccgaaccgggtcctacgttcccgtcccttaccccgtccgtaccctccccgtacctaccgacgaccgtaccnccggtcgtacgggacctacgacggcccggtcgcggttccgcggtaccggtacgtaaccgtaacgtacccgttaccgtaccggtaacgtaccgtactacgcgtaaccggg

SEQ ID NO: 133105 - DNA, 779 bp, Homo sapiens
  misc_feature: GYAE6OF02H4NL3.9.34.D01.1.454.CMB.1.raw
  modified_base (135)..(135): a, c, t, g, unknown or other
  misc_feature (135)..(135): n is a, c, g, or t
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
  modified_base (218)..(218): a, c, t, g, unknown or other
  misc_feature (218)..(218): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgactcactgcacgngggtcctcgggcccagtctgttcngacgcagcccgccctnagtgtcgtcggggcccaggcaggaggtcaccgatccgtacgtncacgtaggagtacgcctaccaacgaggtccgggactacggtttatagagttcgtaaccgtacgtacggtaacccaaactaaccgttaccgaacggaaccacccgtacccctaaaagtcaacttcctaattttaacgagtaaacctaactaagtacggaaccggtcccggtacccgtaccgggtaccggggttccccgacggtaaccgttaccgttcccggtaccccggtacctaccgtaaaggttccgtaacggtacacctcgtacgaccgtcccttccggcgtacctacgtcgtaccggtcggtcccctacggacggttacgagggtacgtacggacggtacggtccgttacgtaacgtttacgttcctacgggtacctacgttaacgttacgtacgaacgggttaccgtaacggtaacccttaaacgttaaccgttacgtttaccggtacgttaaccgggtaccggttaccgggaaccgttaccggacccggtaccggttccggacggttcccgacggaccccgaaccgtaccccccgaaccttaccgtcgttaacccg

SEQ ID NO: 133106 - DNA, 476 bp, Homo sapiens
  misc_feature: GYAE6OF02FG0XV.9.34.D01.1.454.CMB.1.raw
  modified_base (224)..(224): a, c, t, g, unknown or other
  misc_feature (224)..(224): n is a, c, g, or t
  modified_base (312)..(312): a, c, t, g, unknown or other
  misc_feature (312)..(312): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (454)..(476): a, c, t, g, unknown or other
  misc_feature (454)..(476): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaaactccgtgaggggccgcttcatcatctccagagacaattcccagaacatactgtctctgcaactcaataacccgagaggcaggacaggccatttattcngtgcgaaggaggcatatgggaagtacgattttcgatcctcgcagtcgacactttgattactggggccggggaaccctggtcgccgtcncctcagcctcaccaagggccatcggtctcccctggcacctctccaagagcaccnctgggggcacngcggccctgggctgcctggtcaaggactacttccagagtatcacttgagcgggctggcaaggcggccaagttacgannnnnnnnnnnnnnnnnnnnnnn

SEQ ID NO: 133107 - DNA, 839 bp, Homo sapiens
  misc_feature: GYAE6OF02JOD13.9.34.D01.1.454.CMB.1.raw
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
tcagtgatacgtctcacgaccggtgctcgatttagatcgtctgtgttgggtcttggggaggcttggtccagcctgggagtccctgcgactctcctgtgtggcctctggattcacctttgagacctatgccttgacctgggtccgccaggctccaggggaggactggagtgggtcgcaggcatcgctggtggcggtcatgacacattcctacgcaaactcgtgacggggccncttcgatccgatcctccgaganacattcccagaactatactcgtctcgtgacctaactactaactaacccgtgaacggaaggccggaacggtaccacggccctaatttttacttttcctaggtacggtacggaaacgggtcggtacctaagtaacgttaggggaaacttaccggtttaattttcccggtactacccccgttggaccttacgggttacctaacggttaccttttcggaaacctttttaccgggggtaccgggggtaccccgggggtaacccccgttacggggtcccggtttaccccggttacccttccccggttacgtacccggtacccgttaaccccgtacccggtaaaccggggtcccctaaaccgggtttccgtttcccccgttaccccgtttaaccggcccgttaaacccccgggttcccttacccggtaaacccgtccggtacccttaacccggttcccgtaccgggggttacccacccggtaacggtcccgggaccccgtcggtcccggtcggttcccggtacgggtacccgtaaccggggtcctttaacccgttcgtaaccggacgtttaacccgtcgtaacccggttacgg

SEQ ID NO: 133108 - DNA, 523 bp, Homo sapiens
  misc_feature: GYAE6OF02GDC9A.9.34.D01.1.454.CMB.1.raw
  modified_base (353)..(353): a, c, t, g, unknown or other
  misc_feature (353)..(353): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
  modified_base (508)..(510): a, c, t, g, unknown or other
  misc_feature (508)..(510): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (520)..(523): a, c, t, g, unknown or other
  misc_feature (520)..(523): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatagtgggaatacgtatttcgatccctcgcagtcgactactttgattacgtgggggccgggacctggtcgccgtctcctcacgcctccaccaaggcccagtcggtccttccccgnggcctcccgtcctaccaagacgccacctcgtcggggcaccgagccggccgtgggctcgcgtacggcaaaggacctaccttccgacgtaccggtatccgactggacgccgggtctgggaccaaggggcaccgataggcagcagctagncgacgncnnngncncgcncnnnn

SEQ ID NO: 133109 - DNA, 717 bp, Homo sapiens
  misc_feature: GYAE6OF02ITRRP.9.34.D01.1.454.CMB.1.raw
  modified_base (354)..(354): a, c, t, g, unknown or other
  misc_feature (354)..(354): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctcgggcccagtctgttctgacgcagcccgccctcagtgtcgtcggggccccagggcaggacgggtcaccatccgtcgtgcacgtggaagtacgcctaccgaacacggtcggggacctacgttatggatgtacacttacggtaacccaactaacttccgaaggaaccaccgaaccccaaagtcactactaatttanacgaacaactataggaacgccgtacccgtacggacgggtaccctcggtaccgtacgtttcccgtcccggtaccgtacccgtaaggttcccggacgtaccactaccgtaccgtacccgtcccgtccgtaccgtcctaccgttccgtaccgggtccggttacccgtacggtacggtacgtacgggaggtacgtagggtaccggttaccgttacggttaacctttacggttaccgtacgtaacccgttaggttacgtaggtaacgtacggtacggtaacgtaacgttaaacgtacgttcgttaccggttacgtaaccggttacgggtaaccgaccgggtaaccggtacccgttacccggtaccggg

SEQ ID NO: 133110 - DNA, 843 bp, Homo sapiens
  misc_feature: GYAE6OF02HX72Z.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcacctttgagacctatgccttgacctgggtcccgccaggcctccgagggggagggactggaggtgggtcgcgaggcatcgcgtgggtggcggtcagtgacacgtattcacgacaaacgtccggtgacggggcctacttcatcatcctccgagagacaacttcccaagaactatactcgtctctcgactaactctaaactaacctagacggaaggccggtaaggaccgacggtaccttatttacgttttctggtcgagggaaggagtcgtaagtaggtacgggaacgttaacgttacgtttacgaccgttccccgtcgtacgttacggtaccgtaacttaccgttttaggtaacgtttacgggtaccgggggtaacccgggacccgtttgggtcccggtacccggttccctaccgtaccgtaccgccccgttacccggaaacccgaaccgggggtacccctacgggtttaccccggttcccccgtttccccggtaccgggtccccctaacccccgttacccgtaacccgtaaaccggtaccggttaccccgtaacccggttccggggtacccggggtaaccaaacccggtcccggggtccccgggtccccggttaccggggcccgttaccggttcccgggttaccgggtaaaccggtttacccgggtaaaccgttttaccccgaacccggtcggttaaaccccgtttacgtacccggtaccggtaccggggg

SEQ ID NO: 133111 - DNA, 710 bp, Homo sapiens
  misc_feature: GYAE6OF02HQXRW.9.34.D01.1.454.CMB.1.raw
  modified_base (174)..(174): a, c, t, g, unknown or other
  misc_feature (174)..(174): n is a, c, g, or t
  modified_base (209)..(209): a, c, t, g, unknown or other
  misc_feature (209)..(209): n is a, c, g, or t
  modified_base (266)..(266): a, c, t, g, unknown or other
  misc_feature (266)..(266): n is a, c, g, or t
  modified_base (489)..(489): a, c, t, g, unknown or other
  misc_feature (489)..(489): n is a, c, g, or t
  modified_base (562)..(562): a, c, t, g, unknown or other
  misc_feature (562)..(562): n is a, c, g, or t
  modified_base (605)..(605): a, c, t, g, unknown or other
  misc_feature (605)..(605): n is a, c, g, or t
  modified_base (671)..(671): a, c, t, g, unknown or other
  misc_feature (671)..(671): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacgaggtcctcgggcccagtctgttctgacgcacgcccgcctangtgtccgtcgggcccagggcaggacggtcaaccgntcgtcgtagctacgtaggaagttacgactaccaacgtaggtccggggatacgttagngtactacgtacacgtaggtaaccaactactaccgaacgtaaccacctaccccgtaaaagtcacttacgtaactttagacgaaacctaacgtaagtacggaaccggtcccggtaccctaacgggtaccggggttcccctaaggaaccgtacgttccggtcccggaactaccgtaacgtcgtacggactaaccgtcacgacccgtcccgttccgacggaccttanaccgtacggtccgacccgttacgacggacggttagaacggtactagggaccttacgtagtaaccttagttccngacgtaaggttccgaatacgacgtaggtccgtaacgttaaacncggtaccttacggttaccgtaaccggacgtaccgggacgaccggttccgaaccgttcgggtaaccncgaaccgtaccgaacccgtaccctacgtgaccgttaccc

SEQ ID NO: 133112 - DNA, 406 bp, Homo sapiens
  misc_feature: GYAE6OF02F5RQU.9.34.D01.1.454.CMB.1.raw
  modified_base (218)..(218): a, c, t, g, unknown or other
  misc_feature (218)..(218): n is a, c, g, or t
  modified_base (393)..(393): a, c, t, g, unknown or other
  misc_feature (393)..(393): n is a, c, g, or t
  modified_base (396)..(406): a, c, t, g, unknown or other
  misc_feature (396)..(406): n is a, c, g, or t
tcagtgatacgtctcacgaccggtgctcgatttagatcgtctgtgttgggtttgggggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctcagctgaggntgaggctgactattactgccagtcgtatgacagtggcctaagtaacatcgtcttcggaactgggaccaaggtccaccgtccgtgggtacacgcccgaaggcccaaaccccgctagtccactctcgttccccaccctcctcagacgtatcactgaggcggcgtggacaaggcacanagnnnnnnnnnnn

SEQ ID NO: 133113 - DNA, 799 bp, Homo sapiens
  misc_feature: GYAE6OF02FQUXI.9.34.D01.1.454.CMB.1.raw
  modified_base (250)..(250): a, c, t, g, unknown or other
  misc_feature (250)..(250): n is a, c, g, or t
tcagtgatacgtctcacgaccggtgctcgatttagatcgtctgtgttgggtcgtgggggaggcttggtccagcctggggagtccctgcgactctcctgtgtggcctctggattcacctttgagacctatgccttgacctgggtccgccaggctccgagggggaggactggaggtgggtccgcaggcagtccggcgtgggtggcggtcatcgacacattcaacgactaaactccgggtagacgggggcccncttcgatcgatcctaccgagacgactaacttccagaaacatacctgtactcgtgaccaactacaacttaccgtgacggtacgggacgaacgggaccgaaccggtaccttaagttttaactttcgtggtacggacggtaaagggtagacgtagttaacggtagggtaaacggtacgttactttttacggacctttccccgtacgtaccaggtcccgtaaactcgtttacgtacgtttaacgggtccgggggtacccgggtaacccgtttcgggccggttaccccgttccgttaccccgttcggaaccgtccccgttacccgaaccccggtaacgggtaaccccttacgggtttccccggttacccgtttacccccgtcggtaacccttacccccgtctaacccggaactcccggaccctaccgttcgggtaccgggtaccacggtacgggccccgtaccgggtcggacccgttgggcccggttacggtaacgtaaccgggtccttaacggtcccgtaaacggttaccggttactaccgtacgtaccgggg

SEQ ID NO: 133114 - DNA, 909 bp, Homo sapiens
  misc_feature: GYAE6OF02GQS9X.9.34.D01.1.454.CMB.1.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
tcagtgatacgtctcacgaccggtgctcgatttagatcgtctgtgttgggtcgtgggggaggcttggtccagcctggggagtccctgcgactctcctgtgtggcctctggattcaccttttgagacctatgccttgacctgggtccgccaggctccgaggggagggactggagtgggtcgcaggcatcgctgggtcggcggtcatgacacattctacgacaaactccggtgaggggccgcttcatcatccncaganacactccaagaacatactgtctgtacgacaactcaaacttaaccgtggacgtacggaccggtaagggaaccgtaccggaccttaactttttacgttttcgtaggttcggacgggtaaaagggtcggtactaagttaacgggtacggggtaaacgttaccggtttaacgtttttacccggaaccgtttcccccgtaccggtacgtaccggttaccgaacctttacggttttacggtaacgttttaccggggtcccggggggggtaaccccggggttaaaccccgtttcgggggtttaccccgtccccgggttttaccctttaccccggtaccggtaaaccggttaccccccgttaaccccggaaacccgggtaaccggggtacccccttacgggtttacccccgtttccccggtttacccccccgttacgggaccccccttaaccccgttccccggtaaacccgtaaaccgggtccgtaccccggtaaccccggttccggggtacccggggggtacccaaacccgggtacggggtccccgggtaccccggttcgggacccggttaccggtcccggttacggggtaacccttaacgggtaaccctttaccgtacccggtaaacggtacccgtttacgtacccgttagtcccgggg

SEQ ID NO: 133115 - DNA, 758 bp, Homo sapiens
  misc_feature: GYAE6OF02H32JC.9.34.D01.1.454.CMB.1.raw
  modified_base (541)..(541): a, c, t, g, unknown or other
  misc_feature (541)..(541): n is a, c, g, or t
tcagtgatacgtctcacgaccggtgctcgatttagatcgtctgtgttgggtctgggggaggcttggtccagcctggggagtccctgcgactctcctgtgtggcctctggattcaccttttgagaccttatgccttgaccttgggtcccgccaggctaccggagggggagggactggaggtgggtcgcgaggcatcgcgtgggtggcggtcagtgacactattcctacgacctaaacgtccggtaggacggggccctcttcatcactctaccaagacgaactaacttacccgaagaactaacttactcgttactcgtacgacctaactctaaaacgttaaccgaggaacggaggacgaacggacctaccggactttaattttactttcgtaggtacggaacggtacggagtactaagtacggtaaggtaacgttacgtttacgtttaccgaccttccccggtcgacgtagtcgtaacttagtttagaacgtttacgggacgggggtacccggtaccgtcggtacccgtccttcctacgtacncgtaccctaccgaaaccgtaccggacccttcggttcccgtacccgttcccgcgtaccccgtccctttaccgaacgtaacgccgaccgttcccgtacgggtaccgggactaaccggcgtacccggtccggtcggtccgtaccggtaccgttacggtaaccgttaaccgtaaccgtttacccgtacgaacggttaacccttccgacgtcggtaaccggg

SEQ ID NO: 133116 - DNA, 789 bp, Homo sapiens
  misc_feature: GYAE6OF02JJ3WX.9.34.D01.1.454.CMB.1.raw
  modified_base (236)..(236): a, c, t, g, unknown or other
  misc_feature (236)..(236): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggcctccgaggggagggactggagtgggtcgcaggcatcgctgggtggcggtcatgacacattctacgcaaactccgtgacggggccncttcatcatctccagagacaacttcccagaacatactgtctctgacctaactacaaactaacctaggtaaggacgggacggaacgggtaccaaccgggcctaatttttactttccgttagggtcggaccgggaaagggacgggtactaaggttaacggtacgggggtaaacgtttaaccggttaagttttttaccgaacgttcccccgtaccggtaacgtacggtaaccggtaacttacgttttacggtaacgtttaaccggggttcggggggggtaccccggggtaaacccggttcgggttacccggtccccgtttacccgttacccgtccgtaaccggtccccttaacccggaaacccggtaacccgggcccgtaaccgttcccgggttaccccttcccccggtacggcccctaccccgtccctaacccgaacggtaccgaccctaccggtcggtcggggaacctaccggaccgtccgggaccgtcgggcctcggtccgttcggtaccgtaacgtccgtacctacgacgtacgttcaccgtacgtggacgg

SEQ ID NO: 133117 - DNA, 556 bp, Homo sapiens
  misc_feature: GYAE6OF02IS4ZY.9.34.D01.1.454.CMB.1.raw
  modified_base (529)..(529): a, c, t, g, unknown or other
  misc_feature (529)..(529): n is a, c, g, or t
  modified_base (534)..(535): a, c, t, g, unknown or other
  misc_feature (534)..(535): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
  modified_base (543)..(546): a, c, t, g, unknown or other
  misc_feature (543)..(546): n is a, c, g, or t
  modified_base (548)..(556): a, c, t, g, unknown or other
  misc_feature (548)..(556): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggcctatttattctgtgacgaaggaggcagtagtagggaagtacgtattttcgactccctcgcagtcgactactttgacttacgtcgggggacccgggtaaccgtggtccgtcccgtctcctcacgcctcccaccgaacggggcccacgtccggtcccttcccccgtggccctacccctccctaccgaacgcgcctacctcggtcggggcacgcggccggccgtgggcctcgccgtcggtacgaacgtaccttacgtccgagaccgttactaccgacgtagacggccgggctcggggacaacgggcgactagtacgntcganngcngnngnnnncnnnnnnnnn

SEQ ID NO: 133118 - DNA, 644 bp, Homo sapiens
  misc_feature: GYAE6OF02FW8PE.9.34.D01.1.454.CMB.1.raw
  modified_base (232)..(232): a, c, t, g, unknown or other
  misc_feature (232)..(232): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctaccagagacaacttcccagaacatactgtctctgcactcaatacngagnggcgagacgacggcctatttatttcngtgcgtaaggaggcagtagtagggaagttacgtatttcgacttcccgtcgtcgtacgtcgtaacgtactttgacttaccggtcgggggtacccggggaaccgttcggtcccgtacccgttcctacccgttcgacgtccctaccgacccggacggccctaacgtccggtcccttccccgtcgccctacccgtcctacccgaacgacgtacctaccgtcggcggggccacggacggcccggtcccgtcgggtcctcggtcccggttacggtaccgtaacggtaccttacgttcccgtaacggtaccgtactaccgtacgtgaaccggg

SEQ ID NO: 133119 - DNA, 888 bp, Homo sapiens
  misc_feature: GYAE6OF02HDBA9.9.34.D01.1.454.CMB.1.raw
tcagtgatacgtctcacgaccggtgctcgatttagatcgtctgtgttgggtttggggtctggagagaggagcccagccctgggattgtcaggtgttttcatttggtcgatcaggactggacagagagaactcaccatggagtttgggctgacctggtctttttctcgtggcttagttttaaaaggtgtccagtgtgtaggttcaacttggttggagtcgtagggggagtcttggtccagccgtaggggacgtccctgccgactctcctgtggtcggcctcgtggattcctaccgttttgacgtacccttatcggtacccttcggacccgttggggtaccccgccgacggcctaccgggaagggggtacgggtaacgtggggtacggttcggggtccgacgtagggcaacgttccggacggttggggtacgggccggttacagttacgaaccacgttactttaccgaacgtacctaaaacgttcccgggtaggggaaccggggtccctacgttttaccgactaccgtacttacccgtaccgaaacggactaaacccgttaaaccgtttaccccaaaggttaaaaccctacggtttaccttacgtttacccgttcttacgtaaccccgaacttaaccgtaaaaccgttaacccgttagggaacgggtaacgggtaccgggtaaacgggtaacccgtaaaccgggttaccctttaaacggtttttttacccgtttaccggttcggggttaacggttaacccgggggtaaacggggtaaccggtttaaccggtaaaggtttacgggttaaaggggggtaaaaccgtttttaccgggtttaaaggttttacccccggtaaccggtttaccccccgggttaccggttaacccgg

SEQ ID NO: 133120 - DNA, 841 bp, Homo sapiens
  misc_feature: GYAE6OF02GXKVA.9.34.D01.1.454.CMB.1.raw
tcagtgatacgtctcacgaccggtgctcgatttagatcgtctgtgttgggtctgggggaggcttggtccagcctggggagtccctgcgactctcctgtgtggcctctggattcacctttgagacctatgccttgaccgtgggtccgccgaggcctccgagggggagggactggaggtgggtcgcgaggcatcgctggtggcggtcagtgacactattcacgacaaactccgtaggacgggcctcgttcatcagtcctaccgaagagtacaacttcccgagaacatactgtcctctgaccaacctacaaactaaccgtggaaggacggacggaggaaccgaccgggtaccttaagttttacgtttcgttacggtaggaacggtaaagggacggacctaagtacggtaaggggtaaacgtacgtttaacgtttttaccggaacctttccccggtccgtaccgtacggttaccgtacttacgtttacgtaacgtttaccgggtcgggggaccccgggttaacccggtcgggtcccggttcccgtaccgtttcccgtaccgtaccgtccccgtaacccgacccggtaaacccgggtacccgtaccggttccccggttaccccgtttcccccccgggacgtcccccgtaacccccgttacccggtaacccgtaacggtacccgtacccggtcccggttaccggggtacccggggtaccctaaccggtaccgggtccccggtcccgggtacgggtcccgtccgggtacccggttacgggtaaccggaacccggtttaccgtacccgttaaccggaccgttaaccgttcgtacccgtacggtaccggg

SEQ ID NO: 133121 - DNA, 827 bp, Homo sapiens
  misc_feature: GYAE6OF02JU2K8.9.34.D01.1.454.CMB.1.raw
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (444)..(444): a, c, t, g, unknown or other
  misc_feature (444)..(444): n is a, c, g, or t
tcagtgatacgtctcacgaccggtgctcgatttagatcgtctgtgttgggtttggggtctgagagaggagcccagccctgggattggtcaggtgttttctatttggtgatcaggactggacagagagaactcaccatggagtttgggctgacctggtctttttctcgtggtcttaggttttaaagtgtccagtgtgtacggttactaacgtgttggagtcgtgggggaggtcgttggtccgacgcggtggggacgttcccgtgccgtactccgtccgtggtcgtcggccgttactggtaccttcaaccttttggaacgaccttagtcgccgttgacccgtcggggtcccgccgacgggtctaccggagggggtacggaccgttgggaaggttggggcccgtacgnggtaccgntcggccggtggtgggccggtctagcgtaacnccgtaattcccggtaacgaccgtaaaccgtccggggttacgaccgggggtcccgtcgtttacctacgtccttaacgttcccgttaccggaacgtaacggtaaaccctaaccgttacccgaaacgtaaaacccgtagtttaacccgttacggtttactacccggttacggaaacccttaaaccctttaacccaaaggtttaaaccccgttagggaccggttaaaccggacgggtaaccgggaaacccttaaccggggtaaaccttaggttttttaacccttcgtacggttaaggtacccgggaaaagggtcgttacgaaaggtttaccgggtaacggtaacggttaacgttccgtttaaccgggtaccttcccgtccggtacgg

SEQ ID NO: 133122 - DNA, 784 bp, Homo sapiens
  misc_feature: GYAE6OF02I2DII.9.34.D01.1.454.CMB.1.raw
  modified_base (392)..(392): a, c, t, g, unknown or other
  misc_feature (392)..(392): n is a, c, g, or t
tcagtgatacgtctcacgaccggtgctcgatttagatcgtctgtgttgggtttgggggctctgcttcagctgtgggcacaagaggcagcactcaggacaatctccagcatggcctggtctcctctcctcctcactctcctcgcctcactgcacgacgggtcctcgggcccagttctgttctagacgtcacgcccgtccctcgagtcgtccggtcggggccccagggccgaaggacggtccaaccgatccgttccggtacgacctaacgtagggaacgttcgacctaccgaacgacgtccggggactacggttatcgaagtcgtactacgtacgtaacccaactaaccttacgaacggaaccaccgacccgtaaagtcctactacctatttanacgaaactaacgtagtacgaaccggtccggtaccctaccggtaacggggttcccctacgggtaacccgtacttcctcggtcgtacccgtaaccgtaacggtcctaacggaaccctacccgtaactcccggtaccccttcccgacgtcctaaccgtcgtaaccggtccggcttacccgaacggtacgttacgggaatacggtcggtacggaccctttacgtaacgtttactttaaaccgtcgggtaaccttacggttttacgttaacgtacgtaaacgttaaacccggttcgtaaaaccggttaacgtttacgggtttcgggttaaccggggttccgggtaaccggggtaaacggaccttaaacccggggttcttacccgggtaccctaccgg

SEQ ID NO: 133123 - DNA, 727 bp, Homo sapiens
  misc_feature: GYAE6OF02FPPSL.9.34.D01.1.454.CMB.1.raw
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
  modified_base (317)..(317): a, c, t, g, unknown or other
  misc_feature (317)..(317): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccgaggggagggactggagtgggtcgcaggcatcgctggtggcggtcatgacacattctacgcaactccgtgagggccncttcatcatctaccagacgacaactccagaacatactgtctctncaactcaatacctgagaggcgaggacacgctatttattctgngacgaaggagcaagtagtagggaagtacgtattttcgacttccctcgacgtacgtccgtaactaccgttttagaacgtttaccgggtacggggggtaccccggggtaacccggttcgggtacccgtaccccggttccgttacccgttccgtaccggtaccccttacccgtaaccccggaaacccgggtacccctacggttaccccggtttccccgtttcccccgtacggtccccctaccccttaccctacccgaacggtacgacccgtacccggtccggtacggggaccaccggtaccggccgggtacccggttcggggtccgtccggtcccggttacgggaacccgtaacggtacccttaccgttaccggacggttaaccgtacgttaccgtacgtacggtaaccgggg

SEQ ID NO: 133124 - DNA, 712 bp, Homo sapiens
  misc_feature: GYAE6OF02FQ1EB.9.34.D01.1.454.CMB.1.raw
  modified_base (145)..(145): a, c, t, g, unknown or other
  misc_feature (145)..(145): n is a, c, g, or t
  modified_base (217)..(217): a, c, t, g, unknown or other
  misc_feature (217)..(217): n is a, c, g, or t
  modified_base (577)..(577): a, c, t, g, unknown or other
  misc_feature (577)..(577): n is a, c, g, or t
tcagtgatacgtctcacgaccggtgctcgatttagatcgtctgtgttgggtttggggtctgagagagagcccagccctgggattgtcaggttgttttcatttggtgatcaggactggacagagagaactcaccatggtagttggntgactggtctttttctgtggcttagttttaaagcgtcagtgtgtacgttacaagtgtgtagtcggtgggggngtcttggtccagccgtggggactcccgtggcactctccgtgtggtcgtcctgtggtacttctacctttgaaccgtactactcgtccttacgtccgtcgggttccgaccggcgtacccgtccgggaacggggggacggtacggtacggggacggttggggtacgccggtggacgtcgtcgggtccggtgggtgggtaccggtccgtagtcggaactaactactttccgtaacggacctaaaccgtcgggttagggccggggccgtcttacacgtactacgtcctacgaacgactaaccgtactaccaacgaactaccgttatctaccttctacacctaactaccaacgttaacgagaacgnggaccgaacggtaccaaccgtctttaacgtttctttaccgtgtacgggtaaggtaacggtacgtagtaaacgttagggtaacgttaacggttaacggtttacgttaccggtaacccttcccgtaaccgtacccgg

SEQ ID NO: 133125 - DNA, 676 bp, Homo sapiens
  misc_feature: GYAE6OF02FSN3T.9.34.D01.1.454.CMB.1.raw
  modified_base (230)..(230): a, c, t, g, unknown or other
  misc_feature (230)..(230): n is a, c, g, or t
  modified_base (486)..(486): a, c, t, g, unknown or other
  misc_feature (486)..(486): n is a, c, g, or t
tcagtgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattcacgcaaactccgtgagggccncttcatcatctccagagacaattcccagaacatactgtctctgcaactcaatacctgagaggcgaggacacggcctatttattctgtgcgaagggaggcagtagtagggaacgtacgtattttcgacttcccgtcgctacgtcgaactcgtttagattacgtcgggggaccggggtaacccgtggtccgccgttctaccgtcaccgtccacccgtaaccgaccgggccctaagttcccggttaccctttcccccgngggtacccctaccccgttcccttaccgaaacgtacgacccctaaccgttccgggacgggggtccacggtaaccggcccgggtcccgtacggggtccttacggcccggttacgggtaacccgtaacgggtaccctttaaccgttacccggaacgttaaccggttaccttaccgtaccggtggtacccgggg

SEQ ID NO: 133126 - DNA, 761 bp, Homo sapiens
  misc_feature: GYAE6OF02JAWFV.9.34.D01.1.454.CMB.1.raw
  modified_base (184)..(184): a, c, t, g, unknown or other
  misc_feature (184)..(184): n is a, c, g, or t
  modified_base (279)..(279): a, c, t, g, unknown or other
  misc_feature (279)..(279): n is a, c, g, or t
  modified_base (403)..(403): a, c, t, g, unknown or other
  misc_feature (403)..(403): n is a, c, g, or t
tcagtgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggtctttttctcgtggcttagttttaaaggtntccagtgtgagttacaactggttggagtcgtgggggagtcgttggtccacggccgtggggacgtccctggccgtactcctccgtgtcgtggcctntcggtacttctacctttgactacctatcgtccttgaccgttcgggtcccgccgtacggcccgtaccggagggggacgggtacgtcggggagggttcggggtccggcgaacgggcaacgtccggnggttgggtcgggaccgtcgtaagtacgaacctacctacgtttccgtaacgaaccgtaaccgtccggtacggggaccgggtcccgtactttacccgacgttccgtacttaccgaccgaggtaacaaccttaaccgtacccaaacgaactacgttacgttccgtcttaccgtactaccgtaacctaacctaaacttaaccgtaggaccgaacggggtaccgaaccggtaccgtaaccggtaccctttaatttacgtttagtaccgtagtacgggtaaacgggtcgtaacggtaaacgttaggtacgggttaacgttaccggttttaagttacccggttcccgtacccggttccgtaccgg

SEQ ID NO: 133127 - DNA, 829 bp, Homo sapiens
  misc_feature: GYAE6OF02F6XYL.9.34.D01.1.454.CMB.1.raw
  modified_base (140)..(140): a, c, t, g, unknown or other
  misc_feature (140)..(140): n is a, c, g, or t
  modified_base (158)..(158): a, c, t, g, unknown or other
  misc_feature (158)..(158): n is a, c, g, or t
  modified_base (174)..(174): a, c, t, g, unknown or other
  misc_feature (174)..(174): n is a, c, g, or t
tcagtgatacgtctcacgaccggtgctcgatttagatcgtctgtgttggggtttgggacaagaggcagcactcaggacaatctccagcatggcctggtctcctctcctcctcactctcctcgctcactgcacgcgggtcncgggccctagtctgttcngacgcacgccgcctanagtcgtcgacgggccccaggtcaggtacggtacaacctgtcgtcgtcgactacggtaggaacgtcgacctaaccgaagtacgggtaccgggactaacgttagtctacgttacgtaaccgtaacggttaccggtaaaacctaaacctaaccgttaccggaaacggtaaacccgtaaccgaacccccgaaaagtccgtaattacgttaattacgacgtaaccaacgtagacggtaaccgccggtaccgtacggaaccgggtcctacgaacgtcgtaccgttaaccggcctaacggtacgtacgtcgaaccgtaactacgtaccgacccgttaacccgttcccggtaaactacccgttaaccgtaaccggtaacccggttaaccggtcccgttaacccgggaacgtacccggtaaagggttaacccggaggtaccgggtaacgtaacggtttaacaacccgtttaagttacccggtccgaacggttaacgttcggtaaacgtgtacccggttaacggtaacctaacggttaacgaaccgttacgtacccggtttaaccgtacggtacgggtaactaccggtaaccgtccggttacccgttcggacgtaccggaccttaaccgggaaccctaccccggaacgttacacccgttaacccg

SEQ ID NO: 133128 - DNA, 755 bp, Homo sapiens
  misc_feature: GYAE6OF02FUZU9.9.34.D01.1.454.CMB.1.raw
  modified_base (140)..(140): a, c, t, g, unknown or other
  misc_feature (140)..(140): n is a, c, g, or t
  modified_base (224)..(224): a, c, t, g, unknown or other
  misc_feature (224)..(224): n is a, c, g, or t
  modified_base (697)..(697): a, c, t, g, unknown or other
  misc_feature (697)..(697): n is a, c, g, or t
  modified_base (728)..(728): a, c, t, g, unknown or other
  misc_feature (728)..(728): n is a, c, g, or t
  modified_base (734)..(734): a, c, t, g, unknown or other
  misc_feature (734)..(734): n is a, c, g, or t
  modified_base (741)..(741): a, c, t, g, unknown or other
  misc_feature (741)..(741): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccncttcatcatctccagagacaattcccagaacatactgtctctgcaactcaataacctgagaggcagacacggcctatttattcngtgacgaaggacgcaagtagtagggtaacgtagtattttacggactacccctacgacacgttcgaactacctttagaactttaacggtcgggggacccgggaacccgttcggtaccggtcccgtccgttaccctaccgtacgtacccgtacccgtaacccgaaccggggacctaacggtccggttacccttacccccgtacggtacccctaaccccgttacccctaccggtaaacggaacggtaccccttacccggtaccgtacggggggacccttaacgaccgggtcccgggtaacccgttcgggggtaccgttccggtaccccggttacggttaaacccggtaaaccggttaaccccttaaccgttacccgtaaacggtaccgggtttaactaccgttaaccggtacggaacgtacccggggtaccgttacggggaccgtaaacgggaccgtacctaacggtagtcgtacngtaccgagcctagctagcgtaccgttgaacncggtancggtacncgtaatcacgagcg

SEQ ID NO: 133129 - DNA, 746 bp, Homo sapiens
  misc_feature: GYAE6OF02FWFS2.9.34.D01.1.454.CMB.1.raw
  modified_base (281)..(281): a, c, t, g, unknown or other
  misc_feature (281)..(281): n is a, c, g, or t
tcagtgatacgtctcacgaccggtgctcgatttagatcgtctgtgttgggtttggggacaagaggcagcactcaggacaatctccagcatggcctggtctcctctcctcctcactctcctcgctcactgcacagggtcctgggcccagtctgttcgtgacgcagcccgccctcaggttcgtcgtcggggcccccgagggcgtacggagggtccaccgtactccgttcgtcgaccgacggtagggaacgtacgccgtaccaacgtagcggggctagtttacngtactacgtacgtaccgtacgggtaacccaaaccgtaaccgttaccgacggtaaaccaaccgaaccccccgtaaagtcctaacttacgtaatttattacggaacctaactagtaggaaccggtccgaccctacgggtaccgggtaccgtcgtactaccgttccgtaccgccgtaccgtaactcgtacggacctacgtaatccgactcccgtcccgtcggactaccgtacgcgtcggccttccgcgtacgtacgtacgggtaactaggaccggttactacggtaaacttccttaccggcgtaaccgttacggtacgtttaagacggtacctacgggtacgtaacccgtaaataccgtaggttaaccgtcgttaacgggtacgtaccgggtaaccgtacgtcggtaacccgttcggtaccgtcggtaccgtcccggaaacctaccccgtaccgtaccgttgtacccg

SEQ ID NO: 133130 - DNA, 693 bp, Homo sapiens
  misc_feature: GYAE6OF02GRGNO.9.34.D01.1.454.CMB.1.raw
  modified_base (235)..(235): a, c, t, g, unknown or other
  misc_feature (235)..(235): n is a, c, g, or t
  modified_base (360)..(360): a, c, t, g, unknown or other
  misc_feature (360)..(360): n is a, c, g, or t
tcagtgatacgtctcacgaccggtgctcgatttagatcgtctgtgttgggtttgggggaggcgttggtccagcctggggagtccctgcgactctcctgtgtggcctctggattcacctttgagacctatcgcttgaccgtggtccgccgaggcctcgagggggagggacgtggagtgggtcgcgaggcagtcgcgtgggtggcggtcagttgacacagttcacgcaaacgtcggngacgggcgcttcagtcatctccagacgacaacttccagaacagtacagtctctcgacaactacctaaataacctggagaggcgaaggacgcgacgtacttttagtcttggacgtacgaaggacgngtagtaaggtacggaattaacgtattttacacgttcccggtacagtacgtacgtacttacgtttgggactttacggaccggggggacccggggtaaccgttcggtcggtcccgttcgttaccgccggtaccgcctaccctaacgggacccgcctacggtcccgttaccccggttaccctcggtacccacccttaccgaccgaactaccgacctcggtacccggtaggggaccctaacgcgggttaccgcccggttagcccgtcggaccgttacggacgtaaccggtaccgtaccgttaccgtaaggcccgtaacttaccgtggaccgtacggg

SEQ ID NO: 133131 - DNA, 903 bp, Homo sapiens
  misc_feature: GYAE6OF02JFSD4.9.34.D01.1.454.CMB.1.raw
tcagtgatacgtctcacgaccggtgctcgatttagatcgtctgtgttgggtttgggggaggcgttggtccagcctggggagtcccgtgccgactctcctgtgtggcctcgtcggattcgacctttgagacctatgccttgaccgttggtccgccgaggctccgaggggagggacgtggagtgggtcgcgaggcagtcgctggtcggtcggtcagtcgactacgacttctacgacctaaaacgtccgtaggacggggtccacgttcatcacgtctccagacgacaacttccaagacatactgtctctcgactacactaaagtacctagacgacgggcgacggaccgtacggccttattttactttactacgttagaccggaaggaacggtactaaggttagtacggggaaacgtttaaccggttaagtttttaccgactttaccccgtccgacgtacggtaccgtaaccttacgttttaacggtacgttttaacccggggtagggggtaccccggggttaaaccgggtcccgggttacccggtaaccccgttcccgtttacccggtacccgtacgtacccccgttaacccgaacccgtaacccggggtaccccttaccgggtttccccgtttaccccgttaccccccggttcgtacccccctaaccccgtttaccccgtaaacccgtaaccgggtaacccgcccgttaaccccgggttcgggttcccggggaaccggtacccgaacccggggtttaccccggccccgggttccgggttcccggtaccccggttaccggttacccgggtaacccggtaaacggtttaaacccccgtttcccggttaacccgttaaccgggtaaccgtttacccggtaccggtaacgggttcccgaacccgggggg

SEQ ID NO: 133132 - DNA, 723 bp, Homo sapiens
  misc_feature: GYAE6OF02FP7Y5.9.34.D01.1.454.CMB.1.raw
  modified_base (429)..(429): a, c, t, g, unknown or other
  misc_feature (429)..(429): n is a, c, g, or t
  modified_base (671)..(671): a, c, t, g, unknown or other
  misc_feature (671)..(671): n is a, c, g, or t
tcagtgatacgtctcacgaccggtgctcgatttagatcgtctgtgttgggtttgggtctgagagaggagcccagccctgggattgtcaggtgttttcatttggtgatcaggactggacagagagaactcaccatggagtttgggctgacctggtctttttctcgtggctagttttaaaagtgtccagtgtgagttcaactgttggagtcgtgggggagcttggtccaggtcccgtggggacgtccctgccgactctcctgtcgtggcctcgtagattccacgtttagacgtacctattcgacccgttgtaaccgtgggttccccgcgtaggccctccggaagggggtacgggactacggggaaggttgggtaccgcggaacgggtcctacgtcgaccggtttgggtccggtcggggtactacgtgaacncgttaacttacccgtacgtaccgtaaaccgttccgggtaggacggggtcctactttcgatcctatcccgactaaggacgtaaacctaccgttaccccaaagtaacctattaccgttacgtcccgtacgttacgacctaaaccgttaacaaaccgttaacccgtaggaacccggagggtaacccgaggtaaacccgtaactcccgtttaaattttacgttcgtagtaccgtaggaccgggtanacgtagttacggaaggtaacgttagtacttccggaccttacccgcgtaaccg

SEQ ID NO: 133133 - DNA, 756 bp, Homo sapiens
  misc_feature: GYAE6OF02JKJOI.9.34.D01.1.454.CMB.1.raw
  modified_base (187)..(187): a, c, t, g, unknown or other
  misc_feature (187)..(187): n is a, c, g, or t
tcagtgatacgtctcacgaccggtgctcgatttagatcgtctgtgttgggtttgggggctctgcttcagctggtgggcacaagaggcagcactcaggacaatctccagcatggctggtctcctctcctctcactctcctcgctcactgcacgcgggtccgtcggccctagtcttcgttcgtgacgcncgtcccgccctcgagtcgtcgtcgggcccgagggcaggacggtccacatcctcggtcgacgtacgtaggaacgtacgcctaaccaaacgtcggttaccggggacttaacgtttagagtaacgttcgtaacctacgttaccggtaaacccaacctaccgttaccgaacggtaaccacccgtaaccccgtaaatcctaatacttaattacgtacaacgtaaactcggtaacggacggtcccgtccgttaaccggaccgggtaccctacgaccgtacttcccgcccgtactaaccgtcggtactaccgggtactaacgtacgtaccgtaccgtcccttcccgggcgtaccctacttccgacccggtacgggttccctaccggaaggttccaaaggggttggacacgggttacgtcgtaccgtaacgtttaccgtacccggtatacccggttaagccgttacgacggttaccggtacggtaaccgttacggtaaacgttccgtaacgtttcccgttaagggttaacccttaggggtacccggaaaccggttcggtaccccgttaccggtcggg

SEQ ID NO: 133134 - DNA, 637 bp, Homo sapiens
  misc_feature: GYAE6OF02J0LQH.9.34.D01.1.454.CMB.1.raw
  modified_base (146)..(146): a, c, t, g, unknown or other
  misc_feature (146)..(146): n is a, c, g, or t
  modified_base (236)..(236): a, c, t, g, unknown or other
  misc_feature (236)..(236): n is a, c, g, or t
  modified_base (344)..(344): a, c, t, g, unknown or other
  misc_feature (344)..(344): n is a, c, g, or t
  modified_base (507)..(507): a, c, t, g, unknown or other
  misc_feature (507)..(507): n is a, c, g, or t
  modified_base (629)..(629): a, c, t, g, unknown or other
  misc_feature (629)..(629): n is a, c, g, or t
tcagtgatacgtctcacgaccggtgctcgatttagatcgtctgtgttgggtttgggggagggcttggtccagcctggggagtccctgcgactctcctgtgtggcctctggattcacctttgagacctatgccttgacctgggtccnccaggctccaggggagggactgggagtgggtcgcaggcatcgctggtggcggtcatgacacattctacgcaaacgtccgtggaggggccncttcatcagtcctacaggagacaacttcccagaaccatactgtctctgacaactcaaatacctagacgaggcgacgacacggcctagtttattcgtagtcgacgaggnggacagtagtaggaacgtacgtattttcgactaccccgtcgacgtaacgtccggtaactacgtttagacgtttaacggtcggggggacccggtaaccgttggtccgtaccggttcctacgtcacgtccctacaaccgtagcccgtacgtacgttcctacccgngtccaccgttccacgtacactccaccgtgacgggtacaccgagcccggtccgttagggccttaccggcctacgggtacaaacgggtccttaacggtacctcgggaacccttgaccgttaccnggtacggg

SEQ ID NO: 133135 - DNA, 755 bp, Homo sapiens
  misc_feature: GYAE6OF02H8832.9.34.D01.1.454.CMB.1.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
  modified_base (284)..(284): a, c, t, g, unknown or other
  misc_feature (284)..(284): n is a, c, g, or t
  modified_base (591)..(591): a, c, t, g, unknown or other
  misc_feature (591)..(591): n is a, c, g, or t
  modified_base (731)..(731): a, c, t, g, unknown or other
  misc_feature (731)..(731): n is a, c, g, or t
tcagtgatacgtctcacgaccggtgctcgatttagatcgtctgtgttgggtttggggtctgagagaggagcccagccctgggattgtcaggtgttttcatttggtagatcaggactggacagagacgtaactcacctatggtagtttgggctgacctggtctttttactcgtggtcttagtttaaaggtcgtactagtgtgngttacacgtgtgagtcgtggggngtctcggtccacgcgtgggtacgtcccgtgctctcctccngtcgtcgtcctcgtcggtntccttccgttagacgtacctacttgtccgttcgtaccggtccgggtccgtaccgcggtccgttaaccggaggggtacgggtacggttcgggtagggttccggcggacgacggtacgacgttcggccggtgggtcgggtaccggtactagtccgaaaccgtagtaccttttacccggacgtaaccgtaacccgttccgacggggaccgggccgtaccgttactacgttacctaacctcccgtaccgtaagaacctaaaccgttaaacctaccggtaaaccaaacgttaaccgttacgttaacccgttnttaccgtaccgtaacctaaccgtaaccttaacctaaccggtagacggacgtcggaacgtaccgtaacccgggtacttagtttacgtcggtttacgacggtaaggcggtacgtagaaggttacggtaggtcgttaacgttntaacccggtccgtcccgtacgtcg

SEQ ID NO: 133136 - DNA, 830 bp, Homo sapiens
  misc_feature: GYAE6OF02I669P.9.34.D01.1.454.CMB.1.raw
tcagtgatacgtctcacgaccggtgctcgatttagatcgtctgtgttgggtttgggcatgtgtgagttttgtcacaagatttgggctcaactttcttgtccaccttggtcccagcctgggagtccctgcgactctcctgtgtggcctctggattcacctttgagacctatgccttgacctgggtccgccaggctccgaggggacggactggagtgggtcgcaggcatcgcgtgggtgcggtcatgacacattcacgacaaacgttccgtggacgggccgtacttcagttcatcctccgaagacgtacctaaacttccccaagtaaaccgtaattaaccgtggtaccttaccgtacggtaccctaaaccgttaaccgtaaaacgttttaaaccccggtaggtaaacgggtaaccgggacggtaaaccgggaaaccgtaaacccggggtccccttaaaagtttttttaaccgtttacgtttacgggttacggaaaccggttaaaacggggacgggtaacctaaagtttaacgggtacggggtaaaacggtttaacggtaacggttttttaaccggaaccgtttacccccgtccggtaacgtaacgggttaccgtaacgttacgtttacggtaacgtttacgggtccgggggtacccggggtaaacccttggggtcccgtaccgttccgtacccgtcgaccgtacccgtaaccgtaccggaaccggccctaacgtcccgttacccttcccccgtaggtccccgtacccttccgtaacccgtaacgaccgtccctacgtaccgggtccgggacctacgaccggccggtacccgg

SEQ ID NO: 133137 - DNA, 469 bp, Homo sapiens
  misc_feature: GYAE6OF02G7AXW.9.34.D01.1.454.CMB.1.raw
  modified_base (363)..(363): a, c, t, g, unknown or other
  misc_feature (363)..(363): n is a, c, g, or t
  modified_base (431)..(431): a, c, t, g, unknown or other
  misc_feature (431)..(431): n is a, c, g, or t
  modified_base (433)..(435): a, c, t, g, unknown or other
  misc_feature (433)..(435): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (443)..(469): a, c, t, g, unknown or other
  misc_feature (443)..(469): n is a, c, g, or t
tcagtgatacgtctcacgaccggtgctcgatttagatcgtctgtgttgggtttggggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggcctccaggctgaggatggaggctgactattactgccagtcgtatgacaggtggacctaagtaacagtcgtcttcggaactgggaccaaggtccaccgtctggcacgcccaaggccaacccntgcactctcgtccccgccctctcacgtactactcactgacggcgggctgggacaagggcacagtacgntnnngacngncnnnnnnnnnnnnnnnnnnnnnnnnnnn

SEQ ID NO: 133138 - DNA, 908 bp, Homo sapiens
  misc_feature: GYAE6OF02IO5VR.9.34.D01.1.454.CMB.1.raw
  modified_base (273)..(273): a, c, t, g, unknown or other
  misc_feature (273)..(273): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
tcagtgatacgtctcacgaccggtgctcgatttagatcgtctgtgttgggtcgtgggggaggcttggtccagcctggggagtccctgcgactctcctgtgtggcctctggattcaccttttgagaccgtatgccttgacccgtgggtcccgccaggctccgagggggtagggactggagtgggtcgcaggcatcgcgtaggtggcggtacagtgacactattccgacgaccaaactccggtggaggggtcctcttcgactcactcctcgaganactacttccagaacatctgtctctacgcaaactcaaactacgngacgngtacgacacgcgacttagtttctagtgccgaggaacgcgtactagtacggtaggtacgttaacgttacgtttccgacccgttccgtacggaacgttacggtaacccttacgtttaggttaacgtttaacggttacccggggggtacccggggggttaacccccggtcgtttaacccgggttcccccggtcccgtttacccgtacccgttccgtacccggtttaaccccccgaaccccgggttaaaaggggaccccgggtaccccgtttttaaccgggttcccccccgggtttttaaccccccgtaccccgggcccgtttaccccccgtaaaacccccgtttccctaaaaacccggggttaaacggtcccccttaacccggttaacccggggttccggggggtaccggcccctaaaaccccggggggttccttccccggggggggtacccttccgggggttaccgtacccccggttttaaccggggttaccgttaaaaacccgggaccgggtttaacccctttttaacccggggaacctttaaaccggttcccgtaaccgttcccgggttaacggtaaaccggggggg

SEQ ID NO: 133139 - DNA, 726 bp, Homo sapiens
  misc_feature: GYAE6OF02GF27B.9.34.D01.1.454.CMB.1.raw
  modified_base (589)..(589): a, c, t, g, unknown or other
  misc_feature (589)..(589): n is a, c, g, or t
tcagtgatacgtctcacgaccggtgctcgatttagatcgtctgtgttggggtttggggacaagaggcagcactcaggacaatctccagcatggcctggtctcctctcctcctcactctcctcgctcactgcacagggtcctcgggccagtctgttctgacgcagccgccctcagtgtcgtcggggccccgagggccaggacgggtccaccgatctcgtgtccacgtaggaagtagacctaccgaacgacggttcggggacctaacgttacgtgattcgtactaccgtacggtaaccaactaaccgttaccgaacggtaaccaaccgaccccctaaagtctaacgttactaatttacgtacgaaactaacacgtaacggaacggtcccggtacccgtaccgggtaccgggttccccgtaccggtaacccgtacgtttccccgtccgggtaccgtacccgtaacggtccggttcggactaacctacgttccgacccgtacccctcccggtacgcctaactccgtacggtcggtcctacggcggtacgacggtaaggtgtacggacggtcgtacgtaacttcgttacgtacnccgtacggttactgacgtagtacgtacgtacctaaagtacgtacttacggtaccgtacggtaacgtccggtaaccgaaccgggttcaccggtggtaccggacaccgacccgaccgtacccaccggtctaccgtaccg

SEQ ID NO: 133140 - DNA, 869 bp, Homo sapiens
  misc_feature: GYAE6OF02JGC6W.9.34.D01.1.454.CMB.1.raw
tcagtgatacgtctcacgaccggtgctcgatttagatcgtctgtgttgggtttgggggctctgcttcagctgtgggcacaagaggcagcactcaggacaatctccagcatggcctggtcctctctcctcctcactctcctcgctcactcgcacgaggtcctggcccagtctgttactgacgcacgtcccgcctgagtgtccgtcggggaccccagggcaggtacgggtccaacctagtcctcgtagcctaacgtggaaacgtcgcctaccatcgtacgggctacgttatcgtagtacgtactacgtacggtaaccctaactaaccgttcgaacggtaaccgacccgtaacccccgtaagtcctaacgtacttaagtttaacgacggaaacctaactaacgttacggtaaccgggtacccgggtacccgttaccggggtaacccgggtttacccggtaccggggtaaccttaaccggttcccgttaccccggtacctacccggtttaaacgtccgttacgggaacctttaccgaacgttccgtaacccgtccccgttaccgacgtaccgtacccgtaccgtaccggtaccgggttccctaccgggttaccgtcgtaggtaaccggttacgtcggtaccgttaacgttaccgttaaacgttaccggtttacccgacgttaaccggaaccggtttacgttaacggttacccggtacggttaacgggttaaccccgggtttaaacgttaaaccggtttaaccggttaccggttttaacccggtttaccgggtttaaacggggttacccgggtaaaccggggttaaccccggtttacggggtttaacccccggttaccccgggttttaccgggg

SEQ ID NO: 133141 - DNA, 646 bp, Homo sapiens
  misc_feature: GYAE6OF02HIJMQ.9.34.D01.1.454.CMB.1.raw
  modified_base (215)..(215): a, c, t, g, unknown or other
  misc_feature (215)..(215): n is a, c, g, or t
  modified_base (593)..(593): a, c, t, g, unknown or other
  misc_feature (593)..(593): n is a, c, g, or t
  modified_base (598)..(599): a, c, t, g, unknown or other
  misc_feature (598)..(599): n is a, c, g, or t
  modified_base (604)..(604): a, c, t, g, unknown or other
  misc_feature (604)..(604): n is a, c, g, or t
  modified_base (610)..(610): a, c, t, g, unknown or other
  misc_feature (610)..(610): n is a, c, g, or t
  modified_base (621)..(621): a, c, t, g, unknown or other
  misc_feature (621)..(621): n is a, c, g, or t
  modified_base (626)..(626): a, c, t, g, unknown or other
  misc_feature (626)..(626): n is a, c, g, or t
tcagtgatacgtctcacgaccggtgctcgatttagatcgtctgtgttgggtttgggattcacgttgcagatgtaggtctgggtcgcaggcatcgctggtggcggtcatgacacattctacgacaaactccgtggaggggccgcttcatacatctccagacgacaattcccagaacatactgtctctgcaactcaaactaactgagaggcgagacncggctatttacttcgtgtgacgaaggtacggcaagttagtagggtaacgtacggtattttcgactccccgtaccgacgacgtcgactactttagtagttacggtcggggacccggggtaaccgtcggtccgtccgtcctccgtcacgtccctccgaaccgaacggcccgtagtccgttccgttccccgtacggtcctaccccgtacctaccgaaaggacaccgtaaccgtcggtacgggggacccacgggtacggccggacccggtcgggtacctcgggtacccgtgggtacgtaaacgggtaccttaacgtcgaacgaacgttacaacgtcggacgacgggccttacggacgtaacggccgactacgtaggctacgntacgnntacgntacgtnaacgtcaacgntacgngacgtcagacgtactagagc

SEQ ID NO: 133142 - DNA, 530 bp, Homo sapiens
  misc_feature: GYAE6OF01AWW3T.17.33.C11.1.454.CMB.1.raw
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
tcagcgtagactagcacgaccggtgctcgatttagagtgagctcgttgggtttgggctggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagacagaaacctggacaagcacccaggcactcatttatagtacaaacaacaaacactacctggacccctgcccgattctcagctccctcgtggggcaaagctgccctgacactgtctggtgtgcagcctgacggacgaggctgactattacngcctactctactttggtgtgctgngctagttcggcggtaggaccaagctcgaccgtcgttaaacgtccagtcccaaggcctacgccccctccggtccactcctcgttcccctaccccg

SEQ ID NO: 133143 - DNA, 566 bp, Homo sapiens
  misc_feature: GYAE6OF01CHG47.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctacgacccctgcccgatctcaggcctccctccgttggggacaaagctcgccctgacactgtcgtggtgtgcacgcctgaggacgaggctgactattactcgtcctactctactttggtggtgtcgtgtcgctagttcgggcggacggacaagcgtcgaccgtacgttaagtcgacgacccgaaggccgtccggccccccgttcgggtacctaccgttccttccgttccccctaccccttcccttaccccg

SEQ ID NO: 133144 - DNA, 510 bp, Homo sapiens
  misc_feature: GYAE6OF01ACE5S.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgatctcaggctccctcttggggcaaagctgccctgacactgtctggtgtgcagcctgaggacgaggctgactattactgcctactctactttggtgtgctgtgctattcggcggagggaccaagctgaccgtctaagtcagcccaggcctgcccctcggtcatctgtccctacccc

SEQ ID NO: 133145 - DNA, 525 bp, Homo sapiens
  misc_feature: GYAE6OF01BCM6N.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggttgcttgtgctagttcgggcggagggaccaagctgaccgtcttaagtccagcccaaggcctcgccccctcggtccactctcgtccctacccc

SEQ ID NO: 133146 - DNA, 518 bp, Homo sapiens
  misc_feature: GYAE6OF01BYT3S.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgttcccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctagtcggcggagggaccaagctgaccgtcttaagtcagcccaaggcctgccccctcggtcactctcgtcccctacccc

SEQ ID NO: 133147 - DNA, 515 bp, Homo sapiens
  misc_feature: GYAE6OF01EBGPU.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgatctcaggctccctcttggggcaaagctgccctgacactgtctggtgtgcagcctgaggacgaggctgactattactgcctactctactttggtgtgctgtgcttagttcggcggagggaccaagctgaccgtctaagtcagcccaaggctcgccccctcggcactctcgtcccgtcccc

SEQ ID NO: 133148 - DNA, 518 bp, Homo sapiens
  misc_feature: GYAE6OF01DSNIS.17.33.C11.1.454.CMB.1.raw
  modified_base (508)..(508): a, c, t, g, unknown or other
  misc_feature (508)..(508): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgcttagttcggcggagggaccaagctgaccgtctaagtcagcccaaggctcgcccctcgtcactctgttccccncctcctcccg

SEQ ID NO: 133149 - DNA, 718 bp, Homo sapiens
  misc_feature: GYAE6OF01BYR31.17.33.C11.1.454.CMB.1.raw
  modified_base (241)..(241): a, c, t, g, unknown or other
  misc_feature (241)..(241): n is a, c, g, or t
tcagcgtagactagcacgaccggtgctcgatttagagtgagctcgttgggtttggggctggcgaccaggggtcccttccaatatcagcaccatggcctggactcctctctttctgttcctctcacttgcttgccagggtccaattctcagactgtggtgactcaggagccctcactgactgtgtcccaggagggacagtcactctcacctgtcgcttccaacacgtggacgcagtcaaccngtcgtacttactactacctaaacgttcggttaccagacaacgtaaccgtggaacaacgccaacccggagggaccacgtactatttagaacgtaacaaacaaacaaacactccgtacgaccctacgaccgtaattcgacgacggtcctacccgttacggttacgggggaacaaacggtccgtacggtacccgttaggaaccttacgttcggtaccgttagggtacgttcgacgtaacgtccgtagggaacgggacgacgggtctacggtaacttacgttacgtcgtacccttacttacgtttacggtttgggtcggttcgtcgttaggtcgtacgttacggttaccgggtacgggaacgggtaaccacgtcgtacggtacccgtttaagttaacgtcgtaccggacccgtaacgggtcccgttcccggtacccccgttacgggtaccctaccgttccgttccgttccccctaaccccg

SEQ ID NO: 133150 - DNA, 522 bp, Homo sapiens
  misc_feature: GYAE6OF01DPHR1.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctgactattactgcctactctactttggtgtgctgtgcttattcggcggagggaccaagcgtgaccgttcttaagtcagcccaaggcctcgccccctcggtcactctcgttccccgtcccc

SEQ ID NO: 133151 - DNA, 556 bp, Homo sapiens
  misc_feature: GYAE6OF01AIEKS.17.33.C11.1.454.CMB.1.raw
  modified_base (337)..(337): a, c, t, g, unknown or other
  misc_feature (337)..(337): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctcgacccctgcccgatcncaggcctccctcgtggggcaaagctcgccctgacactgtctggtgtgcagcctggaggacgaggctgactattactgccctactcttacgtttggtgtgtctgtgtcgttagttcgggacggagggaccaagcgtcgtaccgttacgttaacgtccgagcccgtaaggccctccgcccccgttcggtccctaccttccttcccggttccccgtcccccg

SEQ ID NO: 133152 - DNA, 517 bp, Homo sapiens
  misc_feature: GYAE6OF01EEFZB.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctcttggggcaaagctgccctgacactgtctggtgtgcagcctgaggacgaggctgactattactgcctactctactttggtgtgctgtgctagttcggcggagggaccaagctgaccgtcttaagtcagcccaaggcctgccccctcggtcactctcgtcccgtcccc

SEQ ID NO: 133153 - DNA, 526 bp, Homo sapiens
  misc_feature: GYAE6OF01CDM7R.17.33.C11.1.454.CMB.1.raw
  modified_base (398)..(398): a, c, t, g, unknown or other
  misc_feature (398)..(398): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctgggatccgtcacgcccccagggaaacggccctggagtggcttgcgctcatttattgggatgagagtaagcactacagtccgtctctgaagaacaggctcacatcacaagacacctcacaaccagtcgtaccttacatgacaatatgaccctgngacacagccacatattactgttcacgctctagtggttcgggtattagttacgtccttacttgactacgtgggccagggactcgtcggtcaccgtctccgcacgccctacaccgacggcccagtcccgg

SEQ ID NO: 133154 - DNA, 523 bp, Homo sapiens
  misc_feature: GYAE6OF01BRTJF.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaatcacccagggcactcatttatagtacaaacaacaaacactcctggacccctgcccgatctcaggctccctccttgggggcaaagctgccctgacactgtctggtgtgcagcctgaggacgaggctgactattactgcctactctactttggtggtgctgtgctagttcggcggtagggaccaagctgaccgtcttaagtcagcccaaggctcgccccctggtcactctgttccccgccctcctcccg

SEQ ID NO: 133155 - DNA, 546 bp, Homo sapiens
  misc_feature: GYAE6OF01CY823.17.33.C11.1.454.CMB.1.raw
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
  modified_base (443)..(443): a, c, t, g, unknown or other
  misc_feature (443)..(443): n is a, c, g, or t
  modified_base (534)..(534): a, c, t, g, unknown or other
  misc_feature (534)..(534): n is a, c, g, or t
tcagcgtagactagcacgaccggtgctcgatttagagtgagctcgttgggtttgggggcgccaggggtcccttccaattatcgagcgaccatggcctggactcctctctttctgttacctctcacttgctgcccagggtccaattctcagactgtggtgactcaggagccctcactgactgtgtccccaggaggacaggtcacgtctcaccgtgtagcttccaacactggacgcagtcaccagtgctactntccaaactggttccagcanaaacctggacaagcaccaggcactcatttatacgtacaaacaacaaacactcctacggacccctgcccgattctcaggcctccgtccgttcgggggacaaagctagccctgacactgtctggtgtgcagcctgagacgaggctgactatactgcctactctactttggtggtnctgtgcttagttcgggcggagggacccaagctacgaccgttcttaaagtcacgcccaaggcctcgccccctggtcaccttctcgttccccnccctcctacccg

SEQ ID NO: 133156 - DNA, 520 bp, Homo sapiens
  misc_feature: GYAE6OF01D8S7Z.17.33.C11.1.454.CMB.1.raw
  modified_base (438)..(438): a, c, t, g, unknown or other
  misc_feature (438)..(438): n is a, c, g, or t
  modified_base (510)..(510): a, c, t, g, unknown or other
  misc_feature (510)..(510): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctnttcgggcggagggaccaagctgaccgtcttaagcagcccaaggcctcgccccctcggcactctcgttccccnccctcctccc

SEQ ID NO: 133157 - DNA, 514 bp, Homo sapiens
  misc_feature: GYAE6OF01A7MWX.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaacaacaaacactcctgacccctgcccgattctcaggctccctccttggggcaaagctgccctgacactgtctggtgtgcagcctgaggacgaggctgactattactgcctactctactttggtgtgctgtgctattcggcggaggaccaagctgaccgtcttaagtcagcccaaggcctgccccctcggtcactctgttcccgtcccc

SEQ ID NO: 133158 - DNA, 514 bp, Homo sapiens
  misc_feature: GYAE6OF01D1NBO.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgatctcaggctccctcttggggcaaagctgccctgacactgtctggtgtgcagcctgaggacgaggctgactattactgcctactctactttggtgtgctgtgctagttcggcggagggaccaaggctgaccgtcttaagtcagcccaaggctcgcccctcggtcatctgtcccgtacccc

SEQ ID NO: 133159 - DNA, 550 bp, Homo sapiens
  misc_feature: GYAE6OF01BKTRX.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgatctcacggctccctcttggggcaaagctcgccctgacactcgtctggtgtgcagcctgaggacgaggctgactattactgcctactcttactttgggtcggtgtcctgtcgtctagttccgggacgggtagggaccgaagccgtacgaccggttcttaagtcacgcccgaaggcctcgcccccgtcggtccacttcctcggttccccgtccccg

SEQ ID NO: 133160 - DNA, 531 bp, Homo sapiens
  misc_feature: GYAE6OF01A6KGY.17.33.C11.1.454.CMB.1.raw
  modified_base (229)..(229): a, c, t, g, unknown or other
  misc_feature (229)..(229): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagcacccaggcactcatttatagtacaaacaacaaacactcctggacccctgcccgattctcaggctccctccgttggggcaaagctcgccctgacactgtctggtgtgcacgcctgaggacgaggctgactattactgcctactctactttggtgtgctgtgtctagttcggcggagggaccaagctcgaccgtacgttaagccagcccgaaggcctcgcccccgtcggtccacctcttcgtccccgtcccc

SEQ ID NO: 133161 - DNA, 541 bp, Homo sapiens
  misc_feature: GYAE6OF01EK83H.17.33.C11.1.454.CMB.1.raw
  modified_base (299)..(299): a, c, t, g, unknown or other
  misc_feature (299)..(299): n is a, c, g, or t
  modified_base (419)..(419): a, c, t, g, unknown or other
  misc_feature (419)..(419): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttanagtaacaaacaaacaaacactcctacggacccctgcccgattctcacggctccctccgttggggcaaagctgccctgacactgtctggtgtgcagcctgaggacgaggctgactattctncctactctacgtttggtggtgctgtgctagttcggcggagggaccaagctgaccgtagttaacgtcacggcccgaaggcctccgtcccccgtcggtacacctccttcgttcccctacccccg

SEQ ID NO: 133162 - DNA, 513 bp, Homo sapiens
  misc_feature: GYAE6OF01EIVSA.17.33.C11.1.454.CMB.1.raw
  modified_base (468)..(468): a, c, t, g, unknown or other
  misc_feature (468)..(468): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgatctcaggctccctcttggggcaaagctgccctgacactgtctggtgtgcagcctgaggacgaggctgactattactgcctactctactttggtgtgctgtgcttattcggcgagggaccaagctgaccgtnttaagtcagcccaaggcctgccccctggtcactctgtccctaccc

SEQ ID NO: 133163 - DNA, 517 bp, Homo sapiens
  misc_feature: GYAE6OF01DP627.17.33.C11.1.454.CMB.1.raw
  modified_base (435)..(435): a, c, t, g, unknown or other
  misc_feature (435)..(435): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgattctcaggctccctcttggggcaaagctgccctgacactgtctggtgtgcagcctgaggacgaggctgactattactgcctactctactttggtggtnctgtgctatcggcggaggaccaagctgaccgtcttaagtcagcccaggccgtgccccctcggtccactctcgtccctacccc

SEQ ID NO: 133164 - DNA, 514 bp, Homo sapiens
  misc_feature: GYAE6OF01AM8Z1.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcacggctccctcttggggcaaagctgccctgacactgtctggtgtgcagcctgaggacgaggctgactattactgcctactctactttggtgtgctgtgctagttcggcggagggaccaagctgaccgtctaagtcagcccaagcctgccccctcgtccatctcgtccctacccc

SEQ ID NO: 133165 - DNA, 514 bp, Homo sapiens
  misc_feature: GYAE6OF01BDBMT.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctggacccctgcccgattctcagctccctcctggggcaaagctgccctgacactgtctggtgtgcagcctgaggacgaggctgactattactgcctactctactttggtgtgctgtgctagttcggcggagggaccaagctgaccgtcttaagtcagcccgagcctgccccctcggtcactctcgttccccgtccc

SEQ ID NO: 133166 - DNA, 725 bp, Homo sapiens
  misc_feature: GYAE6OF01DFZVJ.17.33.C11.1.454.CMB.1.raw
tcagcgtagactagcacgaccggtgctcgatttagagtgagctcgttgggtttgggggctggcgccagggggtcccttccaatatctagcacctatggcctggactcctctctttctgttcctcctcacttgctcgccaggggtccaattcgtcagactgtgggttcgactcaggtagtccctcgactgactgtcgtacccgagggagggaccaggtcgacgtcggtcaccgtgtcgcttccaacgactcggagcagtcaccagtcgcttactactccaaactcggttccacgtacaagtaaaccttggacaacgcaccgagggacacgtcactttagtacgtaacaaacgaacaaacgactacgtacggacccgtcgaccgtattctacacggtctacccgtcgtacggggactaaacgtctacggtacctgaacacgtcgttccgtcgggtcggtcgactagccttaggacgggaccggaagggaccgtacgaacgttacttaacgtacgtaccctactttaccttaacgtttgggttcggtacgtcgttacgtacggtaccgttagttaccgggacgggtaacggggaaccctaaacgggtccgttacggtaacccgttaccgtttaaacggttccgaacgggtacccgtaaacgggaccgttaccggcccccggttaccgggttacctaacccggttcttccggtttccccggttaccccg

SEQ ID NO: 133167 - DNA, 518 bp, Homo sapiens
  misc_feature: GYAE6OF01BH5S1.17.33.C11.1.454.CMB.1.raw
  modified_base (469)..(469): a, c, t, g, unknown or other
  misc_feature (469)..(469): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcagctccctcttggggcaaagctgccctgacactgtctggtgtgcagcctgaggacgaggctgactattactgcctactcttactttggtgtgctgtgcttagttcggcggagggaccaagctgaccgtnttaagtcagcccaaggcctcgccccctggtcactctcgttcccctaccc

SEQ ID NO: 133168 - DNA, 529 bp, Homo sapiens
  misc_feature: GYAE6OF01EV7XH.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgccccgattcctcaggcctccctccgttggggcaaacgctgccctgacactgtctggtcgtgcagcctgagggacgaggctgactattactgcctactctactttggtggtgctgtgcttagtcggcggagggaccagctgaccgtcttaagtcagcccgaaggcctcgccccctcggtccactctcgtcccgtcccc

SEQ ID NO: 133169 - DNA, 521 bp, Homo sapiens
  misc_feature: GYAE6OF01CEADZ.17.33.C11.1.454.CMB.1.raw
  modified_base (431)..(431): a, c, t, g, unknown or other
  misc_feature (431)..(431): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccatggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaaacaacaaaacactcctggacccctgcccgattctcaggctccctccttgggggcaaagctgccctgacactgtctggtgtgcagcctgagacgaggctgactattactgcctactctactttggnggtgctgtgctattcggcggagggaccaagctgaccgtcttaaagtcagcccaaaggctgccccctcggtcactctgttcccaccctccc

SEQ ID NO: 133170 - DNA, 519 bp, Homo sapiens
  misc_feature: GYAE6OF01EWJCB.17.33.C11.1.454.CMB.1.raw
  modified_base (464)..(464): a, c, t, g, unknown or other
  misc_feature (464)..(464): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctggacccctgcccgattctcaggctcctccttggggcaaagctgccctgacactgtctggtgtgcagcctgaggacgaggctgactattactgcctactctactttggtgtgctgtgctagttcggcggagggaccaagctgaccgtnttaagtcagcccaaggctcgccccctggtccactctcgttccccgccctccctcc

SEQ ID NO: 133171 - DNA, 524 bp, Homo sapiens
  misc_feature: GYAE6OF01AGATG.17.33.C11.1.454.CMB.1.raw
  modified_base (430)..(430): a, c, t, g, unknown or other
  misc_feature (430)..(430): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctggacccctgcccgattcctcaggctccctccttggggcaaagctgccctgacactgtctggtgtgcagcctgaggacgaggctgactattactgcctactctactttggngtgctgtgtctagttcggcggagggaccaagctgaccgttcttaacgtcagcccaaggcctcgccccctcggtccactctcgttcccgtccccg

SEQ ID NO: 133172 - DNA, 520 bp, Homo sapiens
  misc_feature: GYAE6OF01BWG66.17.33.C11.1.454.CMB.1.raw
  modified_base (467)..(467): a, c, t, g, unknown or other
  misc_feature (467)..(467): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggtcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctagttcggcggagggaccaagctgaccgtnttaagtcagcccaaggcctgccccctggtcactctgttccccgccctcctccg

SEQ ID NO: 133173 - DNA, 516 bp, Homo sapiens
  misc_feature: GYAE6OF01AC2N6.17.33.C11.1.454.CMB.1.raw
  modified_base (507)..(507): a, c, t, g, unknown or other
  misc_feature (507)..(507): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctagttcggcggagggaccaagctgaccgtcttaagcagcccaaggctcgccccctggtcactctctcccnccctctccg

SEQ ID NO: 133174 - DNA, 512 bp, Homo sapiens
  misc_feature: GYAE6OF01DYW8Q.17.33.C11.1.454.CMB.1.raw
  modified_base (337)..(337): a, c, t, g, unknown or other
  misc_feature (337)..(337): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctgacccctgcccgatcncagctcctcttggggcaaagctgccctgacactgtctggtgtgcagcctgaggacgaggctgactatactgcctactcttactttggtgtgctgtgctagttcggcggagggaccaagctgaccgtcttaagtcagcccaaggctcgccccctggtccactctcgtccctacccc

SEQ ID NO: 133175 - DNA, 529 bp, Homo sapiens
  misc_feature: GYAE6OF01DWTMP.17.33.C11.1.454.CMB.1.raw
  modified_base (517)..(517): a, c, t, g, unknown or other
  misc_feature (517)..(517): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctgacccctgcccgatctcagctccctccttggggcaaagctgccctgacactgtctggtgtgcagcctgaggacgaggctgactatctgcctactctactttggtggtgtctgtgtctagttcgggcggagggaccaagcgtgaccgtcttaagtcacgcccaaggcctcggccccctcggtcctactcctcgttccccnccctcctacccg

SEQ ID NO: 133176 - DNA, 522 bp, Homo sapiens
  misc_feature: GYAE6OF01BIE4S.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtaacaaacaaacaaacactcctcggacccctgccccgattctccaggcctccctccgttgggggcaaagctgccctgacactgtctggtgtgcagcctgacggacgaggctgactattactgcctactctactttggtgtgctgtgcttagtcggcggagggaccaagctgaccgtctaagtcagccaggcctcgcccctggccatctcgttcccgcccc

SEQ ID NO: 133177 - DNA, 524 bp, Homo sapiens
  misc_feature: GYAE6OF01CRZE7.17.33.C11.1.454.CMB.1.raw
  modified_base (465)..(465): a, c, t, g, unknown or other
  misc_feature (465)..(465): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaatggttccagcagaaacctggacaagcacccaggcactcatttatagtacaaaacaacaaacactcctgacccctgcccgatctcagctcctcctggggcaaagctgccctgacactgtctggtgtgcagcctgaggacgaggctgactattactgccttactctacgttttgtggtgctgtgctagttcgggcggtaggaccaagctagaccgtnttaagtcacgcccaaggcctcgccccctggtcctactctcgttccccacccgtcctccg

SEQ ID NO: 133178 - DNA, 527 bp, Homo sapiens
  misc_feature: GYAE6OF01BAVKB.17.33.C11.1.454.CMB.1.raw
  modified_base (471)..(471): a, c, t, g, unknown or other
  misc_feature (471)..(471): n is a, c, g, or t
  modified_base (515)..(515): a, c, t, g, unknown or other
  misc_feature (515)..(515): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaacaacaaacactcctggacccctgcccgattctcacggctccctccttgggggcaaacgctcgccctgacactgtctggtgttgcagcctgaggacgaggctgactattactgcctactcttacttggtggtgctgtgctagtcggcggaggaccaagctgaccgtnttaagtcagcccaagcctcgcccccgtcgtcactctgttccccnccctcctacccg

SEQ ID NO: 133179 - DNA, 517 bp, Homo sapiens
  misc_feature: GYAE6OF01ECUR7.17.33.C11.1.454.CMB.1.raw
  modified_base (465)..(465): a, c, t, g, unknown or other
  misc_feature (465)..(465): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggaccctgccgattctcaggctcctcttggggcaaagctgccctgacactgtctggtgtgcagcctgaggacgagctgactattactgcctactctactttggtgtgctgtgctagttcggcggagggaccaagctgaccgtnttaagtcagcccgaaggcctcgcccccgtcggtcactctcgtccctaccccg

SEQ ID NO: 133180 - DNA, 512 bp, Homo sapiens
  misc_feature: GYAE6OF01CA4FQ.17.33.C11.1.454.CMB.1.raw
  modified_base (297)..(297): a, c, t, g, unknown or other
  misc_feature (297)..(297): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggacccctgcccgattctcaggctccctcttggggcaaagctgccctgacactgtctggtgtgcagcctgaggacgaggctgactattactgcctactctactttggtggtgctgtgctagttcgggcggagggaccaagctgaccgtctagtcagccaaggctcgcccctgtcactctntcccncctctccg

SEQ ID NO: 133181 - DNA, 527 bp, Homo sapiens
  misc_feature: GYAE6OF01AU1TN.17.33.C11.1.454.CMB.1.raw
  modified_base (301)..(301): a, c, t, g, unknown or other
  misc_feature (301)..(301): n is a, c, g, or t
  modified_base (387)..(387): a, c, t, g, unknown or other
  misc_feature (387)..(387): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttanagtaacaaacaacaaacactcctggacccctgccccgatctcaggctccctccttggggcaaagctgccctgacactgtctggtgngcagcctgaggacgaggctgactattactgcctactctacgtttggtgtgctgtgcttagttcggcggagggaccagctgaccgtagttaacgtcacggcccaaggcctcgccccctcggtcactccttgttcccctacc

SEQ ID NO: 133182 - DNA, 535 bp, Homo sapiens
  misc_feature: GYAE6OF01CZHYT.17.33.C11.1.454.CMB.1.raw
  modified_base (296)..(296): a, c, t, g, unknown or other
  misc_feature (296)..(296): n is a, c, g, or t
  modified_base (522)..(522): a, c, t, g, unknown or other
  misc_feature (522)..(522): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtacaaacaacaaacactcctaggacccctgcccgattctcaggcctccctccgttgggggacaaagctgccctgacactgtctggtgtgcagcctgaggacgaggctgactattactgcctactctactttggtgtgctgtgcttagttcgggcggagggacaagctgaccgttctagtcacgcccaaggcctccgccccctggtccaccttcctcgttccccnccctccttacccg

SEQ ID NO: 133183 - DNA, 515 bp, Homo sapiens
  misc_feature: GYAE6OF01DXHH9.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgatctcaggctccctcctggggcaaagctgccctgacactgtctggtgtgcagcctgagatgagctgactattactgcctactctactttggtgtgctgtgtctagttcggcggtagggaccaagctgaccgtcttaagtcagccccaaggctcgccccctcggtccactcgtcgttcccc

SEQ ID NO: 133184 - DNA, 520 bp, Homo sapiens
  misc_feature: GYAE6OF01DCB1W.17.33.C11.1.454.CMB.1.raw
  modified_base (335)..(335): a, c, t, g, unknown or other
  misc_feature (335)..(335): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (466)..(466): a, c, t, g, unknown or other
  misc_feature (466)..(466): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaatggttccagcagaaacctggacaagcaccaggcactcatttatagtacaaacaacaaacactcctcgacccctgcccgattcncaggctccctccgttggggacaaagctcgcctgacactgtctggtgtgcagctgaggacgaggctgactattactgcctactctactttggtggtgtntgtnctagtcggcggaggacagctcgaccgttntacgtcacgaccagcctccgccccgtcgtcnctctcttcccncctcccgtaccg

SEQ ID NO: 133185 - DNA, 520 bp, Homo sapiens
  misc_feature: GYAE6OF01B8UVL.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactacctggacccctgcccgattctcaggctcctccttggggcaaagctgccctgacactgtctggtgtgcagcctgaggacgaggctgactattactgcctactctactttggtgtgctgtgctatcgggcggaggaccaagctgaccgtcttaagtcagcccaaggctcgccccctggtccactctgttccccgccctcctcccg

SEQ ID NO: 133186 - DNA, 535 bp, Homo sapiens
  misc_feature: GYAE6OF01CLXZK.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccaggcactcatttatagtacaaacaacaaacactcctggacccctgcccgatctcaggcctccctccgttggggcaagctcgccctgacactgtctggtgtgcagcctgaggacgaggctagactattactgcctactcttacgtttggtgtgtctgtgcttagtcgggacggagggaccaagctgaccgtacttaagtcagacccaaggcctcgcccccgtcggtccacgtcctcgttcccccgtcccc

SEQ ID NO: 133187 - DNA, 509 bp, Homo sapiens
  misc_feature: GYAE6OF01C0QMA.17.33.C11.1.454.CMB.1.raw
  modified_base (463)..(463): a, c, t, g, unknown or other
  misc_feature (463)..(463): n is a, c, g, or t
tcagcgtagactagcacgaccggtgctcgatttagagtgagctcgttgggttttgggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctggacccctgcccgattctcaggctccctctggggcaaagctgccctgacactgtctggtgtgcagcctgaggacgaggctgactatactgcctactctactttggtgtgctgtgctagtcggcggaggccaagctgaccgtntaacgtcagcccaaggctcgcccctcggtcactctcgtccctaccc

SEQ ID NO: 133188 - DNA, 527 bp, Homo sapiens
  misc_feature: GYAE6OF01EZFVL.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctagttcggcggagggaccaagctgaccgtcttaaagtcagcccaaggcctcgccccctcggtccactctcgttccccgccctcctcccg

SEQ ID NO: 133189 - DNA, 611 bp, Homo sapiens
  misc_feature: GYAE6OF01BQE9T.17.33.C11.1.454.CMB.1.raw
tcagcgtagactagcacgaccggtgctcgatttagagtgagctcgttgggtttgggggcgccaggggtcccttccaatatcagcaccatggcctgggactcctctctttctgttcctcctcacttgctgcccacgggtccaattctcagactgtggtgactcaggagccctcactgactgtgtccccaggagggacagtcactctcacctgtcgcttccaacactggaggcagtcaccagtgcttactatccaaactggttccagcagaaacctggacaagcaccagggcactcatttatagtacaaaccaacaaacacctcctcggacccctgcccgattcctcacggcctcccctccgttgggggccaaacgctgccctgaccactcgtctgggtcgtgcgacgcctggaggacgaggctgactattactcgccttactctacgtttggtgttcgcgttgtgtcttagttcgggacggacgggtacctaagtccgtaggaccgttagttaacgtcgtacggcccgaaagggccttcccggccccccgttccgggttacctacccgttcccgttaccggtttacccccaccccgttccccgttaccccgg

SEQ ID NO: 133190 - DNA, 539 bp, Homo sapiens
  misc_feature: GYAE6OF01D9L1Z.17.33.C11.1.454.CMB.1.raw
  modified_base (445)..(445): a, c, t, g, unknown or other
  misc_feature (445)..(445): n is a, c, g, or t
  modified_base (528)..(528): a, c, t, g, unknown or other
  misc_feature (528)..(528): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcaccaggcactcatttatagtaacaaacaacaaacactcctggacccctgcccgattctcacggcctccctccgttgggggacaaagctcgccctgacactgtctggtgtcgcagcctggaggacgaggctgactattactgcctactcttctttggtgtgctgtntctagtcgggcggaggaccagctagaccgtcgttaacgcacgcccgtaaggctcgcccccgtcgtcctactcttcgttccccnccctcctcccg

SEQ ID NO: 133191 - DNA, 534 bp, Homo sapiens
  misc_feature: GYAE6OF01EPEAX.17.33.C11.1.454.CMB.1.raw
  modified_base (335)..(335): a, c, t, g, unknown or other
  misc_feature (335)..(335): n is a, c, g, or t
  modified_base (443)..(443): a, c, t, g, unknown or other
  misc_feature (443)..(443): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctgacccctgcccgattcncacggcctccctccgttgggggcaaagctcgccctgacactgtctggtgtgcagcctggaggacgaggctgactattactgtcctactcttacgtttggtgtgctgtnctatcgggcggaggacagctgaccgtcttacgcacgcccaaggcctcgccccctcggacctactcctacgttccccgtccctcccttaccg

SEQ ID NO: 133192 - DNA, 523 bp, Homo sapiens
  misc_feature: GYAE6OF01B5PIF.17.33.C11.1.454.CMB.1.raw
  modified_base (300)..(300): a, c, t, g, unknown or other
  misc_feature (300)..(300): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggaccccctgccccgattcctcacggctccctccttgggggcaaagctgccctgacactgtctgtgtgcagcctgaggacgaggctgactattactgcctactctatttggtgttgcttgtgcttagttcggcggaggaccagcgtgaccgtacttagtcagcccaggctcgcccctcggtacacttctcgtccccgtccc

SEQ ID NO: 133193 - DNA, 846 bp, Homo sapiens
  misc_feature: GYAE6OF01C8VC2.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtaacaaacaacaaacactcctacggacccctgacccgacttctcaacggtcctcccgttcccgttcggggggacaaaacggtcctacggaccccgttacgaacccgtaaccttcggttcccgttgggttcggttcggcccgtaaagggtcccccgttaggggaaacggggaacccgggtaacggggtcccttacgggtaaccctttaacgttttaaacccgttacggtacccccgtttaaacccgtttcccgtttaaaccgtttttttcgggggttacggggtttcgggtccgttttagggttccggtaccgttttaacgggttttacccgggggaccggggtaaccgggggtaaccccgtaaaagggtcccgtttacgggtaaacccccggtttaccgtttaaaacgggttacccgtaaccgggtaccccccggtaaaacggggtcccccgttacccgggtaccccccccccggtttaccgggttaccccgtaacccgttttccccgtttcccgggtttacccccccgttaaaccccccccgg

SEQ ID NO: 133194 - DNA, 519 bp, Homo sapiens
  misc_feature: GYAE6OF01D1YXF.17.33.C11.1.454.CMB.1.raw
  modified_base (509)..(509): a, c, t, g, unknown or other
  misc_feature (509)..(509): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctcctccttgggggcaaagctgccctgacactgtctggtgtgcagcctgaggacgaggctgactattactgcctactctactttggtgtgctgtgcttagttcggcggagggaccaagctgaccgtcttaagtcagccaaggctcgcccctcggtcactctcttcccnccctcctccc

SEQ ID NO: 133195 - DNA, 514 bp, Homo sapiens
  misc_feature: GYAE6OF01A9GID.17.33.C11.1.454.CMB.1.raw
  modified_base (297)..(297): a, c, t, g, unknown or other
  misc_feature (297)..(297): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctgacccctgcccgatctcagctccctccttggggcaaagctcgccctgacactgtctggtgtgcagcctgaggacgaggctgactattactgcctactctactttggtggtgctgtgtctagtcgggcggagggaccaagctgaccgtcttaagcacgccaggctcgcccctcgcnctctgttcccnccctcctcc

SEQ ID NO: 133196 - DNA, 617 bp, Homo sapiens
  misc_feature: GYAE6OF01ECQXP.17.33.C11.1.454.CMB.1.raw
tcagcgtagactagcacgaccggtgctcgatttagagtgagctcggttggggtttgggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttccaacacgtggacgcagtcaccagtcgcttactactaccaaactggttaccagacaagaaacctggaacaacgcaccgaggcactctaatttatagtaacaaacaacaaacactccacggacccctgacccgattctcacggcctcccgtccgttggggactaaacgctcgacctgactacgtcgtacgtggtcgtgcgacgtcgtggacgggacgtacggtctacgacttacgttactcgtccttacttcgttacgtttcgggtacgtcgacgtgtcgtacgttacgttcgggacggacgggtactaacgtcgtacgaccgttacgttacgccgtacggacccgtaggcctccgaccccgtggtccctacgtcctccgttccctacccgtccgttacccg

SEQ ID NO: 133197 - DNA, 584 bp, Homo sapiens
  misc_feature: GYAE6OF01A5DXG.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctacgacccctgcccgattctcacggcctccctccgttgggggacaaacgctcgccctgacactgtctggtgtgcagcctgaggacgaggctgactattactcgccttactcttacgtttggtggttcgcgttgtgtcttagttcgggtcgggaacgggaccaaggcctcggtaccgttcgttaaacgtcgaacggccctaaggccgtccgtcccccgttcggtaccctaccgttccttccgtttcccccgcccttcccgttaccccg

SEQ ID NO: 133198 - DNA, 539 bp, Homo sapiens
  misc_feature: GYAE6OF01ESDNL.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgacccctgccgattctcacggctccctccttggggcaaagctcgcctgacactgtctggtgtgcagcctgaggacgagctgactattactgccctatctatttggtggtgcgtgtgtcgttagttcggcggacgggaccaagcgtacgaccgtagttaacgtcacgcccgaaaggcctcgacccccgtcggtccacgttccctcgttcccgtccccc

SEQ ID NO: 133199 - DNA, 538 bp, Homo sapiens
  misc_feature: GYAE6OF01CN3E0.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcaccagggcactcatttatagtacaaacaacaaacactcctggacccctgcccgattctcacggctccctcgttggggcaaagctgccctgacactgtctggtgtgcagcctgaggacgaggctgactattactgcctactctacgtttggtgtgcttgtgtctacgttcggcggagggaccgaaggtctcgaccgttcttaacgtccagcccgaaggcctacgcccccgtcggtctatttcctcgttcccctaccccg

SEQ ID NO: 133200 - DNA, 544 bp, Homo sapiens
  misc_feature: GYAE6OF01B1LBK.17.33.C11.1.454.CMB.1.raw
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggaccctgccgattcncagctcctcgtgggcaaagctgcctgacactgcgtggtgtgcagccgtggacggacgaggctagtactacttactgccttactcttacgtttggtgttgcgttgtcgcttagttcggcggaggaccaaggtctacgaccgttacttaacgcgaacgcccgtaaggcctaccgcccccgtcggtctacctccttcgtcccctacccc

SEQ ID NO: 133201 - DNA, 517 bp, Homo sapiens
  misc_feature: GYAE6OF01CBBMA.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctcctggggcaaagctgccctgacactgtctggtgtgcagcctgaggacgaggctgactattactgcctactctactttggtgtgctgtgctagttcggcggagggaccaagctgaccgtcttaagcagcccaggctcgccccctcggtccactctcgtcccgtccccg

SEQ ID NO: 133202 - DNA, 534 bp, Homo sapiens
  misc_feature: GYAE6OF01BOJD9.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcacgctccctccttggggcaaacgctgccctgacactgtctggtgtgcagcctgaggacgaggctgactattactgccttactcttactttggtgtgcttgtgcttagttcgggcggacgggacaacggctcggacccgtagttaacgtcacgcccgaggcctcgccccgtcggtcactctcgtcccctacccc

SEQ ID NO: 133203 - DNA, 587 bp, Homo sapiens
  misc_feature: GYAE6OF01BRX38.17.33.C11.1.454.CMB.1.raw
  modified_base (229)..(229): a, c, t, g, unknown or other
  misc_feature (229)..(229): n is a, c, g, or t
  modified_base (341)..(341): a, c, t, g, unknown or other
  misc_feature (341)..(341): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttacatccaaactggttccagcagaaacctggacaagcacccagggcactcatttatagtacaaacaacaaacacctcctacgacccctgcccgattcncacggcctccctccgttggggacaaagctcgccctgaccactgtctggtgtgcagcctggagggacgaggctgacttattactcgtcctactaccttacgtttggtggtgtcgtgtcgtcgttagttcgggcgggaacgggaccgaagtcgtacggtacccgtacgttaacgtccgacgaccccgtaaacggccgttcccgccccccgttcggtaccctaccttccgtccgttccccctacccccg

SEQ ID NO: 133204 - DNA, 528 bp, Homo sapiens
  misc_feature: GYAE6OF01CZ5U4.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaacaacaaacactcctgacccctgcccgatctcagctccctccgttggggcaaagctgccctgacactgtctggtgtgcagcctggaggacgaggctgactattactgcctactctactttggtgtgcttgtcgcttagttcggcgggagggaccaagcgtagaccgttctaagtcagacccgaagcctcgcccccgtcggtccactcctcgtcccctacccc

SEQ ID NO: 133205 - DNA, 519 bp, Homo sapiens
  misc_feature: GYAE6OF01AWT4Q.17.33.C11.1.454.CMB.1.raw
  modified_base (427)..(427): a, c, t, g, unknown or other
  misc_feature (427)..(427): n is a, c, g, or t
  modified_base (463)..(463): a, c, t, g, unknown or other
  misc_feature (463)..(463): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctccctccttggggcaaagctgccctgacactgtctggtgtgcagcctgaggacgaggctgactattactgcctactctatttggngtgctgtgctattcggcggaggccaagctgaccgtnttaagtcacgcccgaagctcgccccctcgtcactctcgtccccgcccttcctaccg

SEQ ID NO: 133206 - DNA, 508 bp, Homo sapiens
  misc_feature: GYAE6OF01DJSRH.17.33.C11.1.454.CMB.1.raw
  modified_base (460)..(460): a, c, t, g, unknown or other
  misc_feature (460)..(460): n is a, c, g, or t
  modified_base (499)..(499): a, c, t, g, unknown or other
  misc_feature (499)..(499): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctcgacccctgccgatctcagctccctcgttggggcaagctcgccctgacactgtctggtgtgcagcctgagacgaggctgactatactgcctactctactttggtgtgctgtgtctagttcggcggaggacaagctgaccgtntagtcacgccaagctcgcccctcgtcactctcgttcccncctcctccg

SEQ ID NO: 133207 - DNA, 548 bp, Homo sapiens
  misc_feature: GYAE6OF01CSMPH.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccatgcttactatccaaaactggttccagcagaaacctggacaagcaccaggcactcatttatagtacaaacaacaaacactcctggaacccctgcccgattctcaggctccctccttgggggcaaagctagccctgacactgtctggtgtgcagcctgaggacgaggctgactattactcgccttactctactttggtggtgctgtgctagttcggcggagggaccaagcgtcgaccgttcttaacgtcacgcccgaaggcctcggccccccgtcggtcctaccgtcttacgttcccccgcccgtcccttacccg

SEQ ID NO: 133208 - DNA, 532 bp, Homo sapiens
  misc_feature: GYAE6OF01CTS04.17.33.C11.1.454.CMB.1.raw
  modified_base (482)..(482): a, c, t, g, unknown or other
  misc_feature (482)..(482): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcattatagtaacaaacaacaaacactcctcggacccctgcccgattctcaggctccctccttggggcaaagctcgccctgacactgtctggtgtgcagcctggaggacgaggctgactattactgtcctactcttactttcggtggtcgtctgtgcttagttccggcggagggaccaaggctggaccgtnttaagtcagcccgaaggctcgcccctcggtcactcctcgtccccgtcccg

SEQ ID NO: 133209 - DNA, 530 bp, Homo sapiens
  misc_feature: GYAE6OF01C1M5H.17.33.C11.1.454.CMB.1.raw
  modified_base (475)..(475): a, c, t, g, unknown or other
  misc_feature (475)..(475): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctcggacccctgcccgattctcacggcctccctcctcggggcaaagctcgccctgacactgtctggtgtgcacgcctgaggacgaggctgactattactgcctactcttacttggtgtgctgtgtctagtcggcggagggaccaaggctcgaccgtnttaagtcacgacccaggcctcgccccctcggcccactcctcgttcccctaccccg

SEQ ID NO: 133210 - DNA, 522 bp, Homo sapiens
  misc_feature: GYAE6OF01BAYM2.17.33.C11.1.454.CMB.1.raw
  modified_base (430)..(430): a, c, t, g, unknown or other
  misc_feature (430)..(430): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgacccctgcccgatctcagctccctccttggggcaaagctgccctgacactgtctggtgtgcagcctggaggacgaggctgactattactgcctactctactttggngtgctgtgctagttcggcggagggaccaagctgaccgtcttaagtcgagcccaaggctcgccccctcggtccacctctcgttccccgtcccc

SEQ ID NO: 133211 - DNA, 545 bp, Homo sapiens
  misc_feature: GYAE6OF01DY346.17.33.C11.1.454.CMB.1.raw
  modified_base (334)..(334): a, c, t, g, unknown or other
  misc_feature (334)..(334): n is a, c, g, or t
  modified_base (532)..(532): a, c, t, g, unknown or other
  misc_feature (532)..(532): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctgacccctgcccgattcncacggctccctccgttggggacaaagctcgccctgacactgtctggtcgtgcagcctgaggacgaggctgactattactgcctactctactttggtggtgctgtcgtctagttcgggcggtacgggaccaagctcgtaccgtacgttaagccgacgcccgaaggcctcgccccctcggtcctacttctccgttccccnccctcccttaccg

SEQ ID NO: 133212 - DNA, 520 bp, Homo sapiens
  misc_feature: GYAE6OF01C8A9V.17.33.C11.1.454.CMB.1.raw
  modified_base (382)..(382): a, c, t, g, unknown or other
  misc_feature (382)..(382): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctgacccctgcccgatctcagctccctcttggggcaaagctgccctgacactgtctggtgtgcngcctgaggacgagctgactattactcgcctactctacgtttggtgtgctgtgtctagttcggcggtagggaccaagctagaccgttctaagtcagcccaggcctcgccccctcggtaccactctcgttccctaccccg

SEQ ID NO: 133213 - DNA, 512 bp, Homo sapiens
  misc_feature: GYAE6OF01BJQTV.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgatctcaggctccctccttggggcaaagctgccctgacactgtctggtgtgcagcctgaggacgaggctgactattactgcctactctactttggtggtgctgtgctagttcggcggagggacaaggctgaccgtcttaagcagcccaggctcgcccctggccactctcgtccctaccc

SEQ ID NO: 133214 - DNA, 593 bp, Homo sapiens
  misc_feature: GYAE6OF01C580B.17.33.C11.1.454.CMB.1.raw
  modified_base (233)..(233): a, c, t, g, unknown or other
  misc_feature (233)..(233): n is a, c, g, or t
  modified_base (409)..(409): a, c, t, g, unknown or other
  misc_feature (409)..(409): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgccttaccaacactgggancagtcaccagtcgcttaactataccaaactggttccagcaagaaacctggaacaagccaccgaggccactctaatttataagtaacaaacaaacaaaacactaccacgacccctcgaccgtactctcacgcctcctcgtgggacaaacgctcgcctgacacgtgtcgtggtgtgcncgccgtagacggacgaggctagacttaacttactcgtcctacttcttacgtttggtggtcgtcgttgtgtacgttagtcgggcggacggacagtcgtcgtaccgttacttaacggtcacgacccggagtcccgtaccgtcccccgttacggtcctaccgttccgtcccggttcccccgtccccg

SEQ ID NO: 133215 - DNA, 524 bp, Homo sapiens
  misc_feature: GYAE6OF01BOHJU.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactacctcggacccctgccccgattctcaggctccctccttggggcaaagctcgccctgacactgtctggtgtgcagcctgaggacgaggctgactattactgcctactctactttggtgtgctgtgctagttcggcggagggaccaagctgtaccgtcgttaagtcagcccaagcctcgccccgtcggtcactctcgtcccctacccc

SEQ ID NO: 133216 - DNA, 541 bp, Homo sapiens
  misc_feature: GYAE6OF01ETEM7.17.33.C11.1.454.CMB.1.raw
  modified_base (295)..(295): a, c, t, g, unknown or other
  misc_feature (295)..(295): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcacagtgcttactatccaaactggttccagcagaacctggacaagcaccaggcactcatttanagtacaaacaacaaacactcctggaccctcgcccgatctcagcctcctcgttcgggacaaacgctcgccctagaccacgtgtctggtagtgcagctgaggacgagctgactatactcgcctactctacgtttggtggtcgcgtgtcgtcgtacgttcggcggtaacgggaccaagtcgcgtaaccgtcgttaagtcgacgcccgaaggcctccgccccgtcggtccacctctccgtccctaccccg

SEQ ID NO: 133217 - DNA, 520 bp, Homo sapiens
  misc_feature: GYAE6OF01AH6G3.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctggacccctgcccgattctcaggctccctccttggggcaaagctgccctgacactgtctggtgtgcagcctgacggacgaggctgactattactgccctactctactttggtggtgctgtgctagttcggcggagggaccaagctgaccgtctagtcagcccaggcctcgccccctcggtccacctctcgtccctacccc

SEQ ID NO: 133218 - DNA, 534 bp, Homo sapiens
  misc_feature: GYAE6OF01D2U43.17.33.C11.1.454.CMB.1.raw
  modified_base (478)..(478): a, c, t, g, unknown or other
  misc_feature (478)..(478): n is a, c, g, or t
  modified_base (523)..(523): a, c, t, g, unknown or other
  misc_feature (523)..(523): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggcctccctccgttggggcaaagctgccctgactactgtctggtgtcgcacgcctggaggacgacgggctagactattactcgccttactcttactttggtggtgctgtgctgtcggcggagggaccaagctgaccgtnttacgcacgcccaggctcgcccccgtcgtctaccttctctccccncctccctaccg

SEQ ID NO: 133219 - DNA, 613 bp, Homo sapiens
  misc_feature: GYAE6OF01C3CM7.17.33.C11.1.454.CMB.1.raw
  modified_base (297)..(297): a, c, t, g, unknown or other
  misc_feature (297)..(297): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcaagaacctggacaagcaccaggcactcatttanagtacaaacaacaacactccacggacccctgcccgattctcacgcctacccgtcgtaggggacaacgtctccgcctagactacgtcgtcgtggtgtcgcgacgtccgtaggacggacggaggctagacttacttacgtctaccttacttcgttacgtttggtgtgtcgttggtcgtacgttacggtcgggacggacgggacctaaggcgtacgtaccggttacttaacgtaccaccggcccgtaaggcccgtccccggtaccccgttccggtacctaccgttccgttacccggtcccctcccgttcccttacccgg

SEQ ID NO: 133220 - DNA, 645 bp, Homo sapiens
  misc_feature: GYAE6OF01A7ELB.17.33.C11.1.454.CMB.1.raw
  modified_base (341)..(341): a, c, t, g, unknown or other
  misc_feature (341)..(341): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagccacccagggcactcatttataagtacaaacaacaaacactcctgacccctgcccgatcncacgctccctcgtggggacaaacgctcgccctgaccactgtcgtggtgtgcgtacgccgtaggacggacggagggtctaggaaccttatttaaccgtcgtccttaccttctttacgtttagggtggtcgtcgttggttcgtaccgttacggttccgggacgggtaacgggaccgtaaggtccgttacggtaacccggttacgtttaaacggtccgtaacggaccccggtaaacgggtcccttacccgggccccccgtttccgggtaccctaacccgttcccttcccgtttccccctaacccccg

SEQ ID NO: 133221 - DNA, 631 bp, Homo sapiens
  misc_feature: GYAE6OF01D49N3.17.33.C11.1.454.CMB.1.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttccaacnctggancagtcaccagtgcttactactccaaactcggttccagcaagaacctggacaagcaccagggcactcatttanagtacaaacaacaaacactctcgaccctcgaccgtatctcacggcctcccgtccgttcggggacaaacgctcgccctagacctacgtcgtctggttcgtgccacgccgtaggacggacgacggtactgtactagttactcggtccttacttccgttacgtttcgggtacggttgtcgttgttcgtcgttaggttccgggacggtaacgggaccgaacggtcgtacggtaaccgttacgtttaacggcctaacggaccccgtaaaggtccccgtaccgtccccccgttacgggttacctacccgtttccgttcccgttccccgttacccccg

SEQ ID NO: 133222 - DNA, 522 bp, Homo sapiens
  misc_feature: GYAE6OF01DG5PC.17.33.C11.1.454.CMB.1.raw
  modified_base (296)..(296): a, c, t, g, unknown or other
  misc_feature (296)..(296): n is a, c, g, or t
  modified_base (469)..(469): a, c, t, g, unknown or other
  misc_feature (469)..(469): n is a, c, g, or t
  modified_base (509)..(509): a, c, t, g, unknown or other
  misc_feature (509)..(509): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaatggttccagcagaaacctggacaagcacccaggcactcatttanagtacaaacaacaaacactcctggacccctgcccgatctcaggctccctcttcgggggcaaagctgccctgacactgtctggtgtgcagcctgaggacgaggctgactattactgtcctactctacgtttggtggtgctgtgctagttcgggcggaggaccaagctgaccgtntaacgtcagccaaggctcgcccctgtctaccttcttcccncctcctccgtacg

SEQ ID NO: 133223 - DNA, 571 bp, Homo sapiens
  misc_feature: GYAE6OF01EKYOK.17.33.C11.1.454.CMB.1.raw
  modified_base (238)..(238): a, c, t, g, unknown or other
  misc_feature (238)..(238): n is a, c, g, or t
  modified_base (323)..(323): a, c, t, g, unknown or other
  misc_feature (323)..(323): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
tcagcgtagactagcacgaccggtgctcgatttagagtgagctcgttggggtttagggggcgtggcggccgaggggtcccttaccaatagtcagcaccatggcctggactcctctctttctcgttcctcctcacttgctgcccaggggtccaattctcagactgtggtgactcaggagccctcactgactgtgtcccaggagggacagtcactctcacctgtgcttccaacactggancagtcaccaagtagcttactatacctaaactcggttaccaggacacgaaaacctggaacaacgcacccgagggcactcatttaanagtacaaacaacaaacactccaggacccctgccccgtatctcaggtcctccctccgttgggggacaaaggctcgcccgtacgacactgtctggtgtgcagctgaggacgaggctagactatacgtgctactctacgtttggngtancgtagtgtcgtagtcggacggaggacgtaggcgtacgaccggtacgtaacgacaggccgaacggcctcgccccgtcggacaccgtcgtccgtccccgtcccg

SEQ ID NO: 133224 - DNA, 707 bp, Homo sapiens
  misc_feature: GYAE6OF01ES0FA.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgtcttaccaactacgtggacgcgacgtcaccgtagtcgtacttactactaacctaaacgttcggttaccgacgacaacgtaaaccgtggaacaacgaccaaccggacgggacctactactatttaagtaacgtaaacaaaacaaaccaaactaccttaccgtaccggtacccctcggacccgtacttcctacgacgtcctcccttcggttcggggacaaacgtcgtcgccctagacctacgtcgtcggttgggtgtcgacgacggtccgtaggaacgggacggacggtcgtacgtaacttacttacgtccgtaccttaccgttctttacggtttcgggtaggttcgtcgttgtcgtacgttacggttcggggacgggacgggtaacacggtcgtacggtacccgttagttacgtcaccggtacccgaacggtccctacccggtccccccgttacggtacccacgtttcccgttcccggtcccccgttcccccg

SEQ ID NO: 133225 - DNA, 558 bp, Homo sapiens
  misc_feature: GYAE6OF01CENP6.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactcctggacccctgcccgattctcacggcctccctccgttggggcaaagctgccctgacactgtctggtgtgcacgcctgaggacgaggctgactatactcgcctacttctactttggtgtgctgtgtcttagttcgggcggacgggaccaaggtcctcggtacccgtacttaacgtcacgcccgaacggccctcgccccccgttcggtacctaccgttccgttccgttccccggtccccc

SEQ ID NO: 133226 - DNA, 534 bp, Homo sapiens
  misc_feature: GYAE6OF01CRALE.17.33.C11.1.454.CMB.1.raw
  modified_base (465)..(465): a, c, t, g, unknown or other
  misc_feature (465)..(465): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattcctcaggcctccctccttgggggcaaacgctgccctgacactgtctggtgtgcagcctgaggacgaggctgactattactgcctactctactttggtgtgcttgtgctagttcggcggaggaccaagtcngaccgtcttaagcacgcccaagcctcgtccccctggtccacttctcgttccccgccctcccgttacccg

SEQ ID NO: 133227 - DNA, 544 bp, Homo sapiens
  misc_feature: GYAE6OF01AXPV0.17.33.C11.1.454.CMB.1.raw
  modified_base (433)..(433): a, c, t, g, unknown or other
  misc_feature (433)..(433): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctggacccctgcccgattctcaggctccctcgttggggcaaagctgccctgacactgtctggtgtgcagcctgaggacgaggctgactattactgcctactctactttggtggtnctgtgtctagttcggcggagggaccaaggctcgaccgttacttaacggtcacgcccgaaggcctcgaccccccgttcgggtaccaccttccttccgttcccccgtcccccg

SEQ ID NO: 133228 - DNA, 548 bp, Homo sapiens
  misc_feature: GYAE6OF01DTBR3.17.33.C11.1.454.CMB.1.raw
  modified_base (299)..(299): a, c, t, g, unknown or other
  misc_feature (299)..(299): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggacgcagtcaccagtgcttactatccaaactggtccagcagaaacctggacaagcaccagggcactcatttanagtaacaaacaacaaacactccgtacgacccctgcccgattctcacggtcctcccgtcgttggggacaaagcctcgccctgaactacgtgtcgtggtgtcgcgagcctagacggagagctgacttatactgccctactcttacgtttggtgtcgtctgtgtctagttcggcggacggacagcgtgaccgtataacgtcagcccaaggcctaccgcccccgtcggtacctactccgtccgtcccgtcccc

SEQ ID NO: 133229 - DNA, 532 bp, Homo sapiens
  misc_feature: GYAE6OF01CRVS6.17.33.C11.1.454.CMB.1.raw
  modified_base (520)..(520): a, c, t, g, unknown or other
  misc_feature (520)..(520): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcaccaggcactcatttatagtacaaacaacaaacactcctggacccctgccgatctcaggctcctcctggggacaaagctgcctgacactgtctggtgtgcagcctgaggacgaggctgactatactgcctactctacgtttggtggtgctgtgtctacgttcggcggacgggaccaagctcggtaccgtcgtaacgtcgacgccgaaggctcgcccccgtgtccgtactctcgttccccnccgtccctaccg

SEQ ID NO: 133230 - DNA, 621 bp, Homo sapiens
  misc_feature: GYAE6OF01AB484.17.33.C11.1.454.CMB.1.raw
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (447)..(447): a, c, t, g, unknown or other
  misc_feature (447)..(447): n is a, c, g, or t
tcagcgtagactagcacgaccggtgctcgatttagagtgagctcgttgggtttggggggcggccaggggtcccttccaatatcagcaccatggcctggactcctctcttctgttcctctcacttgctgccagggtccaattctcagactgtggtgactcaggagccctcactgactgtgtccccaggagggacagtcactctcgacctgtgcttccaacactggagcagtcaccagtgcttactntaccaaatggttccngcagaacctggacagcaccagggctactcatttanagtacaaacacaacacncctgacccctgcccgattctacacggctcccgtcgttcgggggcaaacgctacgccctagaaccnctcgtctggtgtcgtcagcctagaggacgngctagactattacncgccttactcttacgtttggtgtcgnttgtcgtcgttagttccgggtacgggacggaccgtaaggtccgtacggtccgttacgttaggttacccacgggtcccctaacggggtcccttcccggtacccccccggttgggtaccccttaaccgttcccgtttaacccggtttcccccctaccccgtttccccttaacccgg

SEQ ID NO: 133231 - DNA, 605 bp, Homo sapiens
  misc_feature: GYAE6OF01C1H2J.17.33.C11.1.454.CMB.1.raw
  modified_base (297)..(297): a, c, t, g, unknown or other
  misc_feature (297)..(297): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcaccaggcactcattanagtaacaaacaacaaacactacctcggacccctgccgatctcaggcctccctccgtggggacaaacgctcgcctgacacgtgtcgtggtgtgcagccgtggacggacgaggctagtactattactgtcctactcttacgtttggtgtgtctgtcgtacgttagttcgggcggtaacgggtaccgaaaggtcgtacggtacccgttacgttaacggtccgtacggaccccgtaacgggtcccgtcccggtccccccgttacgggttaccctaaccgtttcccgttcccggttccccccgttaccccccg

SEQ ID NO: 133232 - DNA, 559 bp, Homo sapiens
  misc_feature: GYAE6OF01B4OXI.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaaacctggacaagcacccaggcactcatttatagtacaaacaacaaacactcctgacccctgcccgatctcacggcctccctcgtcggggacaaagctacgccctgacactcgtctggtgtgcacgccgtggaggacgaggtcgtagacttattactcgccttactcttacgtttggtgtgtctgtgctagtcggtacggagggaccagctcgaccgttacgttagtaccacgacccgaaggcgtaccgcccccgtcggtacctacctcctccgttccccacccctcccttacccg

SEQ ID NO: 133233 - DNA, 585 bp, Homo sapiens
  misc_feature: GYAE6OF01C2SA6.17.33.C11.1.454.CMB.1.raw
  modified_base (327)..(327): a, c, t, g, unknown or other
  misc_feature (327)..(327): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccaggtccaattctcagactgtggtgactcaggagccctcactgactgtgtccccaggagggacagtcactctcacctgtgcttccaacactggagcagtcaccagtgcttactataccaaactggttccagacagaaacctggacaagcaccaggcactcattatagtacaaacaacaaacactcctcgacccncgcccgattctcaggcctccctccgttcggggcaaagctcgccctgaccactgtcgtggtgtgcacgctgaggacgaggctagactattactcgtcctactcgtttacgttggtggtgtcttagtgtacgttgttcgggacggacgggaccaaggtcgtacgaccgttacgttaacgtcgacggacccgaaaggtcccgttacccgccccccgttccgggtacctacccgttcccgttccgtttcccccggtcccccg

SEQ ID NO: 133234 - DNA, 512 bp, Homo sapiens
  misc_feature: GYAE6OF01BFRXT.17.33.C11.1.454.CMB.1.raw
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
  modified_base (463)..(463): a, c, t, g, unknown or other
  misc_feature (463)..(463): n is a, c, g, or t
  modified_base (501)..(501): a, c, t, g, unknown or other
  misc_feature (501)..(501): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaacaacaaacactcctggacccctgcccgattctcaggctccctccttggggcaaagctgcctgacactgtctggtgtgcagcctgaggacgaggctgactatactgcctactctactttggtgtgntgtgctagtcggnggaggacaagctcgaccgtntagtcagccagctcgcccctggtcctactctcgtcccnccctcctcccg

SEQ ID NO: 133235 - DNA, 529 bp, Homo sapiens
  misc_feature: GYAE6OF01BWTUC.17.33.C11.1.454.CMB.1.raw
  modified_base (340)..(340): a, c, t, g, unknown or other
  misc_feature (340)..(340): n is a, c, g, or t
  modified_base (441)..(441): a, c, t, g, unknown or other
  misc_feature (441)..(441): n is a, c, g, or t
tcagcgtagactagcacgaccggtgctcgatttagagtgagctcgttggggtttgggctggcgccagggtcccttccaatatcagcaccatggcctggactcctctctttctgttcctcctcacttgctgcccagggtccaattctcagactgtggtgactcaggagccctcaactgactgtcgtccccaggagggacagtcactctcacctgtgcttccaacactggagcagtcaccagtgcttactatccaaactggttccagcagaaacctggacaagcacccagggcactcatttatagtacaaacaacaaacactcctgacccctgcccgattcncagctccctcgttggggacaaagctcgccctgacactgtctggtgtagcagctgaggcgaggctgactatactgcctactcgtactttggtgtgctgtcgntagttcggcggacggaccaagctcgaccgtacttagtcgagacccgaaggctccgcccccgtcgtcctactcctcgttccccgtcccc

SEQ ID NO: 133236 - DNA, 529 bp, Homo sapiens
  misc_feature: GYAE6OF01EA624.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctcgacccctgcccgattctcacggcctccctctggggcaaagctgccctgacactgtctggtgtgcagccgtgaggacgaggctgactattactcgcctactccttacgtttggtggtgtcgtagtgcgttagttcgggcggaggaccaagctgaccgtgttaacgtcagcccgaggcctcgccccgtcgccactctcgtcccgtcccc

SEQ ID NO: 133237 - DNA, 535 bp, Homo sapiens
  misc_feature: GYAE6OF01E1CYY.17.33.C11.1.454.CMB.1.raw
  modified_base (297)..(297): a, c, t, g, unknown or other
  misc_feature (297)..(297): n is a, c, g, or t
  modified_base (523)..(523): a, c, t, g, unknown or other
  misc_feature (523)..(523): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctcggacccctgcccgattctcaggcctccctccgttgggggcaaagctgccctgacactgtctggtgtgcagcctgaggacgaggctagactattactcgaccttactcttacgtttggtggtgctgtgcttagtcgggcggacgggacaagctagaccgtcttagcacgcccaaggctcgccccctcggctactctcttccccnccctccgtaccg

SEQ ID NO: 133238 - DNA, 528 bp, Homo sapiens
  misc_feature: GYAE6OF01BHVIZ.17.33.C11.1.454.CMB.1.raw
  modified_base (443)..(443): a, c, t, g, unknown or other
  misc_feature (443)..(443): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctgacaagcaccaggcactcatttatagtacaaacaacaaacactcctcggacccctgcccgattcctcacggcctccctccgttcgggggacaaacgctcgccctgactactgtctggtgtgcagccgtggaggacgaggctagactattactgacctactctactttggngtgctgtgctagtcggcgaggacagctgacgtcgtaagcagcccgaaggcctcgccccttcggtcacctctcgttccccgtcccc

SEQ ID NO: 133239 - DNA, 556 bp, Homo sapiens
  misc_feature: GYAE6OF01B8UUK.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctgacaagcacccaggcactcatttatagtaacaaacaacaaacactcctggacccctgcccgattctcacggcctcccctccgttcgggggaccaaacgcctcgccctgacctactgtcctggtgtgcagcctgaggacgaggctgactatactgcctactcttactttggtgtgcgttgtgcgttagtcgggcggacgggaccaaggctcgaccgtacgttagcagacccgtaaggccttccgcccccgttcggtccacgttcccttcgttccccgtcccccg

SEQ ID NO: 133240 - DNA, 513 bp, Homo sapiens
  misc_feature: GYAE6OF01AB5EG.17.33.C11.1.454.CMB.1.raw
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaacaacaaacactcctcggacccctgcccgattctcacggctccctccttggggcaaagctcgccctgacactgtctggtgtgcagcctgaggacgaggctgactattactgcctactctactttggngtnctgtgctagtcggcggaggacagcngcgtntagcacgccagctcgccccgtcgccacgtctgtccccgcctccgtaccg

SEQ ID NO: 133241 - DNA, 584 bp, Homo sapiens
  misc_feature: GYAE6OF01DVV1C.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagccaccaggcactcatttatagtacaaacaacaaacactcctacggacccctgtccgtattctcaggcctcccgtccgttcggggacaaacgctcgcccgtgactactcgtcgtggtgtcgcacgccgtagaggacgaggtctagacttattactgtccttactcgttacgtttgggtggtgtctgtcgtcttagttcgggtacgggtaacgggaccaagtcgtcgtaccgttacttaacgtcacgcccgaaggccgtccgcccccgtcgacctacctcgtccgttcccctcccgttccctacccg

SEQ ID NO: 133242 - DNA, 516 bp, Homo sapiens
  misc_feature: GYAE6OF01BQ76Z.17.33.C11.1.454.CMB.1.raw
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
  modified_base (469)..(469): a, c, t, g, unknown or other
  misc_feature (469)..(469): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtncttactatccaaaactggttccagcaagaaacctggacaagcacccagggcactcaatttanatacaaacaaacaaacactctgacccctnccgattcncagctccctctggggcaaagctgccctgacactgctggngtgcagcctgaggacgaggctgactatacngcctatcgtatttggngtgcgtagtgcttagtcggcggaggacctaagctagacccgtntaaagtcagccaaggctccgccccctggccacgtctcgttcccaccc

SEQ ID NO: 133243 - DNA, 671 bp, Homo sapiens
  misc_feature: GYAE6OF01CARN3.17.33.C11.1.454.CMB.1.raw
tcagcgtagactagcacgaccggtgctcgatttagagtgagctcgttgggttggggggctggcgccaggggtcccttccaataatcgaggctaccattgggcctggactcctctctttctagttcctcctcgacttgcctgcccgagggttccgaattcgtcagtacgttcgttcggttgactctaaggaggtcctcactgactggtcgtcccaggagggacgtaggtcacgtcggtcgaccgtggtcgcttccaacgacgtcggagcacgtccaccagtcgcttacgtactcctaaaacgtggtttccaacgtcaacgtaaaccttggacaacgcaccgagggctacgtccatttagtacgtacaaacgaacaaaacgctacgtcggacccgtgccgattctacaggtctccgtcgttggggactaaagtactcgtccgtgacacgtcgtcgtgggtacggtcgactacgacctgacggtacgaacgggctagtaaccttataacgtacgaccttactcttacgtttggtggtactacgtagtacgtacgttacgttcgggacggacgggaccaacggtccgtacggtaccgttagttaacgtcgtaacgtccgtaagggccgtacggcccctacggttacctacgttccgtccgttaccccgtaccccg

SEQ ID NO: 133244 - DNA, 551 bp, Homo sapiens
  misc_feature: GYAE6OF01AP1AV.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcacccaggcactcatttatagtaacaaacaacaaacactcctacggacccctgcccgattctcacggcctccctcgttcggggacaaacgctcgccctgacactgtctggtgtcgcgacgccgtagacggacgaggctagactattactcgtcctactcttacgtttggtgtgtctgtgtcgtagtcggcggacggaccagctacgaccgttacgtaacgtcgacgaccgagcctcgtcccccgtcggtccacgtccttcgtcccgtccccg

SEQ ID NO: 133245 - DNA, 598 bp, Homo sapiens
  misc_feature: GYAE6OF01CFPD5.17.33.C11.1.454.CMB.1.raw
  modified_base (291)..(291): a, c, t, g, unknown or other
  misc_feature (291)..(291): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcacncatttatagtacaaacaacaaacactcctggacccctgcccgattctcagcctccctccgttgggggcaaagctcgccctgacactgtctggtgtgcagcctggacggacgaggctagactattactcgccttactccttacgtttgggtggtgtctgtcgtcttacgttcgggcgggtacgggacctaaggcctacggtacccgttacttaacggtaccgacgtaccccgaagggcccgtccggccccccgttacggtccctaacttcccgtccggtttccccccgtcccgttccccttaccccgg

SEQ ID NO: 133246 - DNA, 532 bp, Homo sapiens
  misc_feature: GYAE6OF01CAOQE.17.33.C11.1.454.CMB.1.raw
  modified_base (373)..(373): a, c, t, g, unknown or other
  misc_feature (373)..(373): n is a, c, g, or t
  modified_base (478)..(478): a, c, t, g, unknown or other
  misc_feature (478)..(478): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctccctcctggggcaaagctcgccctgacnctcgtctggtgtgcacgccgtgaggacgaggctgactattactgcctactcttactttggtgtgcgtgtgtctagttcggcggacgggaccaacgctcgaccgtnttaacgtcagcccaggcctcgcccccgtcggtccactcctcgttcccctacccg

SEQ ID NO: 133247 - DNA, 625 bp, Homo sapiens
  misc_feature: GYAE6OF01BAZR6.17.33.C11.1.454.CMB.1.raw
  modified_base (299)..(299): a, c, t, g, unknown or other
  misc_feature (299)..(299): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgcttcaacactggagcagtcacagtgcttactatccaaactggttccagcagaaacctggacaagccaccgaggcactcaatttanaacgtaacaaacaaacaaactactacctacggacccctcgaccgtaacttcctcgacgcctacccgtcgttacggggacaaacgctacgccctagacactcgtctggtgtgacgagtccgtacggaggacgaggactacgtactacttacgtcgtacctacgttacgttacgtttgggtcgttacgtcgttaggttcgtacgttacggttcgggaccggtaacgggaccgtaagtccgtacggtaccgttaacgttaacgtccgtacgacccggaagtccgtcccgtaccccgttcgtacctaccgttcctcccgtcccctacccc

SEQ ID NO: 133248 - DNA, 529 bp, Homo sapiens
  misc_feature: GYAE6OF01EWC8O.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctgactattactgcctactctactttggtggtgtctgtgcttagttcgggcggacgggaccaagctgaccgttcttaagtccagacccaaggcctcgcccccgtcggtcacctctcgtccccgtcccc

SEQ ID NO: 133249 - DNA, 596 bp, Homo sapiens
  misc_feature: GYAE6OF01D0NW3.17.33.C11.1.454.CMB.1.raw
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggaacaagcacccaggcactcattatagtacaaacaacaaacactcncgaccctgccgatcncagcctcctcgtggggacaaagctcgccctgacactgtcgtggtgtgcacgcctgaggcggaggcgtagtactacttactcgtcctacttcttacgtttggttgtgtcttgttgcgttacgttcgggacgggacgggaccaaggccgtacggtacccggttacttaaacggcctacggaccccgtaaacgggtcccgttcccgccccccgttacgggtaccctacccgtttcccgttcccggttccccccggtaccccccg

SEQ ID NO: 133250 - DNA, 589 bp, Homo sapiens
  misc_feature: GYAE6OF01C06FO.17.33.C11.1.454.CMB.1.raw
  modified_base (301)..(301): a, c, t, g, unknown or other
  misc_feature (301)..(301): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttaccagcagaaacctggacaagcaccagggcactcatttanagtaacaaacaacaaacactcctacggacccctgacccgtattctaccaggcctcccttccgttcgggggcaaacgctcgccctgacactgtctggtgtgcagcctaggaggacggaggctagacttacttactcgtcctacttcttacgtttggtggttgcttgtgtcttagtcggcgggacgggaccaaggtcctacgtacccgttacttaaggtcccaagtacccgaaggtccgtccgtcccccgtcggtaccctcttacccgttccggttcccccgtccccccg

SEQ ID NO: 133251 - DNA, 710 bp, Homo sapiens
  misc_feature: GYAE6OF01B81RO.17.33.C11.1.454.CMB.1.raw
  modified_base (314)..(314): a, c, t, g, unknown or other
  misc_feature (314)..(314): n is a, c, g, or t
tcagcgtagactagcacgaccggtgctcgatttagagtgagctcgttgggtttgggggcgccaggggtcccttccaatatcagcaccatggcctggactcctctctttctgttcctctcacttgctgcccagggtccaattctcagactgtggtgactcaggagccctcactgactgtcgtcccaggagggacagtcactctcacctgtcgcttccaacactggagcagtcaccagtgacttactactaccaaacttcggttaccagacaacgaaaacctggaacaacgccaaccgaggacactactaatttanaacgtaacaaaacaaacaaacacctaccgtacggacccctgacccgtatctacgacgtcctccgtacggttacggggacaaacgctcgacctagacacgtgtcgtggtgtcgacgacgtccgtaggaacggacggtacggtctagtaaccttaactttaccggtacgtaccctttaacgttaccgtttacggttttgggtacggtcggttccgttgggttacgtaccggtttacgggttaccggggaccgggaaccgggtaaccgtaacggtcgttaccggtaaccgtttaccgttaaacgtaccgaccggacccggtaacggcccgttcccgcccccggttacggtacccttaccgttaccgttcccgttccccggtcccccttccgttaacccg

SEQ ID NO: 133252 - DNA, 609 bp, Homo sapiens
  misc_feature: GYAE6OF01DAXVW.17.33.C11.1.454.CMB.1.raw
tcagcgtagactagcacgaccggtgctcgatttagagtgagctcgttgggtttggggctggcgccaggggtcccttccaatatcagcaccatggcctggactcctctcttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcattatagtacaaacaacaaacactcctggacccctgcccgatctcagcctcctccgttggggcaaagctgccctgacactgtctggtgtgcacgcctgacggacgagcgtagactattactcgacctacttcttacgtttggtggttgcttggttagtcgttaagttccggggaccgggtaacgggtaacccgaaaggtccgtacgtaaccccggtttcgttaaacggtccgtaacggaccccgtaaacgggtcccgttccggacccccccgttcgggtaccctacccgtttccctccggtttcccccctaccccccg

SEQ ID NO: 133253 - DNA, 549 bp, Homo sapiens
  misc_feature: GYAE6OF01CWJKT.17.33.C11.1.454.CMB.1.raw
  modified_base (222)..(222): a, c, t, g, unknown or other
  misc_feature (222)..(222): n is a, c, g, or t
  modified_base (343)..(343): a, c, t, g, unknown or other
  misc_feature (343)..(343): n is a, c, g, or t
  modified_base (370)..(370): a, c, t, g, unknown or other
  misc_feature (370)..(370): n is a, c, g, or t
tcagcgtagactagcacgaccggtgctcgatttagagtgagctcgttgggtttgggggctggcgccaggggtcccttcaatatcagcaccatggcctaggactcctctctttctgttcctcctcacttgctgcccagggtccaattctcgagactgtggtgactcagggagccctcacgtgactgtgtccccaagggcggggacagtccactctcacctgtncttccaactctggagcagtccaccagtgcttacgatccaaactggttccagcagaaaccgtggacaagcaccaggcactcattatagtacaacaacaacactacctgaccctgccgactcncacgctcctcctgggacaagctcgccncgacactgtctcggtcgtgcacgcgtagacggacgaggcgtgactatactcgccgtactcttacttggtgtgctgtcgcgttgttcggcggacgggacgtaagtcgtacgaccgtcttaacgtccacgtacccgacggtcctcgccccgttcgactaccgtcgttccgtcccgtccccg

SEQ ID NO: 133254 - DNA, 580 bp, Homo sapiens
  misc_feature: GYAE6OF01AHMIP.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcacccaggcactcattatagtacaaacaacaaacactcctcgacccctgcccgattctcagctccctccgtggggcaaagctgccctgacactgtctggtcgtgcagcctggacggacgaggctgactattactgcctactcttacgtttggtcgtgctgtcgcgttagttcgggcggagggaccaaggtctacggtaccgttacgttaaacgtccgacggccccgaaagggtcccttacccggtcccccccgttcgggttacccaccgtttcccgttccgtttccccccgtaaccccccg

SEQ ID NO: 133255 - DNA, 597 bp, Homo sapiens
  misc_feature: GYAE6OF01DAFSA.17.33.C11.1.454.CMB.1.raw
  modified_base (337)..(337): a, c, t, g, unknown or other
  misc_feature (337)..(337): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccaggcactcatttatagtacaaacaacaaacactcctgacccctgcccgattcncagcctccctcttggggcaaagctgccctgacactgtctggtgtgcagtcccgtggacgggacgggcgtagtacgtacttacttcgtccgtaccttccttacgttttacggttcggttcggttcgtgttcggtcgttagttcggtcgggacgggaccggacgacgtcgtaccggtaccgttacgttacgcgtaccgaccggacgtccgtcccccgcccgttccgtacctacccgttccgttccccgttccccgtaccccg

SEQ ID NO: 133256 - DNA, 616 bp, Homo sapiens
  misc_feature: GYAE6OF01C0L3B.17.33.C11.1.454.CMB.1.raw
  modified_base (247)..(247): a, c, t, g, unknown or other
  misc_feature (247)..(247): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactanccaaactggttccagcagaaacctggacaagcaccaggcactcatttatagtacaaacaacaaacactcctggaccctcgccgattctcagctccctcgtggggcaaagctcgccctgactactgtctggtgtgctagcctgaggacgaggctgactatactgtcctatctacttggtgtgcctgtgtctacgttcgggcgggtaacgggaccgaaaggccgtacggaaccgttacgttaaacggttaccgaaccggtaccccgaaagggtcccgttcccgggtaccccccccgttccgggttcccctaaacccgttcccgtttaccggtttcccccccggttccccgttccccccgttttaaccccgg

SEQ ID NO: 133257 - DNA, 578 bp, Homo sapiens
  misc_feature: GYAE6OF01BE170.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtaacaaacaaacaaacactcctacggacccctgccccgtaattctcacggcctccctccgttcggggacaaacgctgccctgactacgtgtcgtggtgtgcacgccgtgaggacgaggctgactatactgcctactcttacgtttggtggtgtctgtgcttagttcgggacgggacgggaccaacgtcgtacgtacccgttagttaacgtctagaccccgtaaggcccgtaccggtcccccgtcggtcctaccgtccgttccgttccccgtccccccg

SEQ ID NO: 133258 - DNA, 649 bp, Homo sapiens
  misc_feature: GYAE6OF01CUEKB.17.33.C11.1.454.CMB.1.raw
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttaccacactggagcagtcaccagtgcttactataccaaactgttccagcagaactgacaagcaccgaggcactctattanagtaacaacaaacaacactacncggaccctcgccgactcacacgcctccgtacgtaggggacaaacgctacgccctagactacgtgtctggtgtgcagcctagacggacgagacgtagacttacgtctagcctacttacttacgtttggtaggtcgtacgttgtcggtacgttacggttccgggacgggaaccgggtaccgtaacggtaccgtaacgggtacccgttaacgttaaccgggttaccgaaccggtaccccggaacgggtaccccgttaccccgggtaccccccggttacccgggttacctaacccggtttcccgtaccccggtttaccccccgttaaccccccgg

SEQ ID NO: 133259 - DNA, 708 bp, Homo sapiens
  misc_feature: GYAE6OF01ADDH8.17.33.C11.1.454.CMB.1.raw
  modified_base (234)..(234): a, c, t, g, unknown or other
  misc_feature (234)..(234): n is a, c, g, or t
  modified_base (312)..(312): a, c, t, g, unknown or other
  misc_feature (312)..(312): n is a, c, g, or t
tcagcgtagactagcacgaccggtgctcgatttagagtgagctcgttgggtttggggggtcggccgaggggtcccgttccgaactatcagcaccatggcctggactcctctcttctgttcctcctctacttgctgccacggtcaattctcagactgtggtgactcaggacgccctcactgactgtgtccccagggagggacagcactctcacctgtgccttaccaacactggancagtcaccagtgcttactatccaaacgtggttccagcaacgaaaccgtggaacagaccaccgaggcactcacttttanacgacaaaacgaacaacactccgtcggaccccctgaccccgtattccgtacgacgaccttccccttcgggtacgggggtacaaacgtcctcggaccccttagaacctaccggtttacgcgtttcgggttgacggtccgacgtccgttacggaggaccggtacggacgtacgtacgttaacgttaccgtcgttcccttaacgttccgtttacgtttcggttaggttcgcgtttacgtcgttacgtagttccggggtacgggtacgggtaccgtaggtaccgtacggttaaccggttccgttaaacgtccgtaacggtcccgaagggttccctaccggttccccccgtacggttcccttacgttcccttaccggttccccgtccccgttccgtacccg

SEQ ID NO: 133260 - DNA, 527 bp, Homo sapiens
  misc_feature: GYAE6OF01E2XIS.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaacaacaaacactcctggacccctgcccgattctcaggcctccctccttggggcaaagctgccctgacactgtctggtgtgcagcctgaggacgaggctgactattactgcctactctactttggtgtgcgtgtgctagttcggcggagggaccaagcgtgaccgtcttaagcacgcccaaggcctcgcccctcgtcactcctcgttccccaccctcctacccg

SEQ ID NO: 133261 - DNA, 535 bp, Homo sapiens
  misc_feature: GYAE6OF01ETZBM.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggcctccctccttggggcaaagctcgccctgacactgtctggtgtgcagcctgaggacgagctgactattactgcctactctacgtttggtggtgtctgtgctagttcggcggagggaccaagctcgaccgtacgttaagtcagcccgaaggcctacgccccctcggtccacctccgttcgtcccctaccccc

SEQ ID NO: 133262 - DNA, 566 bp, Homo sapiens
  misc_feature: GYAE6OF01AGKFQ.17.33.C11.1.454.CMB.1.raw
  modified_base (296)..(296): a, c, t, g, unknown or other
  misc_feature (296)..(296): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctcggacccctcgcccgattctcaggcctccctccgttggggcaaagctcgccctgacactgtctggtgtgcagctggaggacgaggctgtacttattactgccttactcttacgtttggtggtgtctgtgtcttagttcgggcggagggaccaagcgtacgaccgttcttaagtcacgcccgaaggcctcggcccccgttcgggtccctacgttcccttaccggttcccccgtccccgttccgttcccg

SEQ ID NO: 133263 - DNA, 580 bp, Homo sapiens
  misc_feature: GYAE6OF01AKH3B.17.33.C11.1.454.CMB.1.raw
  modified_base (402)..(402): a, c, t, g, unknown or other
  misc_feature (402)..(402): n is a, c, g, or t
  modified_base (542)..(542): a, c, t, g, unknown or other
  misc_feature (542)..(542): n is a, c, g, or t
tcagcgtagactagcacgaccggtgctcgatttagagtgagctcgttgggtttggggggcgccaggggtcccttccaatatcagcaccatggcctgtactcctctctttctgttcctcctcacttgctgcccagggtccaattctcagactgtggtgactcaggagccctcactgactgtgtccccaggagggacagtcactctcacctgtgccttccaacactggagcagtcaccagtgcttactataccaaactggttccagcagaaacctggacaagcaccaggcactcatttatagtacaaacaacaacactcctaggacccctgcccgattctcacgctcctccgtggggcaaagctcgcctgacactgtctggtgtcgcagcctggaggacgaggntcgactactactcgtaccttatccttacgtttggtggttcgctgtcgcttagtccgggtacggacgggacctaaggtctacggtacccgtagttaacgacgaccgtcccaaggtcccgtccgtcccccgtccggttaccnccttccttcccgttcccctaccccgttcccttaccccg

SEQ ID NO: 133264 - DNA, 561 bp, Homo sapiens
  misc_feature: GYAE6OF01EM0DW.17.33.C11.1.454.CMB.1.raw
  modified_base (298)..(298): a, c, t, g, unknown or other
  misc_feature (298)..(298): n is a, c, g, or t
  modified_base (386)..(386): a, c, t, g, unknown or other
  misc_feature (386)..(386): n is a, c, g, or t
  modified_base (445)..(445): a, c, t, g, unknown or other
  misc_feature (445)..(445): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacactggagcagtcaccagtgcttactataccaaactggttccagcagaaacctggacaagcaccaggcactcatttanagtaacaaacaacaacactcctcgacccctgcccgattcctcacgctccctcgttcggggacaagctcgcctgactactgtctggtgngcagtccgtggaggacgaggctgactattacctgtccttactcgttacgtttggtggtntcgtgtgtcgtagttcgggtcggacggaccagcgtcgtaccgtcttacgtcgacgcccgtaaggcctccgccccgtcgtcctaccttcttccgttcccctacccttcccgtacccg

SEQ ID NO: 133265 - DNA, 536 bp, Homo sapiens
  misc_feature: GYAE6OF01DW8YE.17.33.C11.1.454.CMB.1.raw
  modified_base (409)..(409): a, c, t, g, unknown or other
  misc_feature (409)..(409): n is a, c, g, or t
  modified_base (452)..(452): a, c, t, g, unknown or other
  misc_feature (452)..(452): n is a, c, g, or t
  modified_base (461)..(461): a, c, t, g, unknown or other
  misc_feature (461)..(461): n is a, c, g, or t
  modified_base (483)..(483): a, c, t, g, unknown or other
  misc_feature (483)..(483): n is a, c, g, or t
  modified_base (518)..(518): a, c, t, g, unknown or other
  misc_feature (518)..(518): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactatccaaactggttccagcagaaacctggacaagcacccagggcactcaatttatagtaacaaaacaacaaacactcctcggaacccctgcccgattctcaggcctccctcgttggggcaaagctgccctgacactgtctggtgtgcagcctagacggacgngggctgacttattactgtcctactcttacttggtgtgctgtgnttgttcggnggacggacgaagcgtgaccgtnttaagtcacgccgaaggcctcgcccccgtcgtacnctctcgttcccctacccc

SEQ ID NO: 133266 - DNA, 590 bp, Homo sapiens
  misc_feature: GYAE6OF01D6H8U.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcaccaggcactcatttatagtaacaaacaacaaacactcctcggacccctgcccgattctcaggcctccctcgttcgggggcaaagctcgccctgacactgtctggtgtgcagccgtggaggacgacggctcggacttagttacctgtaccctactcgttacgtttggtgttcgtcttgtgtctagttcggcgggtaaggaccaaggctacggaccgttacgttaacgtcaacggtcccgaaggcccgtccgccccccgtcgggttacccaccgttcccgttacgttcccccgtcccttccccgttacccg

SEQ ID NO: 133267 - DNA, 515 bp, Homo sapiens
  misc_feature: GYAE6OF01E0QSY.17.33.C11.1.454.CMB.1.raw
  modified_base (505)..(505): a, c, t, g, unknown or other
  misc_feature (505)..(505): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctagttcggcggaggacaagctgacgtcttaagcacgccgaagctcgcccctgtcctactctcgtcccncctcctcccg

SEQ ID NO: 133268 - DNA, 635 bp, Homo sapiens
  misc_feature: GYAE6OF01D2HCI.17.33.C11.1.454.CMB.1.raw
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactgttccagcagaaacctgacaagcaccaggcactcatttanagtacaaacaacaaacactccncgaccctgcccgattcncaggcctcctccgtgggggacaaacgctcgcctcgacactcgtcgtggtgtgcagccgtggacggacggaggtctgacttaattacgtcgtccttactcctttacgtttcgggtggttgtcttggtcgtcttacggttccgggtacggggaacgggtaccaaggtccgtacggtaccccgttacgttaaacggtccgtaacggaccccgtaagggtcccgtacccgggtccccccgttacgggtacccctaccgttcccgttacccggtttcccccccgtccccgttcccctttaccccggg

SEQ ID NO: 133269 - DNA, 708 bp, Homo sapiens
  misc_feature: GYAE6OF01CLC7N.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactatccaaactggttaccagcagaaacctggaacaagccaccgagggcactcattatagtaacaaacaacaaacactacctacgacccctgacccgtatctcacgcctcctccgttcggggacaacgctcgcctcgacactgtctggtgtcgcgcgtccgtggacggtacgaggtctagtacttacgtaacgtcgtacctacttcgtttacgttttcgggtacggttgtccgttggttcggtaccgtttacggtttaccggggaccggggtaacggggtaacccgtaaacggttcccggttacggttaaccccgggttacgtttaaaccgggtcccgtaaacccgggtaacccccggaaaccgggttcccgttaccccgggttaccccccccgtttaccggggttaccccttacccggtttaccccgtttccccggttttccccccccgttaaccccccccg

SEQ ID NO: 133270 - DNA, 668 bp, Homo sapiens
  misc_feature: GYAE6OF01D3LK5.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttccaacacgtggagcagtcaccagtgcttactatccaaactggttccagcaagaaacctggacaagccaccgagggcactctatttataagtaacaaaacaacaaacactacctacggacccctcgaccgattcctcgacggcctcccgtcgttcggggacaaacgcctacgccctacgacctacgtcgtcgtggtcgtcgcgtacgccgtaggacggacggaggtactggtaacttacgttacgtcgtacccttacgttacctttacgtttcgggttcggtggtcgttggtcgtacgttacgttccgggacgggtacgggtaacccgtaaggtccgtacgtacccggttacgttaacggtccgtaacggaccccggtaaacggtcccgttccccggacccccggttccggtacctacccgtttcccgttcccggttccccccgttcccccg

SEQ ID NO: 133271 - DNA, 638 bp, Homo sapiens
  misc_feature: GYAE6OF01EBNDU.17.33.C11.1.454.CMB.1.raw
  modified_base (340)..(340): a, c, t, g, unknown or other
  misc_feature (340)..(340): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggaacaagcaccaggcactcatttatagtacaaacaacaaacactcctcgacccctgcccgattcncacggcctcccgtcgttggggcaaacgctcgccctgacactgtcgtggtcgtgcagcctgacggacgaggctagaccttagttactcgtacctactccgttacgttttggtggttcgtcttggtcgtccgttaggttcgggaccggggaacgggaaccgaacggtccgttaccggtaaccggtttaccgtttaaacggtccgtaaacccggaccccggtaaacggcccgttacccggcccccccgttacgggttacccctaccgtttcccgtttccggttcccccccgttaccccccg

SEQ ID NO: 133272 - DNA, 660 bp, Homo sapiens
  misc_feature: GYAE6OF01EO8T9.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcaccaggcactcatttatagtacaaacaacaaacactcctcgacccctgcccgattctcacggcctccctccgttcgggggacaaacgcgtcgccctgacactgtctggtgtcgcagcctgaggcgaggctgacttattactcgtacctacttccttacgtttgggtggttcgtcgttgtcgtacgttaacggtttcggggaccgggtaacggggaacccgtaaggccgttacggtacccggtttaaccgtttaaacggtaccgaaccgggtacccccgaaagggtccccgttccccggcccccccggtttaccggttaccccgtaacccgtttcccgttcccgggtttcccccccgtcccccgttcccccgtttacccccgg

SEQ ID NO: 133273 - DNA, 541 bp, Homo sapiens
  misc_feature: GYAE6OF01A3XP3.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcagaaacctggacaagcaccaggcactcatttatagtacaaacaacaaacactcctggacccctgcccgattctcacgctccctccgttggggcaaagctcgcctgacactgtcgtggtgtgcagcctggacggacgaggctgactattactgtcctactcttacgtttggtgtgctgtgctagttcgggcggtacgggacaagtctagaccgttctaacgtcgacgcccgaaggcctcgcccccgtgtccacttctcgttcccctaccctccgtaccc

SEQ ID NO: 133274 - DNA, 567 bp, Homo sapiens
  misc_feature: GYAE6OF01CK9A7.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaaacaaacaaacactcctacggacccctgacccgattcctcacggtcctcccctccgttcgggggacaaaacgcctcgccctgactactcgtcgtggtgtgcagcctgacggacgaggctgactattactcgtaccttactctacgtttggtcggttgcttgtgtcttagttcgggcggaggaccaagctcgtaccgtcttacgtcgacgccgaaggctccgccccgtggtcctaccttccgtaccgttccccgccctccttcccg

SEQ ID NO: 133275 - DNA, 595 bp, Homo sapiens
  misc_feature: GYAE6OF01BILQH.17.33.C11.1.454.CMB.1.raw
  modified_base (299)..(299): a, c, t, g, unknown or other
  misc_feature (299)..(299): n is a, c, g, or t
  modified_base (439)..(439): a, c, t, g, unknown or other
  misc_feature (439)..(439): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgttcccaggagggacagtcactctcacctgtgcttccaacactggagcagtcaccagtgcttactatccaaactggttccagcagaaacctggacaagcacccaggcactcatttanagtacaaacaacaaacactcctacggacccctgcccgattctcacggcctccctcgttggggcaaagctgccctgacactgtctggtgtgcagccgtgacggacgaggctagactattactgcctactcttacgtttggngtcgcttgtcgtctagttcgggacggacgggtaccaaggtcctcggtaccgttactttaaacggtcctaaccggaccccgaaagggtccctcccgggtacccccccgttcgggtaccctaaccgtttcccgttccggtttccccccggtacccccc

SEQ ID NO: 133276 - DNA, 547 bp, Homo sapiens
  misc_feature: GYAE6OF01A5R8V.17.33.C11.1.454.CMB.1.raw
  modified_base (486)..(486): a, c, t, g, unknown or other
  misc_feature (486)..(486): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactcctgacccctgcccgattctcagcctccctccgttggggcaaagctgccctgacactgtctggtgtgcagcctggacggacgaggctgactattactcgtacctactcttacgtttggtggtgtctgtgtcgttagttcgggcggagggaccaaggctacgaccgtnttaagtcgagacccgaggcctccggccccctcggtaccacctcgttccgttccccgtcccc

SEQ ID NO: 133277 - DNA, 565 bp, Homo sapiens
  misc_feature: GYAE6OF01DYYV8.17.33.C11.1.454.CMB.1.raw
  modified_base (340)..(340): a, c, t, g, unknown or other
  misc_feature (340)..(340): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcaagaaacctggaacaagcacccagggcactcatttatagtacaaacaacaaacactcctcgaccctgccgatcncacgctcctcgtgggcaagctcgcctgactactgtctggtgtgcagccgtgacggacgaggctagactattactcgccttacttcttacgttttgggtgtcgtcgttggtgtcttagttcgggacgggtacgggaccgaagcgtacgtaccgtagttaacgtcgagaccctaggccctccggcccccgttcggtcctaccttcccgttccgttcccctacccccg

SEQ ID NO: 133278 - DNA, 621 bp, Homo sapiens
  misc_feature: GYAE6OF01EZTUJ.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactataccaaactggttccagcagaaacctggacaagcaccaggcactcatttatagtaacaaacaacaaacactcctcgacccctgcccgattctcacgcctcccgtccgttggggacaaagctcgccctgactactgtcgtggtgtcgcagccgtgaggacgaggctagactattactcgtccttacttcgttacgtttggtcggtcgtcttggtcgtcttacggttcgggacgggacgggaccgaaggtccgtacggtaccgttacgttaacggtaccgaacggaccccgtaaggcccttcccggtcccccgttcgggtaccctacccgttcccgttacccggtttccccccgtccccgttccccgttaccccgg

SEQ ID NO: 133279 - DNA, 548 bp, Homo sapiens
  misc_feature: GYAE6OF01BJ108.17.33.C11.1.454.CMB.1.raw
  modified_base (432)..(432): a, c, t, g, unknown or other
  misc_feature (432)..(432): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaatggttccagcagaaacctggacaagcacccaggcactcatttatagtacaaacaacaaacactcctgacccctgcccgattctcaggcctccctccgttggggcaaacgctgccctgacactgtctggtgtgcagcctgaggacgaggctgactatactgcctactctacgtttgtggtncgtgtgtcttagttccgggcggacgggaccaagctggtaccgttacgttaacgtcgacgcccgaaggcctcgcccccgtggtcctacttcctccgttcccacccctccgttacccg

SEQ ID NO: 133280 - DNA, 532 bp, Homo sapiens
  misc_feature: GYAE6OF01BUR9V.17.33.C11.1.454.CMB.1.raw
  modified_base (522)..(522): a, c, t, g, unknown or other
  misc_feature (522)..(522): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcaccaggcactcatttatagtacaaacaacaaacactcctggacccctgcccgattcctcacggcctccctccgttggggacaaagctgccctgacactgtctggtgtgcagctgaggacgaggctgactatactgcctactcgttactttgggtggtgcgttgtgtcttgtcgggcggaggaccaagctgaccgtcttaagtcacgcccgaagcctcgcccccgtcgtcctactctccgttcccncctccctccg

SEQ ID NO: 133281 - DNA, 658 bp, Homo sapiens
  misc_feature: GYAE6OF01B15SX.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaacctggacaagcaccaggcactcattatagtaacaacaacaaacactcctacggacccctgacccgtattctacacggtcctcccgtccgttcggggacaaacgctacgccctgacctactcgtctacggtgtcgcagtccgtaggacggacgaggctgacttacgttacgtcgaccttacgttcgttaacgtttgggtcggtacgtcgttaggtcgtacgttaacggttccgggacgggtaacgggtaccgtaaacggtccgttacggtaacccggttacgttaaacggtccgtaacggaccccggtaaacgggtccccgttaccggtacccccccggttacggttacccgtaaccgttcccgtttccggttaaccccggttccccccgg

SEQ ID NO: 133282 - DNA, 570 bp, Homo sapiens
  misc_feature: GYAE6OF01BLUPV.17.33.C11.1.454.CMB.1.raw
tcagcgtagactagcacgaccggtgctcgatttagagtgagctcgttggggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtaacaaacaaacaaacactcctacggacccctcgcccgtattctcacggcctccctccgttggggacaaacgctcgcctgactactgtcgtggtgtgcacgcgtgaggacgaggctagacttatacgtcgccttactcgttacgtttggtgtgtcgtgtgtcgttagtcgggcgggacggacagcgtacgaccgttactagtcacgcccgaaggtcctccgtcccccgtcggtcctaccttcgtacccgttccccgcccttcccgtacccg

SEQ ID NO: 133283 - DNA, 774 bp, Homo sapiens
  misc_feature: GYAE6OF01CFN3E.17.33.C11.1.454.CMB.1.raw
tcagcgtagactagcacgaccggtgctcgatttagagtgagctcggtttggggtttggggctggcgccgaggggtcccttccaatatcagcaccatggcctggactcctctctttctgttcctcctcacttgctcgcccgagggtccaattctcagactggtggtgactcgaggacgccctcactgactgtcgtccccgagggagggacagtcactctcaccttgtcgtccttaccaaacacgtgggagccaacggtaccaacccgtaggttcgtacctttaacctaacttaaccctaaaaccgttcgggtttacccaacgaccaaacggtaaaacccgtggaaaccgaaaacggacccaaaccccggaacggggacctaaccttaccttaaatttttaaacgtaaacgttaaaaaccaaaaaccaaaacctaaaaccacccttacccgtacccgggaacccccttccggaccccgtacttccgaccgtacggtccccgttccccgttccgggttacgggggaacctaaacggtcctaccggccctagacctaacgttcgtcgtgggtcgtgaccgacggtccgtaggaacgggagtacggtctacgtacttactacgtcgtaccttacttctttacggtttggtgtgtcgtgttcgtacgttggtcggacggacgggaccaagcctacgtaccgttagtacgcacggacccgtaggccctccccggtccccgttcggtacctacccttccgttcccgttcccccgtacccccg

SEQ ID NO: 133284 - DNA, 600 bp, Homo sapiens
  misc_feature: GYAE6OF01CZ52Z.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctcggacccctgcccgattctcacggcctccctccgttcgggggacaaacgctcgcccctgaccactcgtctggtgtgcagcctgaggacgaggctgactatactgcctactcttacgtttggtgtgtcgtgtgtcgttacgttcgggacgggacgggaccctaaggccgtacggacccgttcgttaaacggtccgtaacggtaccccgaaacgggtcccgtaccggcccccccgttacggtccctaccgtttcccgttcccgtttcccccctaccccccg

SEQ ID NO: 133285 - DNA, 545 bp, Homo sapiens
  misc_feature: GYAE6OF01BNFRC.17.33.C11.1.454.CMB.1.raw
  modified_base (300)..(300): a, c, t, g, unknown or other
  misc_feature (300)..(300): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacactggagcagtcaccagtgcttactatccaaactggttccagcagaaacctggacaagcacccaggcactcatttanagtacaaacaacaaacactcctgaccctgcccgattctcaggcctccctcgttggggacaaagctacgccctgacactcgtctggtagtcgcacgcgtggaggacgaggctgactattactcgcctactctacgttggtgtgctgtgtctagttcggcggacggaccaaggctgaccgttcgttaagtcgacgcccgaaggcctccgcccccgtcggtaccaccgtccttccgtcccctaccccg

SEQ ID NO: 133286 - DNA, 617 bp, Homo sapiens
  misc_feature: GYAE6OF01BT50I.17.33.C11.1.454.CMB.1.raw
  modified_base (233)..(233): a, c, t, g, unknown or other
  misc_feature (233)..(233): n is a, c, g, or t
  modified_base (481)..(481): a, c, t, g, unknown or other
  misc_feature (481)..(481): n is a, c, g, or t
tcagcgtagactagcacgaccggtgctcgatttagagtgagctcgttgggtttggggctgggcgccaggggtcccttccaatatcagcaccatggcctggactcctctctttctgttcctcctcacttgctgcccagggtccaattctcagactgtggtgactcaggagccctcactgactgtcgtccccaggagggacagtcactcgtcacctgtgcttccaacactggacncagtcaccagtgcttactactccaaactcggttccagcaagaaacctggacaagcacccgaggcactcatttatagtacaaacaacaaacactcctacggacccctgcccgattcctcgacgcctacccgtcgttggggacaaagccgtacgccctagacacgttcgtacgtggtcgtcgcgacgcctaggacgggacgtacggctacgactagttactcgtcccttacgtcttacgtttggtggtcncgttgtgtacgttagttcgggacggtacgggacctacgtcgtacgtaccggttacgttaacgccgtacggacccgaacggtcctacccgcccccgttacggtaccctaccgtccgttccggttcccccgttccccg

SEQ ID NO: 133287 - DNA, 639 bp, Homo sapiens
  misc_feature: GYAE6OF01DBRO8.17.33.C11.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (355)..(355): a, c, t, g, unknown or other
  misc_feature (355)..(355): n is a, c, g, or t
tcagcgtagactagcacgaccggtgctcgatttagagtgagctcgttgggtttggggggcgccaggggtcccttccaatatcatcaccatggcctggactcctctctttctgttcctcctcacttgctgcccagggtccaattctcagactgtggtgactcaggagccctcactgactgtcgtccccaggagggacagtcactctcacctgtgcttccaacacgtggancagtcaccagtgcttactataccaaacgtggttaccagcaagaaacctggaacaagccaccgaggcactactatttanacgtaacaaaacaaacaacacctcctacggacccctcgcccgtattcncagtccctcccttcgtggggacaaacgtctacgccctagacctactcgtcgtgggtctcggctacgccgtggacggtacggacgggtcgtagtaacttattacgtcgtaccttacttcttacgtttgggtgtcgtcgtcgttcgtacgttcggttcgggacgggacggacgtaacgcgtacgtaccgttacgttaacgtccgacggacccgtaaggtccgtcccggtcccccgttcggtaccctcccgttccttcccgttcccctccccgttccccttacccgg

SEQ ID NO: 133288 - DNA, 524 bp, Homo sapiens
  misc_feature: GYAE6OF01BE5WN.17.33.C11.1.454.CMB.1.raw
  modified_base (339)..(339): a, c, t, g, unknown or other
  misc_feature (339)..(339): n is a, c, g, or t
  modified_base (473)..(473): a, c, t, g, unknown or other
  misc_feature (473)..(473): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgccccgattcncaggctccctccttgggggcaaagctgccctgacactgtctggtgtgcagcctgaggacgaggctgactattactgcctactctactttggtggtgctgtgctagttcgggcggtagggaccaagctgaccgtnttaagtcagcccaaggctcgccccctggcactctgttccccgcctcctccg

SEQ ID NO: 133289 - DNA, 584 bp, Homo sapiens
  misc_feature: GYAE6OF01C5S7P.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcaccaggcactcatttatagtacaaacaacaaacactacctggacccctgcccgattctcaggctcctcctggggcaaagctagcctgacactgtctggtgtgcagcctgagacgagctgactatactgcctagtctactttggtggtgcgtgtgtacttagttcggcggtaacgggacctaaggcgtaggaaccgttcgttaaaacggttccgaacggtaccccgtaaagggccttccgggacccccccttgggttaccaaccgtttccctaccggtttcccccaaccccgttcccctttacccg

SEQ ID NO: 133290 - DNA, 522 bp, Homo sapiens
  misc_feature: GYAE6OF01CHFSZ.17.33.C11.1.454.CMB.1.raw
  modified_base (467)..(467): a, c, t, g, unknown or other
  misc_feature (467)..(467): n is a, c, g, or t
  modified_base (511)..(511): a, c, t, g, unknown or other
  misc_feature (511)..(511): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaacctggacaagcacccagggcactcatttatagtacaaaacaacaaacactcctggacccctgcccgattctcaggctccctcctggggcaaagctgccctgacactgtctggtgtgcagcctgaggacgaggctgactattactgcctactctactttggtgtgctgtgctagttcggcggaggaccaagctgaccgtnttaagtcagcccgaagctcgcccctcggtcactctcgttccccnccctcctaccg

SEQ ID NO: 133291 - DNA, 588 bp, Homo sapiens
  misc_feature: GYAE6OF01BXZ3O.17.33.C11.1.454.CMB.1.raw
  modified_base (293)..(293): a, c, t, g, unknown or other
  misc_feature (293)..(293): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcaagaaacctggacaagcacccaggcactnatttatagtaacaaacaaacaaacactcctacgacccctgcccgtatctcagcctccctccgttcggggacaaagctacgccctgacactgtctggtgtgcagccgtgacggacgaggctagacttattactcgcctactcttacgtttggtggtgtcgtgtgtctagttcggacggtacggggaccaagcgtagtacccgttacgttaacgtccacggacccgtaaacgggtccgtacccggtccccccgttacgggtccctaccgttcccgttccggttcccccgtacccccg

SEQ ID NO: 133292 - DNA, 533 bp, Homo sapiens
  misc_feature: GYAE6OF01CFGHK.17.33.C11.1.454.CMB.1.raw
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactacctcggacccctgcccgattctcacggctccctcgttcggggcaaagctagccctgactactgtcgtggtgtgcagcctggaggacgaggctgactatactcgcctactcttactttggtgtgcgtgtgcttagttcggcggtagggaccaagctcgaccgtcttaagtcagcccaggcctcgcccctcggctaccgtctcgttcccgtcccc

SEQ ID NO: 133293 - DNA, 549 bp, Homo sapiens
  misc_feature: GYAE6OF01CUY3W.17.33.C11.1.454.CMB.1.raw
  modified_base (493)..(493): a, c, t, g, unknown or other
  misc_feature (493)..(493): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcattatagtaacaaacaacaaacactacctcggacccctgccccgattcctccaggcctccctccttcgggggacaaagctcgccctgacactgtctggtgtgcagcctgaggacgaggctagactattactcgcctactctacttttggtgttgtcgtgtcgtcttagttcgggcggtagggaccaaggcgtgaccgttnttaagtcaagacccaaggcctcgtcccccgtcggtccactctcgttcccctacccc

SEQ ID NO: 133294 - DNA, 800 bp, Homo sapiens
  misc_feature: GYAE6OF01CQ2F6.17.33.C11.1.454.CMB.1.raw
  modified_base (262)..(262): a, c, t, g, unknown or other
  misc_feature (262)..(262): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttaccaacactggagcagtcaccagtgcttactatccaaatggttccancgagaacctggacaagcaccaggcactctattatagtacaaacaacaacactcctcggaccctcgcccgtattctcaggtccctacccgtccgttacgggggtaccaaacgtccgtacgccccgtacggtaacctaccgttcgttccggttcgggttcgttcggccgaccggttcccgtacgggaacggggaaccgggtaacgggtacccgttacggtaaccgtttaacgtttaacccgttacggtaccccgttaaccgtttacccgttttaaccggtttttcggggttacgggtttacggtaccgtttggttacgttaccgtttacgggtttacccggggaccggggtaaaccggggtacccgtaaacggtccggtaccggttaacccggttacgtttaaaccgtaccgaaccggtaccccggtaaacgggttcccgttacccgggtaccccccccgttccgggttacccgttaacccggtttccgtttaccccggtttcccccccttaacccccgtttcccccgtttaacccccgg

SEQ ID NO: 133295 - DNA, 522 bp, Homo sapiens
  misc_feature: GYAE6OF01B8H4U.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgcgttagttcggcggagggaccaagctgaccgtacttaacgtcagcccaaggctcgcccccgtgtccactctcgtcccgtcccc

SEQ ID NO: 133296 - DNA, 747 bp, Homo sapiens
  misc_feature: GYAE6OF01C14RE.17.33.C11.1.454.CMB.1.raw
  modified_base (317)..(317): a, c, t, g, unknown or other
  misc_feature (317)..(317): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgacttactactacctaaactcggttaccagaccaacgtaaacctggaacaacgccaccgagggcactctaatttanaacgtaaccaaacaacaaacacctaccgtccggacccctcgacccgtattctaccgacggtccctcccgttaccggttacgggggactaaacgtccgtaccgtaccccgtacgacctacgttcgttcgtcgggttcgtcggcgaacggtccgtagggacgggtacggtacggtacgtacgtaacttacgttaccgttacgtacccttacgtttccgttttacgtttgggttcggttcggttcgttcggttaccgtaccggttacgtaccggggaccggggtaaccggtaccggaacgtaccggttaaccggtaccgtttaacgttacggtaccgtaccggaacccggtaacggttcccgtaccccggtacccccggttacccggtaccgttacccgtttaccccgttcccggttaccccccggttccccg

SEQ ID NO: 133297 - DNA, 683 bp, Homo sapiens
  misc_feature: GYAE6OF01DKN5L.17.33.C11.1.454.CMB.1.raw
  modified_base (399)..(399): a, c, t, g, unknown or other
  misc_feature (399)..(399): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttaactatccaaaactggttccagccaagaaaccctggaacaagcaacccgaggcactcatttatagtaacaaacaaacaaacactcctacgacccctgcccatcctcacggcctcccgtccgtggggacaaacgctcgccctgaccactgtctggtgngtacacgccgtaggacggacgaggtctacggtaacttaagttactcgccttaacttctttaacgttttcgggtggtcgtcgttagttgtaccttaggtttccggggacgggtaacgggaaccctaaacgggtccgttacgggtaaccccgtttacgttaaacggttccgaaccggtaccccgaaacggttcccgttacccggtcccccccgttcgggttacccgtaccccgtttacccgttacccggtttcccccccggtcccctttcccccgtttaacccccg

SEQ ID NO: 133298 - DNA, 715 bp, Homo sapiens
  misc_feature: GYAE6OF01DCQ94.17.33.C11.1.454.CMB.1.raw
  modified_base (299)..(299): a, c, t, g, unknown or other
  misc_feature (299)..(299): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttanagtaacaaacaacaaacactcctcggacccctcgacccgtattcctcgacggtcctacccgtccgttcgggggaccaaaacggtcctcggccctacgacctacgttgttccgtgggttggtcgccacggtcccgtaggaacgggacggtacggtctaggtaacctttaacgttaccgttcggtacccttaccgtttaccgtttaaccgttttggggtcgggttcggtcgttggttcggttacgttacggttccggggtaccgggtaacgggtacccggtaacggtccggttaccggtaaccccggtttacgttaacggtaccgaaccggtaaccccggaacggtacccgtccccggtaccccccgttccgggttaccctacccgttcccgtttcccgttaccccccttaccccccg

SEQ ID NO: 133299 - DNA, 546 bp, Homo sapiens
  misc_feature: GYAE6OF01EL2QQ.17.33.C11.1.454.CMB.1.raw
  modified_base (532)..(532): a, c, t, g, unknown or other
  misc_feature (532)..(532): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaacaacaaacactcctgacccctgcccgattctcaggctccctccttggggcaaagctgccctgacactgtctggtgtgcagcctgaggacgaggctgactattactcgccttactcttacgtttggtggttgcttgtgtctagttcgggcggtagggaccaaggctcgaccgttcttaagtcacgcccaagggcctcggcccccctcggtcctacctctcgttccccnccctcccttacccg

SEQ ID NO: 133300 - DNA, 598 bp, Homo sapiens
  misc_feature: GYAE6OF01EGU3I.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtaacaaacaacaaacactcctcggacccctgacccgattctcacggcctcccgtccgttgggggacaaagctcgccctgacactgtctggtgtgcagctggaggacgaggctgacttattactgtccttactcctttacgtttgggtgtcgtcgttgtgtcttacggttcgggcggacgggaccaaggctacgtaccggttacttaacggccgtacggacccgtaaggtccgtcccggacccccgttccggtaccctaccgttccgttaccggttcccccgtccccgttcccgttacccg

SEQ ID NO: 133301 - DNA, 720 bp, Homo sapiens
  misc_feature: GYAE6OF01A4PJ7.17.33.C11.1.454.CMB.1.raw
  modified_base (246)..(246): a, c, t, g, unknown or other
  misc_feature (246)..(246): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
tcagcgtagactagcacgaccggtgctcgatttagagtgagctcgttgggtttggggctggcgccaggggtcccttccaatatcagcaccatggcctggactcctctcttctgttcctcctctacttgctcgcccgacgggtccaattctcagactggtggtgactcgaggacgccctcactgactgtcgtcccgagggacggacagtcactctccacctgtcgtccttaccaactacgtgggacncgtacgtccaaccgtaggtcgtacctttaactactacctaaaacgttcggttaccagacgaacgaaaccgtggaacaacgccaaccgagggcacgtctatttatacgtaacaaacaacaaacnctaccgtcggaccctcgccctattccncgacgtcctcccgtcggtcggggacaacgtctcgtccctagacctacgtcgtcgtgggtcgtcgcgacgccgttaggacggtacggcggtctacgtacttacgttacgtcgtaccttacgttaccgttacggtttcgggtacggtcgtccgttggtcgtacgttacggttccgggacgggtaaccggaccgtaacgtccgttaccggtacccgttacgttaacggccgtaaccggtacccggtaacgggtcccgtaacccgggttccccccgttacgggttaccctacccgtttcccggttcccggttccccccgttaccccgg

SEQ ID NO: 133302 - DNA, 536 bp, Homo sapiens
  misc_feature: GYAE6OF01EEZCT.17.33.C11.1.454.CMB.1.raw
  modified_base (443)..(443): a, c, t, g, unknown or other
  misc_feature (443)..(443): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctcgacccctcgcccgattctcacggcctccctccgttcgggggcaaacgctcgccctgacactgtctggtgtgcagcctgaggacgagcgtgactattactgcctactcttacttggtgtgctgtgntgtcggcggaggaccaagctcgaccgttctaagtcacgcccaaggcctcgcccccgtcgtcctcctctccgttcccctcccgtcccttacccg

SEQ ID NO: 133303 - DNA, 559 bp, Homo sapiens
  misc_feature: GYAE6OF01A2MZ1.17.33.C11.1.454.CMB.1.raw
  modified_base (298)..(298): a, c, t, g, unknown or other
  misc_feature (298)..(298): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcaccaggcactcattanagtacaaacaacaaacactcctcggacccctgcccgattctcacggctccctccttggggcaaagctgccctgacactgtctggtgtgcagcctgacggacgaggctgactattactgtcctactcttacgtttggtggtgcgttgtgtcgttagttcgggcgggagggaccaagtccgtagtacccgttattaaggtccaacggccccgaaaggcctccgccccccgtcggttccaccttcctccgttccccctaccccg

SEQ ID NO: 133304 - DNA, 650 bp, Homo sapiens
  misc_feature: GYAE6OF01CB1DF.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcaggagccctcactgactgtgtccccaggagggacagtcactctcacctgtgcttccaacactggagcagtcaccagtgcttactactaccaaaactcggttccagacaacgaaacctggaacaacgccacccgagggaccaactcatttataacgtaacaaaacaaacaaaacactcctacggacccctcgacccgacttctaccgacggacctcccgtccgttcggggacaaacgctacgccctgaccactcgtcgtggtgtcgcacgccgtggaacggacggacggtctacgtactacttacgtcgtccttaccttcgttacgttttgggtcgttgtcgttgtcggtacgttagtttcgggcggggtaacggtaccgaacgtcgtcggtaacccgttcgttaacggtccacggacccgaacggtcccgtcccgtccccccgttcgggtaccctaccgttcccttcccggttcccccgttacccccg

SEQ ID NO: 133305 - DNA, 515 bp, Homo sapiens
  misc_feature: GYAE6OF01A9SXQ.17.33.C11.1.454.CMB.1.raw
  modified_base (295)..(295): a, c, t, g, unknown or other
  misc_feature (295)..(295): n is a, c, g, or t
  modified_base (411)..(411): a, c, t, g, unknown or other
  misc_feature (411)..(411): n is a, c, g, or t
  modified_base (466)..(466): a, c, t, g, unknown or other
  misc_feature (466)..(466): n is a, c, g, or t
  modified_base (494)..(494): a, c, t, g, unknown or other
  misc_feature (494)..(494): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtacaaacaacaaacactcctcggacccctgcccgattctcaggcctccctcctggggcaaagctgcctgacactgtctggtcgtgcagcctgacggacgaggctgactattacngcctactctactttggtgtgctgtgtctagtcggcggaggaccaagctgaccgtnttaagcagcccgaagctcgcccctgtcnctctcgtcccgccctcctccg

SEQ ID NO: 133306 - DNA, 540 bp, Homo sapiens
  misc_feature: GYAE6OF01EP4Z0.17.33.C11.1.454.CMB.1.raw
  modified_base (431)..(431): a, c, t, g, unknown or other
  misc_feature (431)..(431): n is a, c, g, or t
  modified_base (473)..(473): a, c, t, g, unknown or other
  misc_feature (473)..(473): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctcttggggcaaagctagccctgacactgtctggtgtgcagcctgagacgaggctgactattactgcctactctactttggtggtntctgtgtcttagttcgggcggtagggaccaagtctgaccgtnttaacgtcagtcccaaggctcggacccccctgggtacccacgttctcgttccccgccctccctaccg

SEQ ID NO: 133307 - DNA, 607 bp, Homo sapiens
  misc_feature: GYAE6OF01ELSHV.17.33.C11.1.454.CMB.1.raw
  modified_base (453)..(453): a, c, t, g, unknown or other
  misc_feature (453)..(453): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagcacccagggcactcatttatagtacaaacaacaaacactcctacgacccctgcccgtattcctcacggcctcccgtccgttcggggacaaacgctcgccctgacactgtctggtgtgcagctgaggacgaggctagactatttactcgccttactcttacgtttggtggttncgttgtcgtcgttagttccggcgggacgggacctaaggtccgtacggtacccgttacgttaaacggtcctaacggaccccgtaagggtcccgttacccggaccccccgttcggttaccctaaccgttcccgttccggttcccccttaacccccg

SEQ ID NO: 133308 - DNA, 610 bp, Homo sapiens
  misc_feature: GYAE6OF01BB1R0.17.33.C11.1.454.CMB.1.raw
  modified_base (300)..(300): a, c, t, g, unknown or other
  misc_feature (300)..(300): n is a, c, g, or t
  modified_base (417)..(417): a, c, t, g, unknown or other
  misc_feature (417)..(417): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactatccaaactggttaccagctaagaaacctggacaagcaccaggtcactcatttanagtacaaacaacaaacactcctgacccctgcccgtatctcaggcctcctcgtggggacaacgctcgaccctgactactgtcgttcggtgtcgcgagtccgtggacgggacgaggtcncgtaactagttactcgtcctaacttcgttaccgtttgggtacggttgtcgtgttcgtccttaaggttccggcgggaacgggacctaaggccgtcggtaaccgtaccttaaacggtccacggcccgtaaggccgtaccgcccccgtcggtacctacgttcccttaccgtttaccccgccccttcccgttacccg

SEQ ID NO: 133309 - DNA, 618 bp, Homo sapiens
  misc_feature: GYAE6OF01DDF9X.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggtccagcagaaactggacagcaccaggcactcatttatagtacaaacaacaaacactccacggacccctgcccgattctcacgcctccctcgttggggacaaagctcgccctagacactcgtctggtgtgcagccgtaggaggacgacggtctagacttacttactcgccttacgtctttacgtttgggtggtgtcttggtctacgttacgttccggggacgggaacgggtacccaaggtcgtaccggtaccgtttacgttaaacgtccgaacggtacccgaaggcccgttacccgccccccgttcgggtaccctaacccgttcccgttacccggtttcccccgtccccttcccgtttaccccg

SEQ ID NO: 133310 - DNA, 547 bp, Homo sapiens
  misc_feature: GYAE6OF01DW7OB.17.33.C11.1.454.CMB.1.raw
  modified_base (300)..(300): a, c, t, g, unknown or other
  misc_feature (300)..(300): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgacttactatccaaaactggttccagcaagaaacctggacaagcaccaggcactcatttanagtaacaaacaaacaaacactacctacggacccctgacccgtaattctaccacggcctcccgtccgttggggacaaagcctcgccctgaccactgtctggtgtgcgagcctggagacgaggctgactatactcgcctactctacgtttggtgtcgtctgtcgtctagttcggcggaggacaagctacgaccgtataacgcagaccaaggcctccgccccgtcgtcacctctccgttcccctaccccg

SEQ ID NO: 133311 - DNA, 595 bp, Homo sapiens
  misc_feature: GYAE6OF01C8TK8.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactataccaaactggttccagcaagaaacctggacaagcacccagggcactctattataagtaacaaacaacaaaacactcctcggaacccctgacccgtatctcacgcctccctcgttcggggacaaacgctcgccctgacactgtctggtgtcgcgacgccgtggaagggacgtatggctgtactattactcgtcctacttcttacgtttgggttgtgtacgttcgtgtcgtagttcgggacgggacggaccgaagtccgtacgtacccgttacgtaacgtcgaacggcccgaacgggtcctcccggtaccccgttccggtacctacctccgttcccggtttcccccg

SEQ ID NO: 133312 - DNA, 545 bp, Homo sapiens
  misc_feature: GYAE6OF01BL7G2.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtaacaaacaacaaacactcctggacccctgccccgattcctcacggctaccctcgttcggggacaaagctgcccctgacactgtctggtgtgcacgcctggaggacgaggctgactattactgtccttactcttacgtttggtggtgctgtgtctagttcgggcggacgggacctaagctcgtaccgtacttacgcacgaccgaggcctcgccccctcgtccactcgtcgttcccctaccccg

SEQ ID NO: 133313 - DNA, 690 bp, Homo sapiens
  misc_feature: GYAE6OF01CX8XA.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccagggagggacagtcactctcacctgtgcttaccaacacgtgggagcagtccaccagtcgtacttaactaactaccaaaacgtcggttaccaagacaaacgaaaccgtggaaccaagaccaaccccgagggacctaactctaatttataacgtaaaccaaaacaaacaaacctacctcccgtacggacccctcggaccctattcgacgacggtcctcccgtccggttacgggggactaaacgtccgtcggtaccctagaacctacgtcgtcgtggtcgtagctaacgccgtaggacggacggtacgacgtaggtaactacgttacgtcgtaccctacttaccgttacggtttgggtcgtcgtcgttggtcgtacgtttacgggtccgggacgggtaacggaccgtaggtcgtacggaaccgttcgttaaacgtccgacggtacccagggtccctacccggtccccgtcggtacctaccgttccgtcccgtccccgtccccg

SEQ ID NO: 133314 - DNA, 556 bp, Homo sapiens
  misc_feature: GYAE6OF01A7S70.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctcggacccctcgcccgattcctcacggcctccctccgttcggggacaaacgctcgccctgacactgtctggtgtcgcacgccgtgaggacgaggctgactattactcgcctactcttacgtttggtggttgcgttgtgtctagttcgggcggacgggaccagctgtaccgtacgttaacgtcgagcccgtaaggcctccgcccccgttcggtcctacgtcctcgttccccgtcccc

SEQ ID NO: 133315 - DNA, 575 bp, Homo sapiens
  misc_feature: GYAE6OF01CYR8F.17.33.C11.1.454.CMB.1.raw
  modified_base (483)..(483): a, c, t, g, unknown or other
  misc_feature (483)..(483): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactccaaactgttccagcaagaacctgacaagccaccaggcactctattatagtaacaaacaaacaaacactcctacggaccctgccgtacttctacacggcctcccgtcgtcggggacaaacgctcgccctgactacgtcgtcgtggtcgtgcacgccgtggacggacgaggactcgtactacgttactcgtcctactcgttacgtttggtgtcgcttgtcgtcgtacgtcgggnggacggacacggtcgtacgaccgttactaacgtcgacgacccgtaacggtcctcccgtccccgtcgtacctacgtccttcgtcccgttcccg

SEQ ID NO: 133316 - DNA, 560 bp, Homo sapiens
  misc_feature: GYAE6OF01DXG3E.17.33.C11.1.454.CMB.1.raw
  modified_base (323)..(323): a, c, t, g, unknown or other
  misc_feature (323)..(323): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgcttccaacactggagcagtcaccagtcgcttacatccaaaactggttccagcagaaacctggacaagcaccagggcactcaatttatagtacaaacaacaaacactccncggacccctgcccgattctcaggcctccctcgtcggggacaaacgctgccctgactactgtctggtgtgcacgcgtgacggacgacggctagactatactgacctactcttacgtttggtgtgtcgtgtcgtcgttagttcgggcgacggacgagtcgtgaccgttataacgtcgaacgccgaacggtccgtccgccccccgtacggtccacgttcccttccgttcccctaaccccg

SEQ ID NO: 133317 - DNA, 604 bp, Homo sapiens
  misc_feature: GYAE6OF01AJXEW.17.33.C11.1.454.CMB.1.raw
  modified_base (585)..(585): a, c, t, g, unknown or other
  misc_feature (585)..(585): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacagcacccaggcactcatttatagtacaaacaacaaacactcctcggacccctgcccgtatctcacggctccctccgtgggggacaaagctcgccctgacactgtcgtggtgtgcgagccgtaggacggacggacggctagtacttatttacgcgtcccttacttcgtttacgtttgggtaggtcgtcgttgtgtacttagttcgggtcggacggggacctaacgcgtcgtacccgttactttaacgtcgacgccccgaaggccctccggtccccccgttcggtcccgtaccttccgttacccgtttcccccnccccgtttcccttaccccg

SEQ ID NO: 133318 - DNA, 554 bp, Homo sapiens
  misc_feature: GYAE6OF01CG32V.17.33.C11.1.454.CMB.1.raw
  modified_base (372)..(372): a, c, t, g, unknown or other
  misc_feature (372)..(372): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcaccagggcactcatttatagtaacaaacaacaaacactcctcggacccctgccgattctcaggctcccgtccgttggggacaaagcgtcnccctgacactgtcgtggttcgtgcacgccgtgacggacgaggctgactatactgcctactcttacgtttggtggtgtcgtgtgtcttagttcgggcggacgggacacgctcggtacctacgttaacgtcacggaccctaaggcctcgcccccgtcggtaccacttcttcgtcccctaccccg

SEQ ID NO: 133319 - DNA, 550 bp, Homo sapiens
  misc_feature: GYAE6OF01EME8O.17.33.C11.1.454.CMB.1.raw
  modified_base (420)..(420): a, c, t, g, unknown or other
  misc_feature (420)..(420): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcaccaggcactcattatagtacaaacaacaaacactacctcgaccctgcccgattcctcacggcctccctccgttcgggggacaaagcctcgccctgacacgtgtctggtgtgcagcctgaggacgaggctgactattacncgtcctactctactttggtggtgtctgtgcgttagttcgggcggagggaccaagcgtacgaccgtacttaagtccgagacccgaaggcctccgcccccgtcggtccaccttcctccgttccccgtccccg

SEQ ID NO: 133320 - DNA, 555 bp, Homo sapiens
  misc_feature: GYAE6OF01DDJOF.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctgacccctgacccgattctcaggcctcccgtccgttggggactaaagctcgccctgacactgtactggttgtgcagcctggaggacgaggctagactatactcgcctactcttactttggtgtgtctgtgtctagtcggcggaggaccaagtctcggtaccgtacgtaacgtcacgacccgaggtcctccgccccccgttcggtacctaccttcgttccgttccccgtacccccg

SEQ ID NO: 133321 - DNA, 610 bp, Homo sapiens
  misc_feature: GYAE6OF01BH092.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcacccagggcactcatttatagtacaaaacaaacaaacacctcctacggaccccctcgcccgattcctcacggtcctccctccgttcgggggacaaacgcgtcgccctagacacgtgtcgtggtgtgcagccgtgacggacggacggtctagtactattacgtcgtccttacttccttacgtttggtggtgtctgtgtacgttgttccgggcgggtacgggacaacggtcgtacgtaccgttacgtttaacgcgtacgcccgaaggtccgtccggcccccgtcggtcctaccgttcccgttaccggttcccctcccccttcccgttacccg

SEQ ID NO: 133322 - DNA, 578 bp, Homo sapiens
  misc_feature: GYAE6OF01CJXTD.17.33.C11.1.454.CMB.1.raw
  modified_base (393)..(393): a, c, t, g, unknown or other
  misc_feature (393)..(393): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaactggacaagcaccaggcactcatttatagtacaaacaacaaacactacctacggacccctgcccgattcctcacggtcctcccgtccgttgggggacaaagctcgccctgacactgtcgtggtgngcagcctggaggacgagctagactattctgacctacttctacgtttggtggtgtctggtcgtacgttgttccgggacgggtaacgggtaccgaaggtccgtacggtaccgttacgttaacgtcgaccgcccgaaggcctccgccccgtcgtcctaccttctccgttccccacccgttcctacccg

SEQ ID NO: 133323 - DNA, 539 bp, Homo sapiens
  misc_feature: GYAE6OF01DQQYV.17.33.C11.1.454.CMB.1.raw
  modified_base (526)..(526): a, c, t, g, unknown or other
  misc_feature (526)..(526): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccaggcactcatttatagtacaaacaacaaacactcctgacccctgcccgattctcagcctccctccgttgggggcaaagctagccctgacactgtctggtgtgcacgcctgaggacgaggctgactattactgcctactctactttggtggtgtcgtgtgtctagttcgggcggagggaccaagctcgaccgtcttaagtcacgcccaaggcctcgccccctggtcctactcttccgttccccnccctccctacccg

SEQ ID NO: 133324 - DNA, 657 bp, Homo sapiens
  misc_feature: GYAE6OF01DET5Y.17.33.C11.1.454.CMB.1.raw
  modified_base (230)..(230): a, c, t, g, unknown or other
  misc_feature (230)..(230): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccagggagggacagtcactctcacctgtgcttccaacactggancagtcaccagtgcttactactaccaaactggttccagcaagaacctggaacaagcaccgaggcactcatttatagtaacaaacaaacaaacactaccgacggacccctgacccgacttctacacggtcctccgtccgtggggacaaacgctacgccctagactacgtggtctggtagtcgcacgtccgtggacggacggaggtctagtacttacttacgtcgaccttactacgttacgtttgggtgtcggtcgtaggtcgtacgttacggttccgggacgggtaacgggtaacccgaaggtccgtacggtaacccggttaacgtttaaaccggtccaaccgggtacccgtaaacgggtcccgttacccggttccccccgtccggttaccctacccgttcccgttcccgtttccccccttaacccccg

SEQ ID NO: 133325 - DNA, 561 bp, Homo sapiens
  misc_feature: GYAE6OF01AP75C.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactcctcggacccctcgcccgattctcacggcctcccgtccgttcggggacaaacgctcgccctgacactgtcgtggtgtgcagccgtgaggacgacggctgactattactcgtcctactctacgtttggtgtgtcgtgtgtcgtagttcggacggacggaccgaagcgtacgaccgttacgttaacgtcgacgacccgtaggcctcgcccccgtcggtacctacctctccgttcccctaccccg

SEQ ID NO: 133326 - DNA, 668 bp, Homo sapiens
  misc_feature: GYAE6OF01ADYDQ.17.33.C11.1.454.CMB.1.raw
  modified_base (225)..(225): a, c, t, g, unknown or other
  misc_feature (225)..(225): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggancagtcaccagtgcttacatccaaactggttccagcagaaacctggacaagcacccagggcactcatttatagtacaaaacaacaaacactacctggacccctgcccgtattctcgagcctcccctccgttacgggggcaaacgcgtacgccctgactactcgtactggtgtcgacacgtccgtgaacgggacgaggctagtactaacttacgtgtaccttacttcctacgttttgggtacggttgtcgttagtcgtacgttagttccggggacgggtaaccgggaccgaacggtcccgttaacggtaacccgttacgtttaaacggtccgtaaccggtaccccgaacgggtccgtcccccggtacccccccggttaccggttacccgtacccgtttacccgttcccggttacccccccgtccccgttcccgtttaacccccgg

SEQ ID NO: 133327 - DNA, 660 bp, Homo sapiens
  misc_feature: GYAE6OF01CDCPT.17.33.C11.1.454.CMB.1.raw
  modified_base (310)..(310): a, c, t, g, unknown or other
  misc_feature (310)..(310): n is a, c, g, or t
  modified_base (351)..(351): a, c, t, g, unknown or other
  misc_feature (351)..(351): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcactgtgcttccaacactggagcagtcaccgagtcgcttactataccaaacgtcggttaccacgcaacgaaaccgtaggaacaacgcaccgaggcactactattanataacaaacaacaacactaccacggaccctcgaccgtatcncgacgtcctccgtccgtacggggacaacgctaccgcctagactactacgtcgtggtgacgcgtacgcgtaggacgggacggtacggtctaggtaactacgttacgttcgtacccgttacgttaccgtttacggttttaggtcgggttacgtcgttggttacgtacgtttaccggttaccggggtacgggaaacgggtaccgaacggtcgtaacggtacccgttagttaacgtccgaccgtaccggagtcccgtccgacccccggttcgtacctccgttccttccgttcccctcccgttcccttacccgg

SEQ ID NO: 133328 - DNA, 679 bp, Homo sapiens
  misc_feature: GYAE6OF01CLYIV.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcaggagccctcactgactgtcgtcccgaggagggacagtcactctcacctgtgcttccaacactggagcagtcaccagtgcttacataccaaactgttccagcaagaaacctggacaaagccaccacgggacactactatttatacgtaacaaacaaacaaacacctacctacggacccctcgcccgtaacttcctcgaacgtccgttacccgtccggttaggggacaaaacgcgtacggccctagactacgtcgtcgtggtgtcgcgagtccgtaggacgggacgaacggtctacggtactaacgttaacctgcccttacgttacttaacgtttgggtcggttggtccgttaggtcggtaccgttacggtttaccggggacgggaacggggtaacctaaccgggcgttaacccggtaccgttacgtttaaacggttacccgaacggaccccgtaaggtccccgtaccggtcccccgttcggttaccaccgttccttaccggttccccctaacccccg

SEQ ID NO: 133329 - DNA, 735 bp, Homo sapiens
  misc_feature: GYAE6OF01BVCVE.17.33.C11.1.454.CMB.1.raw
  modified_base (301)..(301): a, c, t, g, unknown or other
  misc_feature (301)..(301): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcacgaaacctggaacaagccaccgaggcactctatttanataacaaacaacaacactctcgaccctgaccgtatctcagtcctccgtcgtgggacaacgctcgcctagacacgtcgtcgtgtgtcgcgtacgccgtggacggtacggaggtctacgtaacttacttacgtcggtacccttacgttaccgtttaccggtttgggttcgggttcgtccgttacgggttcggtaccgttacgggtttacccgggggtaccggggtaaaccggggtaacccgtaaacgggtccgttaacccgggttaacccggtttaaccgttttaaaccggtacccgtaaaccgggtacccccgtaaagggttcccccggttcccccgggtaccccccggtttcccggggttacccctaaccccgtttcccgtttacccccggtttaccccccttaaccccccgttttccccgtttaaccccccgg

SEQ ID NO: 133330 - DNA, 613 bp, Homo sapiens
  misc_feature: GYAE6OF01AC5P0.17.33.C11.1.454.CMB.1.raw
  modified_base (303)..(303): a, c, t, g, unknown or other
  misc_feature (303)..(303): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagcacccgaggccactctaattanagtaacaaacaaacaaacactacctcgacccctgcccgtattctcaggccctcccgtccgttcggggacaaacgcctacgccctagacctactcgtctggtgtgtcacgccgtaggaggacgaggctagtactattacgtcgtacctactctttacgtttggtgtgtcgtgtcgtcgtacgttcgggacgggacgggaccgagtccgtacgtaccgttcgttaacggtcaaccggcccgtaaacggtccctacccggtccccccgttccggtacctaacccgttcccgttcccgttcccccgtacccccg

SEQ ID NO: 133331 - DNA, 254 bp, Homo sapiens
  misc_feature: GYAE6OF01C2FI3.17.33.C11.1.454.CMB.1.raw
  modified_base (251)..(254): a, c, t, g, unknown or other
  misc_feature (251)..(254): n is a, c, g, or t
tcagcgtagactagcacgaccggtgctcgatttagagtgagctcgttgggtttggggagttattagtccctactttgactactggggccagggaactctggtcaccgtctccgcagcctccaccaagggcccatcggtcttccccctggcaccctcctccaagagcacctctgggggcacagcggccctgggctgcctggtcaaggactacttccctagtctacgctgagcgggctggcaaggcgcatagnnnn

SEQ ID NO: 133332 - DNA, 648 bp, Homo sapiens
  misc_feature: GYAE6OF01EWHHZ.17.33.C11.1.454.CMB.1.raw
  modified_base (370)..(370): a, c, t, g, unknown or other
  misc_feature (370)..(370): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccaggaggacagtcactctcacctgtcgcttaccaacacgtggacgcagtcaccagtcgtcttaactactaccaaacttcggttaccagacaagaaccgtggaacaagccaccgaggcactactatttaataacgtaacaaacaaacaaccaccttccgtacgacccctacgacccgtatccncgtacgtccttcccgtcggtacggggacaacgtctacgccctacgacacgtgtcgtggtcgtgctacgcgtaggacgggacgacggtacgtacgtacttacgttacgtccgtaccttactttaccgttacgtttgggtcggttcgtacgttcgtcggtacgttacgtaccgggacgggtaacggaccgtaacgcgtacggtaccttacgttacgccgacggaccgtaacggtccgacccgtccccgtacgcctacctccgttcccgtcccctaccccg

SEQ ID NO: 133333 - DNA, 653 bp, Homo sapiens
  misc_feature: GYAE6OF01DXRJM.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtcaccagtgcttactataccaaactggttccagacagaaacctggaacaacgcaccacggcactctatttatagtaacaaacaacaaacactcctacgacccctcgacccgattcctcgacggcctccccgttccggtcgggggacaaacggtccgtcgccccgtcgacctacgttcgttcgtgggtgttcggaccgacggccgtaggaacgggacggaggacttgaaccgttagttaccgtcgtacccttacgttctttacgtttggttggtgtcgttcggtgtcgttagttccgggacggaacgggaccaaggtcgttacggacccgtttagttaaacgtccgtaaccggcccgaaaggtcccgttcccgtcccccgttcgggtacctaccgttcccttccggttcccccttaccccg

SEQ ID NO: 133334 - DNA, 523 bp, Homo sapiens
  misc_feature: GYAE6OF01D0NTD.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgattctcagctccctccttggggcaaagctgccctgacactgtctggtgtgcagcctgaggacgaggctgactatactcgcctactcttactttggtgtgcttgtgcttagttcggcggagggaccaagctgaccgtgttaagctagcccaggctcgccccctcggtcacttcctgttcccctccccg

SEQ ID NO: 133335 - DNA, 601 bp, Homo sapiens
  misc_feature: GYAE6OF01ELG97.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactatccaaactggttccagcagaaacctggacaagcaccaggcactcatttatagtacaaacaacaaacactcctcggacccctgcccgattcctcacggcctcccgtccgttgggggacaaacgctcgccctgacactgtctggtgtgcacgcctggacggacgaggctgacttattactgtacctactcttacgtttggtgttgtcttgtcgtcgttacgttcgggacgggtacggtaccgaagtcgtacggtaccgttacgtttaacgtccgtaacgtacccgaaggtccgtcccgcccccgttcgggtacctaccgttccgttccggtttcccccgtcccttccccgttacccg

SEQ ID NO: 133336 - DNA, 791 bp, Homo sapiens
  misc_feature: GYAE6OF01CTU00.17.33.C11.1.454.CMB.1.raw
  modified_base (226)..(226): a, c, t, g, unknown or other
  misc_feature (226)..(226): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtgcttaccaacnctggagcacgtcaccagtcgtcttactactacctaaacgtcggttaccagacaacgaaaccgtggaacaacgccaacccgaggaccactactatttacaacgtaacaaacaacaaaccactacccgtacgacccctgcccgtacttctcgacgcctcccgtcggtacgggacaacgctcgcctagactacgtgtacgtggtacgtcgactacgtccgtaggaacgggacgacggtacgtacgtaacgttaacgtttaccgtccgtacccgttacgttaccgttttaacggttttcggggttcgggttacggttccgttagggttaccgtaccgtttaacgggtttacccgggggaccggggttaaccgggggtaacccgtaacgggtccggtttaacccggtaacccgggttttaaccgtttaaaccgggtacccgtaaccgggtaccccccggtaaacgggtcccccggtttaccccggttaccccccccgggttaccggttaccccgttaaccccggttttcccccggtttaccccgggtttcccccccgttaccccccccgg

SEQ ID NO: 133337 - DNA, 581 bp, Homo sapiens
  misc_feature: GYAE6OF01C24UY.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcaccagggcactcattatagtaacaaacaacaaacactcctacggacccctgcccgtatctacaggtctcccgtcgttggggacaaacgctcgccctgacactgtctggtgtgcagctgaggacgaggctagactattacgtcgtcctacttcttacgtttggtgtgtcgttgtcgtcgttagttcgggcggaacgggaccaaggtcgtacggaccgttacgttaacgtcgaacgacccgaaggtcccgtaccggtcccccgttccggtacctaccgttcctcccgttccccgtcccccg

SEQ ID NO: 133338 - DNA, 915 bp, Homo sapiens
  misc_feature: GYAE6OF01BBMB1.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtccaccgagtcgtcttactactacctaaaacgttcggttacccaggtacaaacggaaacccgttacgggaaccaacggacccaaccccgacggggtaccaaccgttaccttaatttttaacgttaaacgttaaacccaaaaaaccaaaacctaaaacctaaccctttacccgtaaccgggtaacccccctaccggtacccccgtaactttaccgtaccggtaaccgggttaccccgttacccccggtttaccggttaccggggggggtaacccaaaaaccgggttcccgttacccgggacccccgttacggtaaccccgtaaccgttcgggttaccggtttcgggttcggttacggtcccgtaacggtccccggttagggaacggggtaccgggaacgggtaccgttacggtaacgttaacgtttaaccgttacgtacccgtttacgttaccgtttaacggttttgggttcggttacgtccgtttaggtcggttaccgtttaacggtccggggtacgggtaccgggtaacccgtaaggtaccgttacgggtaccgttaccgttaaacggtaccgtaaccggtacccggtaacgggtcccttacccggaccccccgtttaccggtacccttacccgttacccggtttacccggttccccccgtccccgtttcccccgttacccgg

SEQ ID NO: 133339 - DNA, 805 bp, Homo sapiens
  misc_feature: GYAE6OF01DOK6D.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtgcttccaacactggagcagtccaccagtcgcttactactaccaaacgttggttccagcaacgaaaccgtggaacaacgaccgaacccgagggcactctaattttataacgttaacaaaaccaaactaaaacaccttacccgacggtacccctcggaccccgtattcctacgacggtcctcccgttaccggttcgggggaccaaacgtccgtcgccctcgactacgtcgtcgtgggtcgtcgacgacgtcccgtaggaacgggacggtacggtacgttacgtaacgttacgtttaccgtcgtacccctttacgtttaccgtttaacgttttcggggttcgggttagttccgtttaggttcggttaccggtttacggttaccgggggtaccgggtaaaccggggtaacccgtaacggtacccgggttaccggtaacccgtttaccggtttaaaccgggtcgtaaaccccgggtacccggtaaacggggttccccgttccccgggtaccccccgttaccggttaccccgttaacccgtttcccgttaccccgggttttaaccccccgtcccccgtttccccgttttaacccccgg

SEQ ID NO: 133340 - DNA, 615 bp, Homo sapiens
  misc_feature: GYAE6OF01C1SWC.17.33.C11.1.454.CMB.1.raw
  modified_base (301)..(301): a, c, t, g, unknown or other
  misc_feature (301)..(301): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactatccaaactggttccagcaagaaacctggacaagacacccaggcactcattanagtacaaacaacaaacactcctacggacccctcgacccgacttctacagcctccctccgttacgggggacaaacgctcgccctgacactgtctggtgtgcagcctggacgggacgaggcgtacgacgttacttacgtacgtcctacttcttacgtttggtggtgtcgtgtgtcttagttcggtcgggaacgggaccgtaagtccgtacgaccgttacgttaacgtaccgacggtacccgaaacggtccgttacccggccccccgttacccggttacccgtaccgttcccgttcccgttcccccggttccccccg

SEQ ID NO: 133341 - DNA, 715 bp, Homo sapiens
  misc_feature: GYAE6OF01DKZ73.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtgccttaccaacacgtggacgcagtccaccagtcgcttactatacccaaacgtggttccagcaagaaacctggacaacgcaccgaggcactcaatttataacgtaacaaacaaacaaactacctcctcggacccctcgcccgtattctacgacggccttcccgttcgttacgggggacaaacggcctcgccctacgacctacgtcgttcgtcgggttgtcggccacggtcccgtaggaacgggacggtacggctacgtaacttacgtttactcggtaccttacgtttacgtttaccgtttgggttacggttggtaccgttggtacgttcgttaaggtttccggggacgggtaaccgggtaccgaacggtaccggttacggtacccgttaacgtttaaacggtcccgtaacggaaccccggtaggtccccgtacccggttccccccgttacggttacccctacccgtttcccgtttacccggtccccccgtttacccccgg

SEQ ID NO: 133342 - DNA, 737 bp, Homo sapiens
  misc_feature: GYAE6OF01C4KOO.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccgagggagggacagtcactctcacctgtgcttaccaacacgtggagcagtccaccagtcgacttactactaccaaacgttcggttacagacgaaagaaaccgtaggaacacgaccaccgaggacactactaattaactaacgtaaacaaacaaacaaaccacctaccgtaccgacccgtcgaccgtacttctacgtaacggtccttacccgtaccgggttacgggggaacctaaacggtccgtacgtacccgtacgtacctacggttcgttaccggttgggtcgtacggaccgtacggtaccgtagggaacgggtaacggacggtacgtacggtaacttacttacggtctacccgttacttacgtttacggttgggtacggtcgtacgttggtcggttagttacggtacgggacggtaacggacgtacgtcggtacgtacccggttaacgttaacggaccgtaacggacccggtaacggtcccgttacccggtcccccgttacgggttacccacccggtttcccgtacccgttcccccgttaacccccg

SEQ ID NO: 133343 - DNA, 948 bp, Homo sapiens
  misc_feature: GYAE6OF01EW3EI.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttaccaacacgtggagcagtccaccagtcgcttactactaccaaacgttcggttaccagtaccaacgaaaaccgtaggaacaacgccaaccccgacggggacaaccgtctaattttaagtaacgttaaaccaaaaaccaaacaaaaccaccttacccgtaccgggtacccccttacggaccccgtactttaccgtaccgtaaccggtcccgtttacccccgtttacccggggtttacggggggaaccctaaaaacggtcccgttacccgggtacccccttacggaacccgttaaccgtttcgggtttacccgttaggggtttcgggtccggtaacccggtaaccggtccccgtttaacgggggaacggggtaacccgggaacggggttacggttaaccggttaaaccgtttaaacgttttaacccgttaccggttacccgtttaaacccgttttacccgttttaacccgggttttttaggggtttcgggtttcgggttaccggtttcggttccggttaccggtttaaccgggtttaccgggggtacccggggtaaaccgggggtaacccgtaaacggtcccggttacggttaacccggttaaccgtttaacggtacccgtaaccgggtacccgtaaaccgggtcccgttaccccggtaccccccggttacggtaccccttacccgttaccggttaccccgtttacccccttacccccgtccccgtttaccccgg

SEQ ID NO: 133344 - DNA, 591 bp, Homo sapiens
  misc_feature: GYAE6OF01AHR11.17.33.C11.1.454.CMB.1.raw
  modified_base (294)..(294): a, c, t, g, unknown or other
  misc_feature (294)..(294): n is a, c, g, or t
  modified_base (331)..(331): a, c, t, g, unknown or other
  misc_feature (331)..(331): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctgacagcaccaggcactcattanagtacaacaacaacactccagacccctagccacttcncacggcctacccgtcgttcggggacaaagtctcgtccacgtaccacttcgtaccgtggtacgtcgacgacgtccgtaggacgggacggtacggtctacggtaacttacgttacgtcgtacccgtacttcgtacgtttggtcggtgtcgttgtcggtacttacggtcgggcggtacgggacaacggtctcggtacgtacgtaacgttcacggaccgacgcgtccgccccgtcgtaccgtacctcgtccgtccccgtacccc

SEQ ID NO: 133345 - DNA, 631 bp, Homo sapiens
  misc_feature: GYAE6OF01CKES6.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactataccaaactggttccagcaagaaaacctggaacaagcacccaggcactcatttatagtacaaaacaaacaaacactcctcgacccctgacccgattcctcaggcctccctccgttggggacaaagctcgccctgacactgtctggtgtgcagctggacggacgaggctgacttattactcgcctactcttacgtttggtggtcgtcgttgtcgtcttacgtttccgggcgggtaacgggaccaaggtccgtacggtacccgttacgttaaacggttaccgaccggtaccccgaaagggtcccgttcccggtcccccccgttacggttccctacccgtttacccgttcccggtttccccccgtccccgttcccctttaaccccgg

SEQ ID NO: 133346 - DNA, 698 bp, Homo sapiens
  misc_feature: GYAE6OF01CALUZ.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgtccttaactactaccaaacgttcggttacccaggacaacgaaaaccctgggaacaaacgccaaccccgaggggccacctactaatttataacgtaacaaaaccaaacaaacaccttccgtacggaccccctcgaccccgtattcctacgacggtccttccccgttccggttcgggggacaaacgtctcgccctgacctacgtgttctggtgtcgcgacgccgtggaacggacgaggtcgtagtacttatttaccgtcgtcccttacttcgtttacgtttgggtcggttgtacgttggtcgtacttaggttccgggcgggtaacgggaccaaggtcgtacgggtaccgttacgtttaacggacctaccgggaccctaagggcccttcccggccccccgttacggtaccctaccgttcccggttccggtttccccccgtcccgttccccgtttaccccgg

SEQ ID NO: 133347 - DNA, 674 bp, Homo sapiens
  misc_feature: GYAE6OF01AJBVP.17.33.C11.1.454.CMB.1.raw
  modified_base (409)..(409): a, c, t, g, unknown or other
  misc_feature (409)..(409): n is a, c, g, or t
tcagcgtagactagcacgaccggtgctcgatttagagtgagctcgttgggtttgggggcggccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtccaccagtgcttactataccaaactggttccagcacgaaacctggacaagcacccagggcacactatttatagtaacaaacaacaacactcctacggacccctcgccgactctcgacggtctacccctcgttcggggctaaagctcgccctgacactgtctagggtctgcacgtcgnggtaggaccgaggtcctagaccgttattaacctcggaccttaccgttctaccgttttgggtccggtagtccttaggttccgtacgttacgttaccggggtaggggtaaccggggaacctaacgacggtacccgttaccggttacgtttaacccgtacgacccggtaaccccgaagggttccctcccggtaccccccgtttacggtaccccgttacccgttaccgtttccccgtacccccgttacccccgttcccctttaccccgg

SEQ ID NO: 133348 - DNA, 750 bp, Homo sapiens
  misc_feature: GYAE6OF01CROYN.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcaggacgccctcactgactgtcgtcccgaggacggacagtcactctcactgtgcttaccaacacgtggacgcaacgtccaaccgtagtcgtctttaacgtactaccgtaaactcggttaccagaccaacggtaaacctgggaaccaacggaccaacccgaagggaccacgtactaatttacgtacgtaaaccaaaactaaactaaaacctaccgtacccgtaccgggaaccccctcggaccccgttacttacgtaccgtacggtacccttcccgttacggttacgggggaacaaaacggtccgtacgtacccgtacgtaccgtacgttcgtacgttacgggtcgtacgtaccgtacggtaccgtacggaacgggaacggtaacgggtccgtaacggttaaccgtttaacgtttaaccgttacggtaccctttaccgtttaccgtttaacggtttggttacggtcgtccgttgttacgtccgttacgttacgggcgggtaacggtaccgaacgtcgtacggtaccgtacgttacgtcgacgaccgaacgtccgtaccgtccctcgtactaccgtccttcgtccctacccg

SEQ ID NO: 133349 - DNA, 681 bp, Homo sapiens
  misc_feature: GYAE6OF01BGP8O.17.33.C11.1.454.CMB.1.raw
  modified_base (300)..(300): a, c, t, g, unknown or other
  misc_feature (300)..(300): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactataccaaactggttccagtcagaacctggaacaagcacccagggcactcatttanagtacaaacaacaacactcctcggacccctgacccgattctcacggtcctccctccgttcggggacaaacgctgccctgacctacgtgtctggtgtcgcgacgtccgtggacgggacgaaggtctacgtacttattaccgtcgtacccttaccttacgttacgtttgggttacggttcggtacttggttcgttacgtacgtttcggggaccggttaacgggaccgtaaggtcccgttacgggacccgtttaccggttaaacgtacccgtaccggtaccccgaaacgggtcccggttcccggtacccccccggttcgggtacccttacccgttcccgttaccccgtttaccccccgtcccccgttccccgtttaacccccgg

SEQ ID NO: 133350 - DNA, 532 bp, Homo sapiens
  misc_feature: GYAE6OF01B5EWY.17.33.C11.1.454.CMB.1.raw
  modified_base (519)..(519): a, c, t, g, unknown or other
  misc_feature (519)..(519): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcacccagggcactcatttatagtacaaacaacaaacactcctgacccctgcccgattctcagcctccctcctggggcaaagctacgccctgacactgtctggtgtgcagcctgaggacgaggctgactatactcgccttactctacgtttggtgtgctgtgctagttcggcggagggaccaagctgaccgttgtagtcagcccgaaggctccgccccgtcgtccacttctccgttccccnccctccctacccg

SEQ ID NO: 133351 - DNA, 582 bp, Homo sapiens
  misc_feature: GYAE6OF01CGG6N.17.33.C11.1.454.CMB.1.raw
  modified_base (298)..(298): a, c, t, g, unknown or other
  misc_feature (298)..(298): n is a, c, g, or t
  modified_base (449)..(449): a, c, t, g, unknown or other
  misc_feature (449)..(449): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattanagtaacaaacaaacaaacactacctacggacccctgcccgattctcacgcctccctccgttacggggacaaagctcgccctgacacgtgtctggtgtgcagcctgaggacgagcgtagactattactcgtacctactcgtactttggtgtncgtgtgtcttagttcggacgggtacggaccgaagccgtacggaccgttacgtaaggtccgaacggtcccgaaacggtcccgtccgtccccccgtcggttacccaccttcccgttccgttccccctaacccccg

SEQ ID NO: 133352 - DNA, 668 bp, Homo sapiens
  misc_feature: GYAE6OF01BWD96.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaacctggacaagcaccaggcactcatttatagtaacaaacaacaaacactacctacggacccctgcccgattcctcacggcctcccgtccgttagggggcaaacgctcgaccctgacctactcgtcgtggtcgtcgcgacgcccgtaggacggacggaggtactacggtaccttaagtttaccgtcgtacccttaccgttaccgttacgttttgggtcgggttgtccgttggtacgtcgttacggttccggggtaccgggtaacggggaaccgaacggtccgtacggtaacccgttacgttaacgtaccgtaccggtacccgtaacggccgttccccggtcccccgttaccgggtccctacccgttccttacccgttcccccaccccgtttccccgttacccg

SEQ ID NO: 133353 - DNA, 510 bp, Homo sapiens
  misc_feature: GYAE6OF01DNBFF.17.33.C11.1.454.CMB.1.raw
  modified_base (392)..(392): a, c, t, g, unknown or other
  misc_feature (392)..(392): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctgaacagcaccaggcactcattatagtacaaacaacaaacactctggaccctgcccgatctcagctcctccgtggggcaaagctgccctgacactgtctggtgtcgcagcctgaggacgngctgactatactgcctactcttacttggtgtgtctgtgtctagtcggcggacggaccaagctgaccgtacttagcagcccgaagcctcgcccctcggtacacttctcgtccccgtccc

SEQ ID NO: 133354 - DNA, 633 bp, Homo sapiens
  misc_feature: GYAE6OF01EAC3C.17.33.C11.1.454.CMB.1.raw
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (371)..(371): a, c, t, g, unknown or other
  misc_feature (371)..(371): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtaacaaacaacaaacactccncgacccngccgtattctcaggcctcccgtccgttggggacaaagctcgcctnacactgtctggtgtcgcacgcctaggacggacgaggcgtacgaacttattacgtcgtacctacttcgttacgtttgggtgtcgtcgttcggtgtaccgttagttcgggtacgggtacgggaaccgaacgtccgtacggtaccgtttacgttaaacgtaccgtaaccggacccgtaaggcccgttcccggtaccccccgttcgggtacccttaacccgttccgttacccgtttaccccctccccgttccccgtttaaccccgg

SEQ ID NO: 133355 - DNA, 527 bp, Homo sapiens
  misc_feature: GYAE6OF01ERYZU.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcatttatagtacaaacaacaaacactcctggacccctgcccgattcctcaggcctccctccgttggggacaaagctgccctgacactgtctggtgtgcagccgtgaggacggagctgactattacgtgtcctacttctacgtttggtgtgctgtgctagtcgcggaggaccagctagaccgtactacgtcagccgaacgctacgcccccgtcgtccactcttcgtcccctacccc

SEQ ID NO: 133356 - DNA, 589 bp, Homo sapiens
  misc_feature: GYAE6OF01AZX5I.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacacgtggagcagtcaccagtgcttactactccaaactcggttccagcaagaaacctgaacaagccacccgagggcactcatttatagtacaaacaacaaacactcctcggaccctcgccgtatctcacgcctcccgtccgtcggggacaaacgctcgcctcgactctgtcgtgtgtgcacgccgtgaggacgacggctagactacttacgtcgtacctacttcttacgtttggtgtcgtcgtcgtgtcgttacgttcggacgggtacgggaccgagtcgtacgtaccgttacttaacgtccgtacgacccgacggccgtcccggaccccgtccggtaccaccgttccttccgttcccctacccccg

SEQ ID NO: 133357 - DNA, 607 bp, Homo sapiens
  misc_feature: GYAE6OF01AZND8.17.33.C11.1.454.CMB.1.raw
  modified_base (275)..(275): a, c, t, g, unknown or other
  misc_feature (275)..(275): n is a, c, g, or t
  modified_base (350)..(350): a, c, t, g, unknown or other
  misc_feature (350)..(350): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggagccctcactgactgtcgtccccaggagggacagtcactctcacctgtgcttccaacactggagcagtcaccagtgcttacatccaaactggttaccagcagaaaccnggaacaacgcacccaggcactcatttacagtaacaaacaacaaacactccgtacggacccctgccccgtattccncgacggcctccctcggttacggggactaacgctacgccctgaccacgtgtcgtgtcgtgcgacgccgtagacggtacgacggtcgtacggtaacttacgtacctacgtcccgttaacttccgttacgtttgggtcggtcgtctgtcgtcgtacgttcgggcggacgggacgacgtcgtgtaccgttacgtacgtccgacgacccgtaacggccgtaccgcccccgttcggtcccaaccgtctccggttcccctcccg

SEQ ID NO: 133358 - DNA, 715 bp, Homo sapiens
  misc_feature: GYAE6OF01CK2P4.17.33.C11.1.454.CMB.1.raw
  modified_base (317)..(317): a, c, t, g, unknown or other
  misc_feature (317)..(317): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtgtccccaggagggacagtcactctcacctgtgcttccaacactggagcagtcaccagtcgcttaactactaccaaaacgtcggttccaggacaacgaaacctggaacaagccacccgaggccactactatttanaacgtaacaaaacaaacaaacctacgtacccgtacggaccccctcgaccccgtaacttcctccgaacggcccttaccccgttcccggttacgggggaacctaaaacggccgttaccgacccttacggacctacgtgttcgtgggtgtcgcacggccgtaggaacggacggaggacgtacgtacttaacttacctcgtacccttaccttacgttacgtttgggttcggtcgtcgttggtcgtacgttacgttccgggacgggtaacgggaccgaacggtaccgtaccgtaccggttacgttaacggtaccgaaccggtacccgaaacgggttcccgtacccggtccccccgttaccgggtaccctaccttcccgttccccgttacccccgttacccccg

SEQ ID NO: 133359 - DNA, 600 bp, Homo sapiens
  misc_feature: GYAE6OF01EHRSI.17.33.C11.1.454.CMB.1.raw
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagcacccaggcactcatttanagtacaaacaacaaacactccnggacccctgcccgattcncagcctccctcgtggggacaaagctcgccctgacacgtgtcgtggtgtgcagccgtaggaggacgaggctgaactattactgcctactcttacgttttggtggtgtcgtgtgtcgttaggttcggacgggaagggaccaaggtcgtacggtaacccgttacgttaaacgtcctaacggaccccgaagggtcccgttccggcccccccgttaccgggttaccctaacccgttcccgttcccgttaccccccgttacccccg

SEQ ID NO: 133360 - DNA, 554 bp, Homo sapiens
  misc_feature: GYAE6OF01EFKV5.17.33.C11.1.454.CMB.1.raw
  modified_base (230)..(230): a, c, t, g, unknown or other
  misc_feature (230)..(230): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggancagtcaccagtgcttactactccaaactggttccagcagaaacctggacaagcacccagggcactcatttatagtaacaaacaacaaacactcctcgacccctgcccgattctcacggcctccctcgttggggcaaagctgccctcgacacgtcgtctgggtgtgcagccgtgaggacgaggctgactattactgcctactcttacgtttggtggtgctgtgcttagttcggcggagggaccaagctgacccgttattaacgtccagacccaaggccctccggcccccgtcggtccacccttcgttccgttcccctaccccccg

SEQ ID NO: 133361 - DNA, 591 bp, Homo sapiens
  misc_feature: GYAE6OF01EE9PV.17.33.C11.1.454.CMB.1.raw
  modified_base (224)..(224): a, c, t, g, unknown or other
  misc_feature (224)..(224): n is a, c, g, or t
  modified_base (261)..(261): a, c, t, g, unknown or other
  misc_feature (261)..(261): n is a, c, g, or t
  modified_base (343)..(343): a, c, t, g, unknown or other
  misc_feature (343)..(343): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacancctggagccagtcaccagtgcttacctaatccaaacnggttccaagacagaaacctggacaacgcgacccaaggcacttcatttacaagtacaaacaacaaacactacctggacccctncccgatctcacgctccgctaggggcaaacgctgaccctgacactgtctgngnagacgtcagaggacgacgtgtacgacttacttacgtctacctacgtcttacgtttgtaggtcgtacgtgtcgtacttacggttcggaggaccggtaacgtaacgtcgttacggtaccgttacgttaacgtacgaccgtacccgaacggtcgtcccgtaccccggtcggtacctacccgttcgttccggtacccccg

SEQ ID NO: 133362 - DNA, 615 bp, Homo sapiens
  misc_feature: GYAE6OF01D7Q0O.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgccttccaacactggagcagtccaccagtgctttaactataccaaacgtggttccagcaacgaaacctgacaacgcacccgaggcactctatttatagtaacaaacaaacaaactactacctcgaccctgccctacttctcacgcctccctccgttggggacaacgcgtcgccctgacactgtcgtggtcgtgcacgtccgtggtaacgggacgaggtctacgacttacttacgtctaccgttacttcgttacgtttggtcgttcgtgtgtcgtacttaggtcgggaccggtagggaccaggtcgtacgtaccgttacgttaacgacgacgtacccgagggtccctcccgtccccgttccgtacctaccttctacccgttcccctacccttcccgttacccg

SEQ ID NO: 133363 - DNA, 785 bp, Homo sapiens
  misc_feature: GYAE6OF01C8PLJ.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctcgcccagggtccaattctcagactgtggtgactcaggacgccctcactgactgtcgtcccagggaggacagtcactctcacctgtgccttaccaacactggagcacgtcacctagtcgtactttaactactaccaaacgttcggttaccagacaacgaaaccgtaggaacaacgccaccgaggcactctaatttataacgtaacaaacaacaaaccactaccgtacgaccctcgaccgtatccgtcgacggtcctcccgtcggtacggggtaccaaacgtcctcgaccctagacctacgttcggtacgttacgggttcgtacgacgtacggtaccgtacggaacgggacggtacggtacggtaacgttaaccttaacgtttaacgttccgtacccgtttaccgtttaccgttttaacggttttacggggtcgggtttacgttccgtttagggtaccggttaccgtttacgggtttacccgggggaacgggtacgggtaaccgaacggttccgttaaccggtacccggtttaacgttaaacggtcccggtaaccggaacccggtacgggttaccccgttaccccgggtaccccccgttcggggttaaccctacccggtttacccgtttcccccggttccccccggtttaccccccg

SEQ ID NO: 133364 - DNA, 583 bp, Homo sapiens
  misc_feature: GYAE6OF01CZ8OX.17.33.C11.1.454.CMB.1.raw
  modified_base (335)..(335): a, c, t, g, unknown or other
  misc_feature (335)..(335): n is a, c, g, or t
  modified_base (443)..(443): a, c, t, g, unknown or other
  misc_feature (443)..(443): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcacagtgcttactatccaaatggttccagcagaaacctggaacaagcacccagggcactcatttatagtacaaacaacaaacactcctggacccctgccgattcncagctccctccgttgggggcaaagctgccctgacactgtctggtgtgtcgagtcctgacggacgagggctgtaactattactcgccttactctacgtttggtggtgtnttgtgtcgttacgtttcgggcggtaggggaaccctaaggccgttagacccgttcgttaaacgtcgacgacccgaaggccgtccgccccccgttggtccctaccttcccgttcgttccccccgccctttccccgttacccg

SEQ ID NO: 133365 - DNA, 646 bp, Homo sapiens
  misc_feature: GYAE6OF01BAP4F.17.33.C11.1.454.CMB.1.raw
  modified_base (298)..(298): a, c, t, g, unknown or other
  misc_feature (298)..(298): n is a, c, g, or t
tcagcgtagactagcacgaccggtgctcgatttagagtgagctcgttgggtttggggctggcgccaggggtcccttccaatatcagtaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtaacaaacaacaaacactcctaggacccctgacccgtattcctcacggcctccctccgttgggggacaaagctcgccctgacactgtctggtgtcgcacgcctggaggacggaggctagtacttattacgtgtaccctacgttccttacgtttgggtaggttcgtcgttgtcgtcgttagttcgggtaccgggacgggaacccgtaaggccgttacggtacccggttacgtttaaacggtacccgaacgggtaccccgaacgggtccgtccccggtacccccccgttacgggttacccttacccgttacccgtttcccgtttacccccgacccccgtttacccccg

SEQ ID NO: 133366 - DNA, 726 bp, Homo sapiens
  misc_feature: GYAE6OF01ADIHY.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttaccaacacgtggagcagtcaccagtcgcttactactaccaaacgtggttaccagcaagaaacctggaacaacgcacccgaggcacgtctattataagtaacaaacaaacaaacacctccacggacccctcgacccgtacttcctacgacgccctaccctcggttcggggactaaagctacgccctagacctacgttgtcgttgggtcgtcgacacggccgtaggaacgggacggaacggtcgtacgtaacttaacgttaacgtcggtacccttacgttaccgtttacggttttcgggtcgggttcgtcgttcggttacgttccgtttaacgggtttccggggaacgggtaaccggggaacccgtaaacggtccggttaccggttaacccggtttaacgttaacggttaccgaacccgggtaacccgtaaccgggttccctacccggttccccccgttacggttaccctacccgtttcccggtttcccggttcccccgttaccccccg

SEQ ID NO: 133367 - DNA, 592 bp, Homo sapiens
  misc_feature: GYAE6OF01A4AP6.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctgacaagcacccaggcactcatttatagtacaaacaacaaacactcctcggacccctgcccgattctcagcctccctcgtggggcaaagctcgccctgacactgtctggtgtgcacgcctggaggacgaggctgtactattactgcctactctacgtttggtgtgcgtgtgcttgttcggcgggagggacccaagtcgtacggtacccgttacgtttaaacggtcctaacggaccccgtaacgggtcccgttacccggtccccccccgttccgggtacccttaacccgttcccgtttcccggttccccccggtcccccccg

SEQ ID NO: 133368 - DNA, 625 bp, Homo sapiens
  misc_feature: GYAE6OF01AI2G3.17.33.C11.1.454.CMB.1.raw
  modified_base (307)..(307): a, c, t, g, unknown or other
  misc_feature (307)..(307): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacactggagccagtccaccagtcgcttactatccaaactgttccagcacgaaacctggacaagaccacccagggcactctattanacgtaacaaacaacaaacacctaccacgtaccctacgacccgtacttacctcacggccttccccgtccgttcggggacaaacgcctacgccctacgactacgtgtcgtcggttcgtcgcacggccttaggaccgggtacggaggtacctgtaacttacgttactcgtcccttactacgttcgtttcggtgttcggcgttcgtgtcttacggttcgggacgggtacggacctaacggtcgtacgtaccgttacgttacgtcgacgccgaacggtccgtcccgtacccgtccgtacaccgttccgtcgtccccgtacccg

SEQ ID NO: 133369 - DNA, 522 bp, Homo sapiens
  misc_feature: GYAE6OF01A5PMP.17.33.C11.1.454.CMB.1.raw
  modified_base (299)..(299): a, c, t, g, unknown or other
  misc_feature (299)..(299): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccaggcactcattanagtacaaacaacaaacactcctggacccctgcccgattcctcacggctccctccgttggggcaaagctgccctgacactgtctggtgtgcagcctgaggacgaggctgactattactgcctactctactttggtgtgctgtgctagttcggcggagggaccaagctgaccgtcttaagcagcccgaggcctcgcccccgtcggtcactctcgttccctacccc

SEQ ID NO: 133370 - DNA, 616 bp, Homo sapiens
  misc_feature: GYAE6OF01CB99B.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcagaaacctggaacaagcacccgagggcactcatttatagtaacaaacaacaaacactcctacgacccctcgaccccgattctcgacggtcctcccgtccgttcgggggacaaacggctcgccctgacctactcgtcttggtgtgcacgccgtgaggacgaggctagtacttaattactcgtacctaccttcttacgttttagggtggttcgtgttgtcgtcttagttccgggacgggacgggaccgaagtccgtacggacccgttacttaacggtccgacgacccgtaaacggtcctcccggtcccccgtcggtaccgtacccttcccgttccgttcccccggtcccccg

SEQ ID NO: 133371 - DNA, 566 bp, Homo sapiens
  misc_feature: GYAE6OF01EOTGN.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactaccaaactggttccagcagaaacctggacaagccacccagggcactcatttatagtacaaacaacaaacactacctcgacccctcgcccgattcctcacggcctccctcgttggggacaaagctcgcctgacacgtgtctggtgtgcagcctgaggacgaggctgacttactacgttcacctacttcttacgttttcggtgggtcgtcgtgtcgtctagttcgggacggtagggaccaagcgtcgaccgttagttaacgtcagacccgtaggcctccgcccccgtcgtacctacctcttccgtccccgtacccccg

SEQ ID NO: 133372 - DNA, 612 bp, Homo sapiens
  misc_feature: GYAE6OF01EKYKQ.17.33.C11.1.454.CMB.1.raw
  modified_base (170)..(170): a, c, t, g, unknown or other
  misc_feature (170)..(170): n is a, c, g, or t
  modified_base (220)..(220): a, c, t, g, unknown or other
  misc_feature (220)..(220): n is a, c, g, or t
tcagcgtagactagcacgaccggtgctcgatttagagtgagctcgttgggttgggggcgccagggtcccttccaatatcagcaccatggcctggactcctctctttctgttcctccgtcaccttgctgcccagggtccaattctcagactgtggtgactcaggagccctnactgactgtgtccccaggagggacagtccactctcacctgtgcttccaanactggagcagtcaccagtgcttacatccaaatggttccagctagaacctggacaagcaccaggacactcatttatagtacaaactaacaaacactcctacggacccctgacccgattcctcaacggctccctccgttggggacaaagtctcgccgtgacactgtcgtggtgtgcagcctgacgcgacgctgactatacgtgccttactcgttactttggtgttacgtcgttgtgtcttaagttcgggacgggtaacggaaccaaggtccgtacgtacccgttacgtttaaccggttcgaacggtccccgtaaaggtcccggttccgaccccccgttcgggtaccctaaccgttccgttaccgtttaccccccgtcccgttcccgttaccccg

SEQ ID NO: 133373 - DNA, 556 bp, Homo sapiens
  misc_feature: GYAE6OF01DSXG7.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactatccaaactggttccagcagaaacctgacaagcacccagggcactcatttatagtaacaaacaaacaaacacctacctacggacccctcgcccgattctcaggcctccctcgttcggggacaaagctgccctgacactgtctggtgtgcagccgtggacggacgaggctgactattactcgcctactcttacgtttggtgtgctgtgcgttagttcggcgggtagggaccaaggtcgtagtaccgtgttaacgtcgacgacccgaggcctccgcccccgtcggtaccacgtctccgtcccctaccccg

SEQ ID NO: 133374 - DNA, 601 bp, Homo sapiens
  misc_feature: GYAE6OF01AWJ1B.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgcttccaacactggagcagtccaccagtgcttactactccaaaactggttccagacagaaacctggacaagcacccaggggcactcatttataagtacaaacaaacaaaacactacctaggacccctgccccgtaattcctcaacggcctccccgtcctttcggggggaccaaaacgctcgtcccctagaccaaccgttcgtccgttagggtcgtgcgaagccgtggtacgggacgagggtctacgaacttacttaactcggcctacttcttactttgggtcgtgcttgtgtcgtagttccggcgggtacgggaccgaagcgtacgaccgtcttaacgtccgagacccgtaggcctcggcccccgtcgtcacctctcgtcccgtccccg

SEQ ID NO: 133375 - DNA, 628 bp, Homo sapiens
  misc_feature: GYAE6OF01BRH0B.17.33.C11.1.454.CMB.1.raw
  modified_base (297)..(297): a, c, t, g, unknown or other
  misc_feature (297)..(297): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttccaacactggagcagtcaccagtgcttacatccaaactggttccagcagaaacctggacaagcaccagggcactcatttanagtaacaaacaacaaacactcctacggacccctgacccgtattctcacgctcccgtccgttggggacaaacgctcgccctagacactgtctggtctcgcgacgccgtgacggacgaggctagtactagttacgtgtcctacttcttacgtttggtcggtgtcgttgttgtacgttagttccgggacggtacgggtaccgaaacgtccgttacggtaccgttaccgtttaaacggtcctaacgggtaccccgaaacgggttcccgtacccggtaccccccgttccgggtacccttaccgttacccgttcccgttaccccccgttaacccccg

SEQ ID NO: 133376 - DNA, 527 bp, Homo sapiens
  misc_feature: GYAE6OF01DWO82.17.33.C11.1.454.CMB.1.raw
  modified_base (295)..(295): a, c, t, g, unknown or other
  misc_feature (295)..(295): n is a, c, g, or t
  modified_base (333)..(333): a, c, t, g, unknown or other
  misc_feature (333)..(333): n is a, c, g, or t
  modified_base (377)..(377): a, c, t, g, unknown or other
  misc_feature (377)..(377): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtacaaacaacaaacactcctggacccctgccgatcncagctccctcgttggggcaaagctgcctgacactcgtactggtntgcacgcctaggaggacgagctagacttatacctgccttactcttacgtttggtgtgcttgtgctacgtcgggcggaggaccagctgaccgtgtacgtcacgcccaaggctcgcccccgtgtcctctctacgttcccgccctccgtaccg

SEQ ID NO: 133377 - DNA, 779 bp, Homo sapiens
  misc_feature: GYAE6OF01AV4G6.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacgtatccaaactggttacccgacgcaacgtaaccgtacggaacaacgacccaaccggacgggacctactaccttaattttacgtaacgtaaacctaaaaccaaaacctaaacctaccttacccggtaacccggtacccccgtacccggtaaccccggttaacgtttcccgtaaccggtacccggtccccttaccccccgtttccgggggttcccgggggaaaccgtaaaccgtcgtacccgtaccccgtacgaaacccgttacgttcggttacggttggggtcgttcgacggtaccgtccgtagggaacgggacggtacgggtaccgtaccgtaactttaccgttacgtccgtaccctttaccgttaccttttacggtttcgggttacggtcgttcggttgtactacgttacggttccggggtacgggaccgtacgtagtaccgaccgtacgttacgtacgtacgaccgtaccggactccggtccccgtccccgtcgtccgtaccttcgttacccctaccccttccgtcccttaccg

SEQ ID NO: 133378 - DNA, 633 bp, Homo sapiens
  misc_feature: GYAE6OF01C07YL.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctgacaagcacccaggcactcatttatagtaacaaacaacaaacacctcctcggacccctcgcccgattctcaggcctccctcgttggggcaaagctgccctgacactgtctggtgtgcagcctgaggacgaggctagacttattactcgccttactcgtttacgtttggtcggtgtcttggtcgtcgtagtttccgggcggggtaacgggacccgtaaacggtccgttagggtaccccggtttagttaaaccggttaccgtaccggacccccgtaaaggggtcccctacccggtacccccccggttcccgggttccccgaaccttttccccgttcccggtttcccccccgttaacccccccg

SEQ ID NO: 133379 - DNA, 610 bp, Homo sapiens
  misc_feature: GYAE6OF01EA9WT.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcaccaggcactcatttatagtacaaacaacaaacactcctcgacccctgcccgattctcacggcctccctccgtggggacaaacgctcgccctgacactgtctggtgtgcacgctggaggacgaggctagacttattactcgtccttactcttacgtttggtggttcgcgttggtcgtacgttagttccggggtacgggtaacgggaccctaaggccgtacggtaacccgttccgttaaacgtaccgacggtaccccgtaaggcccgttccgccccccgttcggtaccctaccgttcccgttcccgtttcccccgtccccttcccgttacccg

SEQ ID NO: 133380 - DNA, 666 bp, Homo sapiens
  misc_feature: GYAE6OF01EJ028.17.33.C11.1.454.CMB.1.raw
  modified_base (229)..(229): a, c, t, g, unknown or other
  misc_feature (229)..(229): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggaacaacgcaccagggcactcatttatacgtaacaaacaaacaaacacctacctcggacccctcgaccccgattcctcacggacctccctccgttcgggggacaaacgctcgcccgtagacctactcgtctggtgtgcacgccgtaggacggacggacggtcgtagtaaccttagttacgtcgtacccttacttccgtttaacgttttgggtaggttggtccgttggtcgtaccgttaggttccgggacgggaacggggaaccaacggtacttacgggtacccgttacgttaacggttcccgtaacggaccccggtaacgggtccgttaccccggccccccgttccgggtaccctaacccgttcccgttcccggttcccccgttaccccccg

SEQ ID NO: 133381 - DNA, 771 bp, Homo sapiens
  misc_feature: GYAE6OF01BLDMG.17.33.C11.1.454.CMB.1.raw
  modified_base (336)..(336): a, c, t, g, unknown or other
  misc_feature (336)..(336): n is a, c, g, or t
tcagcgtagactagcacgaccggtgctcgatttagagtgagctcgttgggttgggggcgccaggggtcccttccaattatcagcaccatggcctggactcctctctttctgttcctcctctacttgctgcccagggtccaattctcagtacttgtggtgtactcgaggacgccctcacgtagactgtcgtacccgagggagggacagtcactctcctaccttgtcgtccttacccaacgtacgtgggtacgacgtacgtaccaccgtgtcgtcttaacgtactaccaaacgttcggtacgagacaacgaacgtggaacacgccaccgaggcacgtntaatttataacgaacaaacaacgtaacacctccgtcgacccctcgaccctacttcacgacgtcctcccgtcggtacggggactaacggctaccgtccgtacgacctacgttcgttacgtcggtgtacgcgtacggtacgtcgggaacgggacggacgttcgacgttaacttacgtttacctcgttaccgttacctttacgtttacgggtttcgggttcggttcgttacgttgggttcgttacggttaccgggttccggggaccggggttaaacgggaccgtacggtaccggtacggttacccggtttaacgttacggtaacccgtaccggtaacccggtacggtccccggttacccccggtcccccggtacggttacccgtacccgtttcccggttaccccgtttccccccggttcccgttccccggtttacccg

SEQ ID NO: 133382 - DNA, 669 bp, Homo sapiens
  misc_feature: GYAE6OF01D2W9T.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtcccaattctcagactgtggtgactcaggagccctcactgactgtcgtccccaggagggacagtcactctcacctgtgcttccaacactggagcagtcaccagtgacttactataccaaactcggttccagacaagaaacctggaacaacgccacccgagggcactctaatttataacgtaacaaacaaacaaacactaccgtacggacccctcgacccgtattccacgacggtcccttcccgtccggttacgggggacaaacggtcctacgcccgtagtacctacgtagtctgggtcgtcgcgacgtccgtaggacggacggaggctagtaacttacgtacgtcgtccttacttcgttacgtttgggtggtcgtcgttcggtgtacgttacggttacgggcgggtaacggtacgtaacggtccgttacggtacccgttaacgttaacggtccgaacggtacccgtaacgggccgtacccggacccccgttcggtaccctacgtttcccgtcccgttcccccgtacccccg

SEQ ID NO: 133383 - DNA, 664 bp, Homo sapiens
  misc_feature: GYAE6OF01CWLTT.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtgccttaccaacactggagcagtcaccagtcgcttactataccaaactcggttccagacagaaacctggacaacgcaccgaggacactactattatacgtaacaaacaacaaacactacctacgacccctcgccgtaatctacacgtcctcccgtcgttggggacaaacgcctacgcccgtacgactcgttcgtcgtcggtgtacgacgacgccgtaggtacggacgtacggtcgtacgtacttacttaaccgttcgtacccgttaacttaccgtttaacgttttcgggtagggttcgtcgttcggttacgttacgttcgttaccggggtacggtaacggggacctaacggtccgtaacggtaccgttacgtaacgtcgaccgtaccggaaccggtccctcccggcccgttaccggtactacccgttcctcccgttaccccgttaccccg

SEQ ID NO: 133384 - DNA, 682 bp, Homo sapiens
  misc_feature: GYAE6OF01B4ZAR.17.33.C11.1.454.CMB.1.raw
  modified_base (299)..(299): a, c, t, g, unknown or other
  misc_feature (299)..(299): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttaccaacactggagcagtcaccagtgcttactataccaaactggttccagcaagaaccgtggacaagcaccgaggcactcatttanagtacaaacaacaacactcctcgaccctcgaccgtatctcgacgccttcccgtcgttggggacaacgctcgcctcgactcgtgtcgtggtgtcgcgacgccgtaggacggacggtaggccgtagacgttacttacgtacgtccttaaccttcgtttaaccgttttgggttacgggttcgtcgtttggttcgttaccgtttacggttaccggggtaccggggaacgggtaacccaagggtccgttaccggtaacccggtttacgtttaacggtaccgaccggtaccccggtaaacggtccgttccccggtacccccggttccgggtacccttacccgttacccgttacccgttacccccttacccccgttcccccgttaacccg

SEQ ID NO: 133385 - DNA, 562 bp, Homo sapiens
  misc_feature: GYAE6OF01DFAAV.17.33.C11.1.454.CMB.1.raw
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtcgcttactatccaaaactggttccagcagaacctggacaagcacccgaggcactcatttanacgtaacaaacaacaaacactacctcggacccctgacccgattcncacggctaccctcgtgggcaaagctgcctgacactgtcgtggtcgtgcagccgtgacggacgacggctagacttattactgtccttactcgttactttggtggtcgtctgtgtcgtaagttccgggcggaacgggacacgcgttacgaccgttactaacgtcacggaccgaaggccctccggcccctcggtacaccttcctcgttccccgtccccg

SEQ ID NO: 133386 - DNA, 621 bp, Homo sapiens
  misc_feature: GYAE6OF01DP1XE.17.33.C11.1.454.CMB.1.raw
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactataccaaaactggttccagcaagaaacctggacaacgcaccgaggcactcatttanagtaacaaacaacaaacactctacgaccctgaccgattctcacgctcctcgtggggacaagctcgcctgacnctcgtcgtggtgtgcacgcctggaggacgaggctgaacttatacctcgaccttacttcttacgtttggtggtcgtcgttgtcgtacgttacggtcggggtacgggacgggaaccgtaaggtccgtcggttaacccggttacttaacggtaccgacggtaacccgaacggttccgtcccggtaccccccggttcggtaccctacccgttaccttcccggtttaccccctccccgttcccgttaaccccg

SEQ ID NO: 133387 - DNA, 622 bp, Homo sapiens
  misc_feature: GYAE6OF01AJTL4.17.33.C11.1.454.CMB.1.raw
  modified_base (229)..(229): a, c, t, g, unknown or other
  misc_feature (229)..(229): n is a, c, g, or t
  modified_base (403)..(403): a, c, t, g, unknown or other
  misc_feature (403)..(403): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactactcctaaactcggttaccagcaacgaaacctggaacaacgcaccgaggacactcatttatagtaacaaacaacaaacactcctacggaccctcgcccgtattctcacggcctcccgtcgtcggggcaaacgctcgcctagacactcgtctggtgngcacgccgtaggacggacgagtctacgacttacttaccgtcgaccttacttccttacgtttcggtggttgcgttgtcgtacgttacgttccgggacggacgggaccgaacggtcgtcggtacccgttcgttaaacgtccgtaacggacccgtaacggtcccgttaccgcccccgttacgggtccctaccgtttccgttcccgttccccgttaacccccg

SEQ ID NO: 133388 - DNA, 555 bp, Homo sapiens
  misc_feature: GYAE6OF01DSXCL.17.33.C11.1.454.CMB.1.raw
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcaagaaacctaggacaagccacccgaggcactcatttatagtaacaaacaacaaacactcctacgacccctgcccgattcncacggcctcccgtccgtcggggcaaacgctcgtaccctgacncgtgtcgtggtgtgcagcctgaggacgaggctagactattacctgtaccctacttcttacgtttggtgtgtcttgtgtcttagtcggcgggaggaccgagcgtacgaccgtcttagtcacgaccgacggcctcgccccgtgttcctatttcctccctcccttacccg

SEQ ID NO: 133389 - DNA, 574 bp, Homo sapiens
  misc_feature: GYAE6OF01AMARV.17.33.C11.1.454.CMB.1.raw
  modified_base (229)..(229): a, c, t, g, unknown or other
  misc_feature (229)..(229): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtcgcttactataccaaacgtcggttccagcaagaaacctggacaagcaccgaggcactcattatagtacaacaacaaacactcctcgaccctcgccgtattctcacgcctcctcgttcggggacaacgctcgcctcgacactcgtcgtggtgtgcacgccgtggacggacgaggtctgtactacgttactcgtccttactccttacgtttgggtcggtcgtcttcggtgtcgttacgttcgggacgggacgggacgaacgcgtcgtaccgtcgtaacgtcgacgccgaacggcctcgcccccgttcggtcctaccgtcgtccgttccctaccccg

SEQ ID NO: 133390 - DNA, 721 bp, Homo sapiens
  misc_feature: GYAE6OF01A7EB6.17.33.C11.1.454.CMB.1.raw
  modified_base (331)..(331): a, c, t, g, unknown or other
  misc_feature (331)..(331): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactggtgtccccaggagggacagtcactctcacctgtgcttccaacactggacgcacgtccaccgagtcgtacttactactactaaacgttggttccaggcaagaaaccgtggaacaagacaccgagggcactactatttataacgtaacaaanaacaaacactcctacgacccctagcccgtaatccacgacggtcctacccgtccggttacggggacaaacggtctacgccctcggaactacgtcgtacgtcgggtacgtcgtccacggtccgtaggacgggtaaccgtacgggtactacggtaaccttacgttaccgtcggttaccttaaccgttcgttaacggttttcgggtcggttacggtcgttcggttcgttacgttaacggttccgggtacgggtaaccgggtacgtaacggtaccgttcggtaacccggttacgttaacgtccggtaacgtacccggacggtacccgtacccggttacccccgttacggtttacccgttccgttcccgggtttacccccgtccccgtttcccccg

SEQ ID NO: 133391 - DNA, 620 bp, Homo sapiens
  misc_feature: GYAE6OF01AT3C4.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctgacccctgcccgattctcacgctccctcgttggggcaaagctgcctgacactgtctggtgtgcagccgtgacggacggaggctagactattactcgtccttacgttccttacgtttgggtggttgtcttggtcgtcttaggttccgggtacggggaggaacccgtaaggcgtacggtacccgttacttaacggtacctacggaccccgtaaggtcccgttccccggtaccccccgttccgggttaccctaccgtttcccgttacccggtttccccccggtccccctttcccgttacccccgg

SEQ ID NO: 133392 - DNA, 634 bp, Homo sapiens
  misc_feature: GYAE6OF01E44G0.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactccaaactggttccagcagaaacctggacaagcacccagggcactcatttatagtacaaacaacaaacactcctgacccctgccgatctcacggctccctccgttggggcaaacgctcgccctcgacacgtcgtctggtgtcgcagccgtggaggacggaggcgtagtactacgttactcgtacccgtaccttcttaacgttttcgggttggtgtcgttggttcgtccgttagtttccgggcggggtaacggggacccgtaaacggccgttacggtacccggttaccgtttaaacggtccgtacggaccccggaaacggtcccgtcccggtccccccgttccgggttaccacccgttcccttccggttcccccggttcccccccg

SEQ ID NO: 133393 - DNA, 583 bp, Homo sapiens
  misc_feature: GYAE6OF01DZK82.17.33.C11.1.454.CMB.1.raw
  modified_base (570)..(570): a, c, t, g, unknown or other
  misc_feature (570)..(570): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgacttactataccaaacttggttccagcaagaaacctggacaagcaccaggcactcatttatagtaacaaacaacaaacactcctacgacccctgacccgtatctcacggcctcccgtccgttggggacaaacgctcgcctagactacgtcgtcgtggtgtcgcgagcctaggacggacgacgactcgacttagttactcgtaccttactacgttacgtttggtgtcgtcgtgtcgtactagtcgggtacggacggaccgagtcgtacgtaccgtacttacgtacgacgacccgagcctccgccccgtgcctacctccgttccgttccccncccttccgtcccg

SEQ ID NO: 133394 - DNA, 670 bp, Homo sapiens
  misc_feature: GYAE6OF01AW5OS.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactccaaactggttccagcaagaaacctggaacaagccaccgaggcactcatttatagtaacaaacaacaaacactccacggacccctgccctattctcgacggcctcccgtcgttcggggacaaagcctcgccctacgactacgtgtccgtgggtcgtcgcgacgtccgtaggacgggacgacggctacggtaacttattaccgtcgtacccttaacttccgttacgtttgggtggttcgtacgttcggttgtccgttacggttaccgggtaccgggtaacgggaacccgtaaggtccgtacgggtaacccgtttacgttaaacggtccgaaccggtacccggaaacgggtccccgtcccggtaccccccggttacggttaccctaacccgtttccgttccccggttacccccttacccccg

SEQ ID NO: 133395 - DNA, 574 bp, Homo sapiens
  misc_feature: GYAE6OF01C8H9H.17.33.C11.1.454.CMB.1.raw
  modified_base (295)..(295): a, c, t, g, unknown or other
  misc_feature (295)..(295): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaatggttccagcagaaacctggacaagcacccaggcactcatttanagtaacaaacaacaaacactcctcggacccctgacccgtattcctcacggcctccctccgttcgggggacaaagctcgccctgacactgtcgtggtgtgcacgcctgaggacgaggctgactattactgcctactcttacgtttggtgtgtctgtgtctagttcgggcggagggaccaagctacgaccgttacgttacggtcaccgccgaaggtcctcccggcccccgtcggtccctaccttccgttaccgttcccccgtccccgttcccgttaccccg

SEQ ID NO: 133396 - DNA, 746 bp, Homo sapiens
  misc_feature: GYAE6OF01ATEV7.17.33.C11.1.454.CMB.1.raw
  modified_base (296)..(296): a, c, t, g, unknown or other
  misc_feature (296)..(296): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctggacccctgacccgattcctcacggcctccctccgttcgggggacaaagcctcgccctaggacctacgtgtcgtggtgtcgcacgccctggacgggacgacgggtctacggtaccttaacgttaccgtacgtacccttaacgttccgtttaaccgtttttgggttcgggttcggttccgtttagggttccgttaccgtttaacggtttccggggtacccggggtaacgggggtaaccccgtaaacgggtcccgtttacggtaaccccggtttaccgtttaaaacgggttcccgtaaaccgggtcccccgtaaacggggttaccccgttccccgggtcccccccccggtttacgggttacccctacccggtttaccccggtttcccggtttccccccccggtcccccgtttcccccgtttaacccccgg

SEQ ID NO: 133397 - DNA, 687 bp, Homo sapiens
  misc_feature: GYAE6OF01C3A3K.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggatagtcactctcacctgtgcttccaacactggagcagtcaccagtgcttactataccaaactggttccagacagaaaacctggaacaagcacccagggcactctaattatagtaacaaaacaacaaaacactacctcggaccccctgaccccgtattctacacggtcctaccctcggttcgggggactaaacggctacgccctagtacaccgttgttcgttgggttacggtcggaccgacggtcccgttagggacgggaacggacggtacgttacgtaacgtttacgtttaacctaccgttacccttacctttcctttaacggttttagggttgggttacgtcgtttcggttcgtacgttaggtttccggggacgggtaacgggtaccaacggtccgtacggtaccgttacgtaacggtcgacgtacccggaacggtccgtacccgtcccccgtacggttcccacttcccgttccgttcccccgtacccccg

SEQ ID NO: 133398 - DNA, 591 bp, Homo sapiens
  misc_feature: GYAE6OF01A9QP6.17.33.C11.1.454.CMB.1.raw
  modified_base (553)..(553): a, c, t, g, unknown or other
  misc_feature (553)..(553): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccgaggcactcatttatacgtacaaacaacaaacactcctcggacccctcgccgacttctcgacggcctccctccgttcggggacaaacgtctcgcccgtgacacgtgtctggtgtgcacgccgtaggaggacgaggcgtcgtactacttactcggtaccctacttcgttacgtttgggtcggtgtcgtgtcgtcgttacggttcgggacgggtaggaccgaagtcgtcgtaccgttacgttaacgtcgaccgtacccgacggtcgtcccnccccgtcggtccaccgtttcctccgttcccctaccccg

SEQ ID NO: 133399 - DNA, 789 bp, Homo sapiens
  misc_feature: GYAE6OF01DTT5I.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgccttccaacacgtggagcagtcaccagtgtacttactactaccaaacttcggttaccagacaacgaaaccgtacggaacaacgaccaaccccgagggccacttctattttaataacgttaacaaaacaaacaaaaccgaccttacccgtaccggacccctacgaccccgtacttcctacgacggtccttaccccgtccggttcgggggaaccgaaacgtccttacgcccgtacgtaacctaccgttacgttccgttgggttacgtggaccgtacggccgttagggaacgggtacggacgggtactacggtaacgttaacgttaccgttccgttacctttaccgtttaccgtttacgtttttgggtacgggttcggtcgtttaggttcgttacggttacggttccggggacgggtaaccggggaacccgtaagggtccttacgggtacccggtttaccgttaaacggtaccgaccgggtaaccccgtaacgggtcccgttccccgcccccggttcccggttacccttacccgttcccgtttacccggtttcccccgttccccgttccccgttacccgg

SEQ ID NO: 133400 - DNA, 748 bp, Homo sapiens
  misc_feature: GYAE6OF01B106G.17.33.C11.1.454.CMB.1.raw
  modified_base (225)..(225): a, c, t, g, unknown or other
  misc_feature (225)..(225): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
tcagcgtagactagcacgaccggtgctcgatttagagtgagctcgttgggttttgggctggcgccaggggtcccttccaatatcagcaccatggcctggactcctctctttctgttcctcctcacttgctgcccagggtccaattctcagactgtggtgactcgaggacgccctcactgactgtcgtcccaggaggacagtcactctcactgtcgcttaccaacnctggacgcagtcacctaggtctacttactactacctaagttcggtaccagacaagtaaccnggaacaagccaccgnggcactactatttagtaactaacaaactaaccaaacacctaccgaccggaccccttacggaccttacttacgaccgacggtccctcccttacgggttcggggaacctaaacggtcctaccgtacccgtacgaccgtacgtttcggtcggttaccggtgtacgaccgtacggtaccgtaacgggacgggaccggtaacggtaccgtacggtaacgttaacgttacctacggttaccccttaaccgttaccgtttaccggtttggttacgggttagtcgttggtccgttacggtacggttaccgggaccgggtacggtaacccgacggttccggtaacgtacccggtttacgtaacggttaccgaaccggtacccgtaaacggtcccgtccccggttacccccggtcgtaccccgttaccgttcccgttcccgtccccggttaaccccc

SEQ ID NO: 133401 - DNA, 583 bp, Homo sapiens
  misc_feature: GYAE6OF01BJ6PL.17.33.C11.1.454.CMB.1.raw
  modified_base (340)..(340): a, c, t, g, unknown or other
  misc_feature (340)..(340): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcattgactgtgtccccaggagggacagtcactctcacctgtgcttccaacactggagcagtcaccagtgcttactatccaaactggttccagcagaaacctggacaagcacccgaggcactcatttatagtacaaacaacaaacactcctcgacccctgcccgattcncacggcctccctccgttggggacaaagctgccctgacactgtctggtgtgcagccgtggacggacgacggtctaggacttacttactcgtcctactctttacgtttgggtggtcgtcgttgtgtaccgttacggttcgggcgggtaacgggacctaagcgtacgtaccgttacgttagtccgacggacccgaacggtcctccgcccccgtcggtcctaccttcctccgttccccctacccccg

SEQ ID NO: 133402 - DNA, 580 bp, Homo sapiens
  misc_feature: GYAE6OF01DRMV9.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaactggttccagcagaaactggacaagcaccaggcactcattatagtaacaaacaacaaacactacctacggacccctcgcccgattcctcacggtcctcccgttccgttcggggacaaagcgtcgccctacgacactgttctggtagtgcagcctgacggacgaggctagactagttactcgtaccttactcttacgtttggtggtgctgtcgtctagttcggcggacggacaaggtctcgtaccgttacgttaacgtcgacgacccgtaaggtcccgtaccgtcccccgttacggtaccctacttccgtccggttccccgtacccccg

SEQ ID NO: 133403 - DNA, 743 bp, Homo sapiens
  misc_feature: GYAE6OF01CNM2O.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggagggacagtccactctcacctgtgcttccaacactggagcagtcaccagtgcttactataccaaactcggttccagacaagaaacctggaacaagccacccgagggccactctatttataacgtaacaaacaaacaaaaccactaccctacggaccccctcgacccgtaacttcctaccgacggtcctccccgttacccggttacggggggaacctaaaacggtcccgttacggtaccccctacggtaccctaaccgtttcggttcccgttgggttcggttacggtacccgacggtaccccgtaagggaacggggaaccggaacggtcgtaacggtacttaaactttacgtcggtacccttaccgtttaccgtttacgttttggggtacggttgtccgtttagggttcgtacgttacggttccgggacgggtaaccgggaccgaaagtccgtacggaaccgttagttaaaccggtcaaccggacccgaacgggtcctaccccggcccccgttcggtacctaccgtttccctcccggttcccccgtacccc

SEQ ID NO: 133404 - DNA, 635 bp, Homo sapiens
  misc_feature: GYAE6OF01CDLOZ.17.33.C11.1.454.CMB.1.raw
  modified_base (226)..(226): a, c, t, g, unknown or other
  misc_feature (226)..(226): n is a, c, g, or t
  modified_base (396)..(396): a, c, t, g, unknown or other
  misc_feature (396)..(396): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcaccgtgcttccaacactggancagtcaccagtgcttactatccaaactggttccagcagaacctggacaagcacccgaggcactcatttatagtaacaaacaacaaacactacctcggacccctgcccgtattctcacggtcctccctcgttcggggacaacgctcgccgtgactactgtctggtgtcgcncgcctggaggcgaggtctacgactacttacgcgtccttacttcgttacgtttgggtggttcgtcgttagtcgtcgttacgtccgggtacgggaacgggtaaccgaaggtccgtacggtaacccgtttacgttaaacgtccgaaccggtacccgtaacgggtccctcccggtcccccgtcggtaccctaccgttcccgttacccgttaccccctaccccttcccgttcccgttaacccgg

SEQ ID NO: 133405 - DNA, 606 bp, Homo sapiens
  misc_feature: GYAE6OF01EZ462.17.33.C11.1.454.CMB.1.raw
  modified_base (229)..(229): a, c, t, g, unknown or other
  misc_feature (229)..(229): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactataccaaactggttccagcaagaaacctggacaagccaccagggcactcatttatagtaacaaacaacaaacactcctacggacccctgcccgattcctcaaggcctccctccgttgggggacaaagctcgccctgaccacgtgtcgtggtgttcgcacgtcctggaggaccgaggctacggacttatttacctcgccttacttcttacgttttcgggtggtcgtcgtcgtgcgttagttccgggacgggacgggaaccgaagcgtcggtaccgtaccgttaagtccgtaagacccgaagggtcctacccgccccccgttcgggttccaaccgtttcccttcgttcccccgtacccccg

SEQ ID NO: 133406 - DNA, 680 bp, Homo sapiens
  misc_feature: GYAE6OF01D2ZWF.17.33.C11.1.454.CMB.1.raw
  modified_base (229)..(229): a, c, t, g, unknown or other
  misc_feature (229)..(229): n is a, c, g, or t
  modified_base (308)..(308): a, c, t, g, unknown or other
  misc_feature (308)..(308): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttccaacactggancagtcaccagtcgcttactataccaaactcggttaccagcaagaaacctggaacaagcaccgagggcactctatttaanagtaacaaacaacaaacactacctacggacccctcgacccgtattcctacgacggtacctcccgtccggttacgggggaccaaacggtccgtacgcccgtacgacctacgttcggtacgttgggtcgtcgtacgacggtccgtaggacgggacgtacggcttacgtaacttacgttacgtcgtcccttacgttccttacgtttgggtgtgtcgttgtcgtacgttaggttacgggacgggtaacgggaccgaacggtcgtacggtaacccgttacgttaacggtccgtaacggacccggtaacggcccgtacccggtaccccccggttcggttaccctaccgtttcccgttcccgttccccgttaacccccg

SEQ ID NO: 133407 - DNA, 564 bp, Homo sapiens
  misc_feature: GYAE6OF01AUJJF.17.33.C11.1.454.CMB.1.raw
  modified_base (229)..(229): a, c, t, g, unknown or other
  misc_feature (229)..(229): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagcacccaggcactcatttatagtacaaacaacaaacactcctcggacccctcgcccgattctcacggctcccgtccgttcggggacaaacgctcgccctcgacacgtcgtctggtgtgcagccgtgaggacgaggctgactatactcgtcctactcttacgtttggtggttgcttggtgtccgttagttcgggcggtacgggaccaagtcgtcgtaccgttacgttaacgtctacgacccgacggcctccgccccgtcgtaccactcctcgttccccgtcccccg

SEQ ID NO: 133408 - DNA, 589 bp, Homo sapiens
  misc_feature: GYAE6OF01CX9RK.17.33.C11.1.454.CMB.1.raw
  modified_base (299)..(299): a, c, t, g, unknown or other
  misc_feature (299)..(299): n is a, c, g, or t
  modified_base (465)..(465): a, c, t, g, unknown or other
  misc_feature (465)..(465): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttacataccaaactggttccagcaagaaacctggaacaagcaccaggcactctaatttanaagtacaaacaaacaaacactcctcggacccctgaccccgtatctcaggtcctcccgtcgtggggacaaacgctacgccctagactactgtcgtaggtcgtgcagccgtgaaggacgaggtctagtaactattacgtgtcctactcttacgtttggtgtgcgttgngtcgtacgttcgggacggacggactaagcgtacggacgttcgtaacgtacgacgtacccgagccgtccgcccccgtcggtctaccgttccttcccggttacccccgtcccgttcccgttacccg

SEQ ID NO: 133409 - DNA, 680 bp, Homo sapiens
  misc_feature: GYAE6OF01ATT2N.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactaccaaaactcggttaccagcacgaaacctggaacaagcacccgaggcactcattatagtacaaacaacaaacactcctacgacccctgcccgattctcacggtcctccccgtcgttcggggacaaacggctacggccctacgacactcgtacttgggtcgtcgctacgccgtaggacggacgacggtctagaccttagttaccgttagaccgttaacttaccgtttacgtttgggttcggtcgtacgttggttacgtacttacggttccgggtacgggtaacggggaaccgtaacgtccggtacggtaacccggtttacggttaaaccgtcggtaaccggaccccggtaaacgggtcccgtcccggtacccccccgttccgggtacccttaacccgtttcccgttccccggtttcccccggttccccccg

SEQ ID NO: 133410 - DNA, 707 bp, Homo sapiens
  misc_feature: GYAE6OF01CSMZL.17.33.C11.1.454.CMB.1.raw
  modified_base (358)..(358): a, c, t, g, unknown or other
  misc_feature (358)..(358): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcaggagccctcactgactgtcgtccccaggagggacagtcactctcacctgtgcttccaacactggagcagtcaccagtgcttactataccaaactcggttccagcaagaaaccgtggaacaagccaccgaggacactctaatttataacgtaacaaacaaacaaacacctacctacggacccctcgccgtacttcncacggtcctcccgtacgttcggggacaaacgccgtcgccctacgactacgtcgtcgtgggtgtcgcacggccgtaggacggacgaggtacgtagtactactttaccgtcgtacccttacgttcgtttaacggtttgggttacggttcggtcgttggttacggtcgttacggttaccggggtacgggtaaccggggtaacccgaacggttccggttacgggtaacccgtttaccggttaaacggtcccgtaaccgggaccccggttaaacgggtcccgttaccccggttacccccccgttcgggttaccctacccgtttccccggtcccgtttaccccccgttacccccg

SEQ ID NO: 133411 - DNA, 640 bp, Homo sapiens
  misc_feature: GYAE6OF01D1SAN.17.33.C11.1.454.CMB.1.raw
tcagcgtagactagcacgaccggtgctcgatttagagtgagctcgttgggttggggctggcgccaggggtcccttccaagtatcagcaccatggcctggactcctctctttctgtttcctcctcacttgctgcccagggtccaattctcagacgtgtggttgactcaggacgccctcactgactgtcgtcccgagggagggacagtccactctcacctgtcgcttccaacactggatcacgtccaccagtgtacttaactactacctaaacgttcggttaccagacaaacgaaaccgtggaacacgccaccgacggcacgtctattatacgtaacaaacaacaacactccgtcggaccctcgaccgtattcacgacgaccgtccgtcgtggggacaacgtctcgcctcgacactcgtcgtcggtcgcgcacggtccgtaggacgggaacggacgtcgtcggtacttagttacgttcgtaccttacgttccgtttacgtttggtcgtcgttcgttcgttcgttacgtcgggtacggtacgggaccgtacggcgtacgtaccgttacgtaacgtaccgacggtacccgaggtccgtacccgcccctcggtcctacgttccgtcccgttccctacccttcccg

SEQ ID NO: 133412 - DNA, 747 bp, Homo sapiens
  misc_feature: GYAE6OF01A7A5K.17.33.C11.1.454.CMB.1.raw
  modified_base (194)..(194): a, c, t, g, unknown or other
  misc_feature (194)..(194): n is a, c, g, or t
  modified_base (370)..(370): a, c, t, g, unknown or other
  misc_feature (370)..(370): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggagccctcactgactgtcgtcccgaggnggacagtcactcgtcaccgtgtcgccttcaacacgtggacgcacgtcaccagtcgtacttactactaccaaacgttcggtaccagacaagtaaacctggacagaccaccgaggacactctatttacaacgtaacaaacaacaacctactaccgtacggaccctgacccgtattccncgtacgccgtccgtcggtagggactaacgcgtacgacctacgacctagtcgtacggtggtacgttcgaccgtacggtccgtaagggacggtaccgcgggtacgtacgtaactttacgttaaccgtccgtaccctttaacggttaccgttttaacggtttgggacggtttccggtcgtttacgggttcggtaaccgggttttacggttaccgggggtaccggtaaaccgggttaccgtaaacggtcccgttaaccgggttaaacccggtttacgttaaccggtacccgtacccggtaacccgggtaaccgttcccgtaccccgttacccccgttcggtacctttaacccgtccggttaccccttccccgttacccccg

SEQ ID NO: 133413 - DNA, 850 bp, Homo sapiens
  misc_feature: GYAE6OF01BVZAS.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtccccgagggaggacagtcactctcacctgtcgcttaccaacacgtaggacgacacgtaccaccgtagtcgtacttactaactaccctaaacgttcggttaccagaccgaaacgtaaaccgtacggaaccaacgacccgaacccggaacgggacctaaccgtaccttaattttaacgtaaaccgtaaaccaaaaacctaaaaccaaaacctacccgtacccgttaccggaacccccgttaccggaccccgttaacgttccgtaccgtaccggtacccccgttcccggttaccgggttacgggggaacctaaaccggtccttccgaccccgttgaacctacggttcgtcggttggtacgtacgtcgacgtaccggtacgggacgggaaccgtggtaccgtaacgtaacgttaacttaccgttaccgtaccgtttacgttccgtttacggtttcgggttcggtacggttcgttacggttacgtaccgttacgggtttacccggggacgggtaaccggtaaccgtaacggtacccgttacggttaacccgtttaacggttaacggtacccgtaacccggtacccggacgggttaccccgttaccccgtaccccgggttaccgtacccttaacccgttccccgtttaccccgttccccccggtacccc

SEQ ID NO: 133414 - DNA, 557 bp, Homo sapiens
  misc_feature: GYAE6OF01A8T5K.17.33.C11.1.454.CMB.1.raw
  modified_base (296)..(296): a, c, t, g, unknown or other
  misc_feature (296)..(296): n is a, c, g, or t
  modified_base (545)..(545): a, c, t, g, unknown or other
  misc_feature (545)..(545): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtacaaacaacaaacactcctcggacccctcgcccgattctcacggctccctccttcggggacaaagctgccctgacactgtctggtgtgcacgcctggacggacggaggctgactattactcgcctactcttacgtttggtaggttgcttgtgtcgttagttcgggacggtagggaccaggctcgaccgttcgttaacgtcacgcccgaaggctccgcccccgtcggtcctaccttctccgttcccncccgtcctcccg

SEQ ID NO: 133415 - DNA, 534 bp, Homo sapiens
  misc_feature: GYAE6OF01ELWDD.17.33.C11.1.454.CMB.1.raw
  modified_base (520)..(520): a, c, t, g, unknown or other
  misc_feature (520)..(520): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctccctccttggggcaaagctgccctgactactgtctggtgtgcacgcctgaggacgaggctgactattactgccctactctactttggtgtgctgtgcttagtcggcggacggaccagctcgaccgtattagtcagacccgaaggccgtcgccccctcggctacctctaccttccccncccgtccttacccg

SEQ ID NO: 133416 - DNA, 576 bp, Homo sapiens
  misc_feature: GYAE6OF01C7RIH.17.33.C11.1.454.CMB.1.raw
  modified_base (299)..(299): a, c, t, g, unknown or other
  misc_feature (299)..(299): n is a, c, g, or t
  modified_base (406)..(406): a, c, t, g, unknown or other
  misc_feature (406)..(406): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctgacccctgcccgattctcaggcctccctccgttggggacaaagctcgccctgacactgtctggtgtgcacgcctaggacggacgnggacttgactacttactcgcctactcttacgtttggtcggtgcgttgtgtcttagttcgggacgggtacggaccgaaggtcctaggacccgttcttaagtccacgacccgaaaggtccgtccgaccccccgttcggtaccctaccgttccgtccgttcccgtaccccccg

SEQ ID NO: 133417 - DNA, 594 bp, Homo sapiens
  misc_feature: GYAE6OF01EXDZY.17.33.C11.1.454.CMB.1.raw
  modified_base (223)..(223): a, c, t, g, unknown or other
  misc_feature (223)..(223): n is a, c, g, or t
  modified_base (390)..(390): a, c, t, g, unknown or other
  misc_feature (390)..(390): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggttgactcaggagccctcactgactgtgtccccaggagggacagtcactctcacctgtgcttccaanactggagcagtcaccagtgcttactatccaaactcggttccagcagaaacctggaacaagccacccaggggcactacatttacgtaagtacaaaacaacaaacactcctgacccctgcccgattcctcgacgcctcccgtcgtggggacaaagcgtcgccctgaccncttcgtcctgggtacgtcgacgacggtccgtggacgggacgaacggtctagtaaccttagttaccgtcgtaccttactcttacgtttggtggtcgtcgttggtgtcttaggttcggacggaggaccgtagccgtcgtacccgtagttacgtcaccgacctaggcctcgcccccgtggtaccaccgttcctcgtccccgtccccg

SEQ ID NO: 133418 - DNA, 900 bp, Homo sapiens
  misc_feature: GYAE6OF01DDF6D.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcaggagccctcactgactgtcgtccccagggagggacagtcactctcacctgtgcttaccaacacgtggagcagtccaccgagtcgtcttactactacctaaacgttcggttaccaggaccaaacggtaaaccgtcggaaccgaaacgaccgaaccccgaacggggacctacgttactaacttttaacgtaacgtaaaccaaaaacaaacaaaacctacttaccccgtaccggaaccccgtaccgtacccgtacttaccgttccgacgggtcccttaccccggttccggttacggggggaacctaaaacggtccgttacgccccgtacgtaaccgtaccgttcggttccgttcgggttacgtacggaccggtaacggtacccggttacgggaacggggacgggtaacgggtacgttacgttaaccgttaacgtttaccgtaccggttacccgttaaccttttccggtttttaacgggttttcgggttccgggttcggttacccgttgggttaccggttaccgtttaacggggtttccgggggaacggggtaacggggtaacccgtaaagggttaccggttaacccgggtacccggtttaaacgtttaaccggtaaccggtaaacccgggtaccccggtaaaccggggtccccggttaccccgggtaccccccggtttaccgggttacccgttaaccccgtttacccggttcccccggtttacccccggtttccccccgg

SEQ ID NO: 133419 - DNA, 634 bp, Homo sapiens
  misc_feature: GYAE6OF01EMIPL.17.33.C11.1.454.CMB.1.raw
  modified_base (342)..(342): a, c, t, g, unknown or other
  misc_feature (342)..(342): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgttcccaggagggacagtcactctcacctgtgcttccaacactggagcagtcaccagtgcttactatccaaactggttccagcagaaacctggacaagcaccagggcactcatttatagtacaaacaaacaaacactcctacggaccctcgcccgattcncacgcctccctccgttcggggacaaacgtctcgccctgacactgtcgtggtgtcgcacgccgtgacgggacgaggctagacttattactcgcctacttcttacgttttcgggtggttgtcgttgtcgtacgttacgtttcgggacgggtaacggggaccgtaaggtccgtacggtacccgttaccgtttaaacggtccgtaacggaccccggtaacgggtcccgttaccccggccccccgttaccgggttcccctaacccgtttcccttcccgttccccccttaaccccccg

SEQ ID NO: 133420 - DNA, 727 bp, Homo sapiens
  misc_feature: GYAE6OF01CSQP8.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctccacctgtcgccttaccaacacgtggacgcacgtccaccagtcgtcttactactacctaaacgtggttaccagaccaacgtaaaccgtggaacaacgaccgaaccccgagggacctaccttactaatttaactaacgtaaaccaaaaccaaaccaaaccacctacccgtaccgaacccctcgaccccgtattccacgacgtccttcccgttcggtacggggacaaacggtctcgacctcgactctacgtcgtggtcgcgaccgagtccgtagggacgggaccgtacggtcttacggtaactttacgttaccgtaccggttaccttacctttacggtttacggtttggtcggttgttcgtcggttcgtacgtttcgggtaccgggacgggtacgggaccgtacggtaccgttaccggtaccgtttaacgtaacggtaccgtaccgaccggtaaccggccctccccggtaccccgttccggtacctaccccgttccgttccccgttacccccgttacccccg

SEQ ID NO: 133421 - DNA, 703 bp, Homo sapiens
  misc_feature: GYAE6OF01E0PF8.17.33.C11.1.454.CMB.1.raw
tcagcgtagactagcacgaccggtgctcgatttagagtgagctcgttgggttggggctggcgccagggtcccttcaatatcagcaccatggcctggactcctctctttctgttcctcctcacttgctgcccagggtccaattctcagactgtggtgactcaggagccctcactgactgtcgtccccgaggacgggacagtcactctcacctgtcgacttaccaacacgtggacgcaacgtccaccagtcgtccttactactaccaaacgttcggttccacgcaacgaaaccgtagaacaacgaccacccgagggacactcgtaatttaataacgtaaacaaaaccaaacaaaccacctaccctacggacccctacggaccctacttccaccgacggccttaccccgtccggttacgggggacaaacggtccgtacgtccctcggtaacctcggtgttccgtgggtacgtcgaccgtacgtcgtacggacgggacggtagtacgtacgtaccttacttacgtccgtaccttacgttcgttaccggtttgggttggtcgttccgtggtacgttcggtacggttcggggacggacggtaccgaacgtcgtaccgtacttacggttaacgccgtacggaccggtaccggccgtccccggttacccgttccggtacctaccgttcccgttccccgtccccttaccccg

SEQ ID NO: 133422 - DNA, 573 bp, Homo sapiens
  misc_feature: GYAE6OF01C49GX.17.33.C11.1.454.CMB.1.raw
  modified_base (336)..(336): a, c, t, g, unknown or other
  misc_feature (336)..(336): n is a, c, g, or t
  modified_base (385)..(385): a, c, t, g, unknown or other
  misc_feature (385)..(385): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtcgcttactatccaaactggttccagcagaacctggacaagcaccaggcactcatttatagtaacaaacaacaaacactcctcgacccctgaccattcncacgctccctcgtggggacaaagctcgcctgacactgtcgtggtgtgcncgcctggacggcgagctagacttattactcgtaccttactcttacgtttggtgtagtcgtgtgtacgtagttcgggcggacggaccagtctacgaccgttacgttacgtcacggccgaaggtccgtcccgtccccgttcggtaccctaccgttccgttacccggttccccctcccgtcccgttacccg

SEQ ID NO: 133423 - DNA, 584 bp, Homo sapiens
  misc_feature: GYAE6OF01BQIAD.17.33.C11.1.454.CMB.1.raw
tcagcgtagactagcacgaccggtgctcgatttagagtgagctcgttgggtttggggggcgccaggggtcccttccaatatcagcaccatggccctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcacccagggcactcatttatagtacaaacaacaaacactcctcgacccctgcccgattcctcagctccctcgttcggggcaacgctcgccctgactcctgttctggtgttcgctacgcccgtgacggacgtacggctgacttattactgtacccttactcttacgtttggtggtcgtcgtgtcgcttagttccgggcgggacggaccgagtcgtacgtaccgttcgttaagccgacggcccgtaaggccctccgcccccgttcggtccctaccttcctaccgttcccctccccgttcccttacccg

SEQ ID NO: 133424 - DNA, 540 bp, Homo sapiens
  misc_feature: GYAE6OF01DIBUT.17.33.C11.1.454.CMB.1.raw
  modified_base (468)..(468): a, c, t, g, unknown or other
  misc_feature (468)..(468): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatacaaaactggttccagcagaaacctggacaagcaccaggcactcatttatagtacaaacaacaaacactctcgacccctgcccgattctcagctccctcttggggacaaagctgccctgacactgtctggtgtgcagcctgaggacgaggctgactattactgcctactctactttggtgtgctgtgctagttcgggcggacgggaccaagctgaccgttnttaagtcacggccaaggcctccgccccccgttcggtcctacgttccttgttcccccaccctcccttaccccg

SEQ ID NO: 133425 - DNA, 745 bp, Homo sapiens
  misc_feature: GYAE6OF01EILHF.17.33.C11.1.454.CMB.1.raw
  modified_base (233)..(233): a, c, t, g, unknown or other
  misc_feature (233)..(233): n is a, c, g, or t
  modified_base (300)..(300): a, c, t, g, unknown or other
  misc_feature (300)..(300): n is a, c, g, or t
  modified_base (366)..(366): a, c, t, g, unknown or other
  misc_feature (366)..(366): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcnccagtcgcttaactataccaaaacgttcggttaccagcaacgaaaacctggaacaaggcaaccccgnggctactactattactagtaacaaacaaacaaacgacctaccgtacggacccctcgaccccgtacnttaccgtaccgtaccggtcccgttaccccgttcccggttacggggtaccgtaaacgtaccgttccgtcccgtaccgtaaccgtaccgttacggttcggttcggttcggttcgtaccgtaccggtaccggtacgggtaacgggacggtacggtacgttacgtacgttaaacgttacgttaccgttaccgttaccgttaccgtttacggtttggtttcgggttcgtcgttcggttacggttacgttacggttacgggtacgggtaacggtaaccgtacgtacgtacgtaccgttacgttaacgtacgtaccgtacccgacggtccgtcccgtcccgtcccgtacctaccttacccgttcccgttccccgtccccgtacccg

SEQ ID NO: 133426 - DNA, 666 bp, Homo sapiens
  misc_feature: GYAE6OF01CDKZO.17.33.C11.1.454.CMB.1.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccagggagggacagtcactctcacctgtgcttccaacnctggancacgtcaccagtcgcttactataccaaacgtcggttccagcaagaaacctggaacaagccacccgaggcactctattactagtaacaaacaaaccaaactacctaccgtacgacccctcgaccccgtattcctacgacgtccttccccgtcggttacggggacaaacggtcctaccgccctacgaccgtacgttcggtcgttgggtcgtcgtacgacgtccgtaggacggacggacggtcctagtaacttacgttactcgtacccttacgttccgttacgttttggtcggttacgtcgtcgttacgtccgttaggtttccgggacgggtacggaaccgacgtccgtacggtaccgttacgttacggtacgaccggaccgtacgccgtacccgtccccgtcgtccctacctccgttcccgtccccgttacccccg

SEQ ID NO: 133427 - DNA, 820 bp, Homo sapiens
  misc_feature: GYAE6OF01BLC4S.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccaggtccaattctcagactgtggtgactcaggagccctcactgactgtcgtcccaggagggacagtcactctcacctgtgcttaccaacactggagccagtccaccgagtcgtcttaactactacctaaaactcggttaccaagacaacgaaaacccgtaggaaccaaagaccaaccccgaagggtccaacctacctaatttaacgtacgttaaacaaaaacctaaaccgaaaacctaacctacccgtaccggaacccccgttacgaccccgttaactttaccgtaccgtaacggtcccgttacccccgttaccggtttaccgggggggaacctaaaaacggtcccgtttacccggacccccgttacggtaaacccgtaaccgtttcggttaccgttggggttcgttacgaccgtacggtccgtagggaacgggtaccggaagggtccgttacggtaaccttaagtttacccgttcggtacccctttaaccttaccgttaacggttttcgggttggttacggtccgtttagggttcgtcggtttaacgttaccgggacgggtaaccgggtaccgaacggtaccgtacgtacccggttacgttaaccggtcctaaccggcccggttaaacggcccttacccggcccccgttacggtccttaacttcccgttcgttaccccccgtcccg

SEQ ID NO: 133428 - DNA, 658 bp, Homo sapiens
  misc_feature: GYAE6OF01CLF5W.17.33.C11.1.454.CMB.1.raw
  modified_base (387)..(387): a, c, t, g, unknown or other
  misc_feature (387)..(387): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtcgccttaccaactacgtggacgcacgtcaccgtaagtcgtacttactaactaccctaaaacgttcggttaccagtacaacgtaaaccgtggaacaacgccaaccgagggactacgtactaattacaacgtaacaaacaaacaaacactacctacggaccctcgacctatccncgacgtacctccgtcggtcgggacaagctcgcctagactacgtgtcgtaggtcgcgacgacgtcgtggtacggacgtacggtctacgtaacttcgtaacgtccgtaccttaccttacgttacggtttggtacgtcgtacgttgtcgtacgttcggtacgggtaccggtaacggacctacggtccttacggtaccgtacgttagtaccgacgacccgtaacggtcccgtacccgccccgtcggtactacctccgttcccgtcccttaccccg

SEQ ID NO: 133429 - DNA, 562 bp, Homo sapiens
  misc_feature: GYAE6OF01AHM0W.17.33.C11.1.454.CMB.1.raw
  modified_base (481)..(481): a, c, t, g, unknown or other
  misc_feature (481)..(481): n is a, c, g, or t
  modified_base (546)..(546): a, c, t, g, unknown or other
  misc_feature (546)..(546): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggccactcatttatagtacaaacaacaacactcctggacccctgcccgattctcacgcctccctccgttcggggcaaagctcgccctgacactgtctggtgtgcagcctggacggacgaggctgactattactgtcctactctactttggtggtgctgtcgcttgtcgggcgggacgggaccaagctcgtacccgtnttaacgtcgacgcccgaaggtccgtcccgcccccgtcggtcccacgttcccgttccgttcccccnccccgttccctccccg

SEQ ID NO: 133430 - DNA, 738 bp, Homo sapiens
  misc_feature: GYAE6OF01BMN1O.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcgaggacgccctcactgactgtcgtccccgagggagggacagtcactctcactgtcgcttccaacacgtggacgcacgtacaccagtcgtacttaactactaccgaaacgttcggtaccagacgaacgtaaaaccgtcggaacaacgaccgaaccgaacgggtacctaaccttacttaattttaactaaacgtaaaaccaaaaaccaaaaccaaaacctaaccttaccgtaccggtaaccccgtccgacccgttacttcctacgaccggtcccttcccgtaccgggttacgggggacctaaacggtccgtaccgtacccgtacggtaacctacgttacggttcggttggtcggtcgtacgcgtccgtagggacgggacggacggtcgtacgtacgttacgttacgtacgtcctttacgttcgtttacggtttcggtacggtgtcgttcgtcgtacgtcggttcgggacgggacggacgaacggtctacggtacgttacttaggccgtaacgtccggaggtcccgttcccggcccgtacgtctcccgttacttcccgttaccctcccgttcccttaccg

SEQ ID NO: 133431 - DNA, 635 bp, Homo sapiens
  misc_feature: GYAE6OF01BAKO4.17.33.C11.1.454.CMB.1.raw
  modified_base (241)..(241): a, c, t, g, unknown or other
  misc_feature (241)..(241): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggagccctcactgactgtgtccccaggaggacagtcactctcacctgtgcttccaacactggagcagtcaccagtnctactatccaaactggttccagcagaaacctgacaagccacccgagggcactcgtaatttaataacgtaacaaaccaaacaaaacactacccgtacggacccctcgcccgacttcctcacggcctcccgtccgttcggggactaaacgtcgtcgcccgtacgacacgtcgtcgtggtcgtgcacgcgtaggacggacgaggctagacttacgttactcgtaccctacttacgttacgttttcgggtggtcgtcgttgttcggtaccgttagttccggggtcggaacgggtaccgaacgtcgtacgtaccggttacttaacggtccacggaccgtaacggtccgtccggtaccccgtaccggtcctaaccttccgttccgttcccgttacccccg

SEQ ID NO: 133432 - DNA, 787 bp, Homo sapiens
  misc_feature: GYAE6OF01AVWDT.17.33.C11.1.454.CMB.1.raw
  modified_base (175)..(175): a, c, t, g, unknown or other
  misc_feature (175)..(175): n is a, c, g, or t
tcagcgtagactagcacgaccggtgctcgatttagagtgagctcgttgggtttgggggggtcggccgaggggtcccgttccaatatcagcaccatggcctggactcctctctttctgttcctcctcacttgctgcccaggtccaattctcagactgtggtgactcaggagccctnactgactgtcgtccccaggagggacaggtcactctcacctgtgctttccaacactggagcagtccaacctgtcgccttactactccgaaaactggttaccagcagaaacctaggaacgaacgaccaacccgacggacgacctacactttataacgttaccaaacctaaacaaacctaacctacctacggacccctacgacccgacttacctacgacggtcctccccgttccggttacgggggtacccaaacggtccgtcgtacccgtacgacctaccgttacgtcgttacgggttcggtcgtccgtacggcccgttaggaacggggaacggtacgggacgtttcggaactttaacgttaccgttccggtacccttaccgttcgtttaccgttttagggttccggttaggtcccttagggtcgttaccgtttacggtaccgggggtccgggaaggggtaacccgacgggttaccttacgggtacccggttacgtttaaacggtccgtaacgggtccccgtaaggtcccggttccccggtcccccggttaccgttacccgtaaccgtttccgttacccggtttaccccccgtccccggttcctttacccccggg

SEQ ID NO: 133433 - DNA, 745 bp, Homo sapiens
  misc_feature: GYAE6OF01DSMFN.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccgagggtccaattctcagactgtggtgactcaggacgccctcacgtgactggtcgtcccgaggagggacagtcactctcaccgtgtcgcttaccaacacgtggacgctacgtccaaccgtaggtctacttaactactaccctaaaacgttcggttaccagaccaaacggaaaccgtacggaacaacgaccaccggagggaccactacgtaattactaacgtaaacaaaacaaaacaaaccacgtaccgtaccggaccctacgtaccgtacttacgccgaacgtccgtcccgtaccggttacggggaacaaacgtccgtcgacccgtacgtaccgtacgtcgtccggtgggtcgtacgacgacgtaccgtaggacggacgacggtcgtacgtaacttacgttacgttcgtaccttacgttacgtttacggtttggtaggttcgtcgttagtccgtagttaccggttacgggacgggtaaccggaccgtacggtacggtaccggtaccgttacgtaacggttaccgaacggacccggtaacggtcccgttaccccgggtacccgttccggtacccttacccgtcccgttaccccggttcccccgttacccccgg

SEQ ID NO: 133434 - DNA, 748 bp, Homo sapiens
  misc_feature: GYAE6OF01DE0ZG.17.33.C11.1.454.CMB.1.raw
  modified_base (734)..(734): a, c, t, g, unknown or other
  misc_feature (734)..(734): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcaggagccctcactgactgtcgtccccgagggagggacagtcactctcacctgtcgcttaccaaactcgtggagcaagtcaccagtgtcttactactacctaaacgtggttaccagacaacgtaaaccaggaacaagcccaccgaggaccactcgtaatttactaacgtaacaaaaccaaactaaaccaccttaccgtaccggaccccttacgaccccgtattcctaccgtacggtccttacccgttacggtcggggaacaaacgtcctacgtccctagacctacgttcggtcgtgggttcgtacgacgacggtccgtaggacgggtacggtctacgtaacctttagtaccgttcgtacccttacgttaccgtttacggttttcgggtacggttcgttcgttcgggttcgttacggttacgggttccgggtacggggtaacgggtaaccgtacgggttccgtaacgggttaacccgtttacggttaaaggtaccctacgggtaccccgtaacggtcccgtaccccggtccccgttcggttaaccctccggttcccgttcccgggttacccccnccccgtttaccccg

SEQ ID NO: 133435 - DNA, 650 bp, Homo sapiens
  misc_feature: GYAE6OF01DC332.17.33.C11.1.454.CMB.1.raw
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcaagaaacctggacaagccacccgaggcactctatttanagtaacaaacaacaaacactccncgacccctcgacccgtatctcacggcctccctccggttaggggacaaacgctcgccctgacactcgtcgtggtgtcgcacgccgtaggacgggacggggtctagtacttacgttacgtcgtacccttacgttcgttacgtttgggtggttcgtcgttgtggtcgttaggttccgggacgggtacggaacctacggtccgtacggtaacccggttacttacggaccctaacggaccccgtaacggtcccgttcccggtcccccgttaccggtcctacccgttccgttccccgttacccccgtccccttcccgtcccgttacccggg

SEQ ID NO: 133436 - DNA, 789 bp, Homo sapiens
  misc_feature: GYAE6OF01BF550.17.33.C11.1.454.CMB.1.raw
tcagcgtagactagcacgaccggtgctcgatttagagtgagctcgttgggtttggggctggcgccaggggtcccttccaatatcagcacatggcctggactcctctctttctgttcctcctcacttgctcgcccgagggtccaattctcagactggtggtgactcgaggacgccctcactgactgtccgacccgagggagggacagtccactctcctacgtgtcgtccttaccaacacgtaggacgactacgtaccacgtagtcgtaccttaactacctaacctaaacgttcggtacaacgtaccgaaacgtaaaccgtacggaaccgaacggacccaaccggacgggtacctaacttacgttaaactttaacgtaaaacgtaaaccaaaaacctaaaccgtaaaaccctaccgttaaccccggtaacccggacccccgttaccggaaccccgttacgttacccgtaccgtaacccggtcccgtttaccccggttacgggtaccggggtaactaaccggtcgtacccgtaccgtacgtacccgtacggtcggttacgtgggtacgtcgacgtacggtcgtacgggacggtacgacgtcgtacgtaacgttacgtcgtactaccgtttacgtcgtttacggtgggttacgtgttaccgtgttcgtacgttaacggcggggtaaccgaaggacgtacgtcgtaccggtacgttactacggactaccggccggtacggtcccgtacccggtcccgtacgttcctacccgtttccaccccttcccgtaacccg

SEQ ID NO: 133437 - DNA, 643 bp, Homo sapiens
  misc_feature: GYAE6OF01BEHXK.17.33.C11.1.454.CMB.1.raw
  modified_base (399)..(399): a, c, t, g, unknown or other
  misc_feature (399)..(399): n is a, c, g, or t
tcagcgtagactagcacgaccggtgctcgatttagagtgagctcgttgggtttggggctggcgccaggggtcccttccaatatcagcaccatggcctggactcctctctttctgttcctctcacttgctgccagggtccaattctcagactgtggtgactcaggacgccctcactgactgtgtccccaggagggacagtcactctcacctgtgcttccaacactggagcagtcaccagtcgcttaactatccaaactggttaccagccaagaaacctggaacaagccaacccgagggcactctaatttactaagtaacaaacaaacaaacacctacctacggaccccctagccccgattcctacgacgctcccgtccgttggggacaaagctcgccctnactacgtgtctaggtgtcgcgacgccgtaggaagggacggacggtctacgtacgttacgttacgtcgtacccttacttaccgtttaacgtttgggtacggtgtcgttaggtcgtacgttacgttccggggtcgggaacgggtaccgaacgtcgtacggtacccgttacgttaacggttccgacggtcccggaacggtccgccgtaccccccgtcggtccaccttccgtccgttcccctaccccg

SEQ ID NO: 133438 - DNA, 570 bp, Homo sapiens
  misc_feature: GYAE6OF01BK410.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaaacaacaaacactcctacgacccctgcccgattctcacggcctcccgtccgttcgggggcaaagctcgccctgacactgtcgtggtgtgcacgtcctgaaggacgaggctagactattactgtacctactcttacgtttgggtgttcgcgttgtgtactagtcgggcggacgggaccaagcgtacgtaccgtcttaagctacgccaaggccgtcgcccccgttcggtacctacgttccgttaccgttcccctcccgttccctacccg

SEQ ID NO: 133439 - DNA, 670 bp, Homo sapiens
  misc_feature: GYAE6OF01BNU36.17.33.C11.1.454.CMB.1.raw
  modified_base (298)..(298): a, c, t, g, unknown or other
  misc_feature (298)..(298): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaacctggacaagcacccgaggcacgtcatttanagtacaaacaacaaacactacctcggacccctgcccgattctacaggcctaccctccgttggggcaaagctcgccctgacactcgttacgtggtagttcgcacgtccgtagaggaccgaggctacggactacttactcgcccttactcttacgtttggtggtcgtcgttcgtcgtacgttacgtttccgggacgggtaacgggaaccgtacggtcgttacggtacccgtttacgttaaaccgttacgtaaccggtacccccggtaacgggtcccgttcccggtaccccccccggttccgggttaccccgtacccgtttaccccgtttacccggtttccccccgttaaacccccttccccgtttaacccccgg

SEQ ID NO: 133440 - DNA, 596 bp, Homo sapiens
  misc_feature: GYAE6OF01C4DVZ.17.33.C11.1.454.CMB.1.raw
  modified_base (230)..(230): a, c, t, g, unknown or other
  misc_feature (230)..(230): n is a, c, g, or t
  modified_base (301)..(301): a, c, t, g, unknown or other
  misc_feature (301)..(301): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggancagtcaccagtgcttactatccaaactggttccagcagaaacctggacaagcacccgaggcactcatttanagtacaaacaacaacactcctgacccctgcccgattctcacggcctccctcgttcggggcaaagctcgccctgaccactgtcgtggtgtcgcacgcgtgaggacgaggctagacttattactcgtacctactcttacgtttgggtggttgcgtgtcgtcgtagttcgggcgggtacgggaccctaaggcctcggtacccgttacgttaaacgtccgtacgacccgtaacgggcccttcccggaccccccgttcggtacccgtacccgttccgttcccgttccccttaaccccccg

SEQ ID NO: 133441 - DNA, 704 bp, Homo sapiens
  misc_feature: GYAE6OF01BHQ8J.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggacggacagtcactctcacctgtgcttccaacactggagcagtcaccagtgcttactatccaaacttgttaccagcagaaacctgacaagcaccgaggcactctatttatagtacaaacaacaaacactctacgaccctgcccgattacctcacggctaccctcgttacggggcaaagctcgcctgactactcgtacgtggtcgtcgcgtaagtcccgtaggaacgggaccggaggtcctagtaacttacgttacgttacgtcccgttacttaccgtttacggtttacggtacggttcgtcgttacggttcggtacctttaacgggttccgggtacccggggtaacgggtaacccggtaacgtcccggttacggtaacccggtttaacgtttaaacggtaacccgtaaccggtaccccggtaaacgggtacccgttaccccggtcccccgtttacggtaccccgtacccgtttcccgtaccccggttttcccccgcccccgtttcccgtaccccgg

SEQ ID NO: 133442 - DNA, 753 bp, Homo sapiens
  misc_feature: GYAE6OF01BDMGW.17.33.C11.1.454.CMB.1.raw
  modified_base (178)..(178): a, c, t, g, unknown or other
  misc_feature (178)..(178): n is a, c, g, or t
  modified_base (183)..(183): a, c, t, g, unknown or other
  misc_feature (183)..(183): n is a, c, g, or t
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
tcagcgtagactagcacgaccggtgctcgatttagagtgagctcgtggggttgggggcgccgaggggtcccttccaattatcagcaccagtagggaccgtggactcctctctttctgttccctcctctacttgctcgccagggtccaagttcgtcagactggtggtcgactcgaggcnccctnactgactgtcgcccgagggagggacagtcactcncacctgtctcttaccaacncgtaggnctagcaccgaggtctacttactactaacctaaacgttcggttaccgagaccgaacgtaaaccgtagggaaccaacggcccgaaccgcgggtacaaccttacttaagtttaataaacgtaaacaaaaacctaaacaaaccggtaccttaccgtaccgggtaacccccttcggaccccgttaacgttcctaaccggtacggttcccgttacccggttttaccggggtacgggggaaaccgtaaaccggtccgtttcccggacccgttacggaaccgtacggttcggttcggtgggttacgtcgaaccgtcggaccggtaggacgggtacggacgtcgtacgtacgtacttacggctaccttactcgtttacgttggtcgtcgtcgtcgtgtcgttacggtcgggagtaaccggactacggtcgtcgtacgttacgtagtacgacgccgtacggtccgtcccggtcccgtacgtccgtacccttcggttccctaccccgccgtttcgtacccg

SEQ ID NO: 133443 - DNA, 876 bp, Homo sapiens
  misc_feature: GYAE6OF01AGY8W.17.33.C11.1.454.CMB.1.raw
  modified_base (154)..(154): a, c, t, g, unknown or other
  misc_feature (154)..(154): n is a, c, g, or t
tcagcgtagactagcacgaccggtgctcgatttagagtgagctcgttgggtttgggtcgtggcgccaggggtcccttccaatatcagcaccatggcctggactcctctcttctgttcctcctcactgctgccaggtccaatctcagctgtggtnactcaggacgccctcactgaccttgtcgtccccgaggacgggacacgtcaccttcacctaccgtgtcgccttaccaaactaccgtgggacgcctaagtccaccgtagttcgcttaacctactacctaaaccgttcgttaccagacctagaaacccgtaggaaccaacgacccgaacccgacgggtaccaccgtactaactttacgtaacgtaacctaaaccgaactaaaccctacctacccgtacggacccctaccggaccgtaccttccaccgtaaccgtcccgttccccgtaccggttcggggacctaaacggtccgtccgtaccccgtacgtaccgtaccgttcgttaccgggtacggttcgtccgtacgttaccggccgttacgggaaccggggtacgaacgggttacgtacggttaacccgttattttaccccggtacggttaaccccttttcggtaacccgttttcggtttacggggttccgtgggtttcccttaaggtttccggtaccgtttaaggggtttcccgggggaaccgggttacgggtaacccgtacggttacggtaaccgggtttcccgtaacggtttaacccgtaacccggtacccggtaaccccggttaaccggtccccgtttaccccgggccccgttaaccccggtaccgtttacccccggtttacccgtttccccgggtaacccccccgttttaacccccccgg

SEQ ID NO: 133444 - DNA, 722 bp, Homo sapiens
  misc_feature: GYAE6OF01ECXH5.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcgaggacgccctcactgactgtcgtccccgaggaggacagtccactctcacctgtcgccttaccaacacgtggagccacgtccaccgtagtctactttaactactaccgtaaacgttcggttaccacgaccaaacgaaaccggtaggaaccgaacgaccgaacccgagggtacctaaccgtttactaattttaacgtaaacgtaaaaccaaaaaccaaaccaaaacctacccgttacccgtaccggtaaccccctcgtaccccgtactttaccgtccgaacggtcccttaccccgttacggtacggggaacctaaacgctaccgaccctacgaacctacgttcgtacgttggtgtacgacgacgtccgtaggacggacggacgtcgtacgtaacttacgtaccgtcgtaccttacttacgtttacgtttgggtcgtcgtcgttgtctacggtacgttcgggacggacgacagtcgtacgtacctagtaccgacgacgtaccgtaggcctcccgaccccgttgcccgtacgttcccgttacccttcccctacccttccgtaccg

SEQ ID NO: 133445 - DNA, 724 bp, Homo sapiens
  misc_feature: GYAE6OF01BMG62.17.33.C11.1.454.CMB.1.raw
  modified_base (382)..(382): a, c, t, g, unknown or other
  misc_feature (382)..(382): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgccccagggagggacagtcactctcacctgtcgcttccaacacgtggacgcagtccacctagtcgtccttactactaccaaacgttggttccagacaacgaaacccgtggaacaacgaccacccgaacgggcacctactatttaactaagtaacaaaacaaacaaaccactaccgtacggacccctcgaccccgtattccncgacgtccttccccgtccggttacggggactaaacggcctcgtaccctgacctacgtcgttcgtcgggttgcgacgacggaccgtagggacggtacggacggtcgtacgtaccttagtacctcgtaccttaccgttacgttacgtttgggtggtggtcgttggtcgtacgttacggttccggggacgggtacgggtaaccgtacgtccgttaacggaccgtttacggttaccgtaccggtaccgcccggtaaccgggtcccgttcccggtccccccgttacggttacccgtacccgttccgtttcccccggttcccccgttccccgtcccgtttaaccccgg

SEQ ID NO: 133446 - DNA, 626 bp, Homo sapiens
  misc_feature: GYAE6OF01ELTE1.17.33.C11.1.454.CMB.1.raw
  modified_base (306)..(306): a, c, t, g, unknown or other
  misc_feature (306)..(306): n is a, c, g, or t
tcagcgtagactagcacgaccggtgctcgatttagagtgagctcgttgggtttggggctggcgccaggggtcccttccaatatcagcaccagtgggcctggactcctctctttcctgttcctcctcacttgctgcccagggtccaattctcagactgtggtgactcaggagccctcactgactgtcgtcccaggaggacagtcactctcacctgtgcttccaacactggagcagtcaccagtgcttactactaccaaactggttccagcaagaaacctggaacaagcacccgaggcactcatttanacgtaacaaacaacaaacactacctacggacccctcgacccatctcacggcctccctcgttacggggacaaacgtctacgccctagaccgtacgtcgttcgttgggtgtacgccgtacgccgtaggacggacgacggtactagtacttacttaccgtcgaccttacgtctttacgttggtcgtgtcttggtcgtcgttggttccgggacgggtacgggaccgacgtcgtacgtaccgttaacgttacgtacctaggacccgtacggtccctacccggtcccgtaccgtacctaccttccgttcccgtccccgttaccccc

SEQ ID NO: 133447 - DNA, 657 bp, Homo sapiens
  misc_feature: GYAE6OF01DJEAE.17.33.C11.1.454.CMB.1.raw
  modified_base (215)..(215): a, c, t, g, unknown or other
  misc_feature (215)..(215): n is a, c, g, or t
  modified_base (448)..(448): a, c, t, g, unknown or other
  misc_feature (448)..(448): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccaggaggacagtcactctcacctgtcncttaccaacactggagcagtccaacagtgtacttactaactacctaaacgtcgtccagacgacgaaacctaggaaccaacgccgaaccgagggccactactaatttaaacaacgtaaacaaaccaaaccaaacgacctaccgtaccggaccctcgcctacttccgacgtacgccttcccgtcgtacggggacaacgcctcgccctagactcgtgtctggtcgcgcgtagccgnggaacggacgtaggcttagtaaccttattaccgtcgtacctttacttcgttacgtttgggtgtcgtcgtggttcgtcggttacggtccgggacggtaacggaccgtaagtccgtacgttaaccgtacgttaacgccgtaccgacgtaccggtccttccccggtccccgtaccgtacttacccgttccctaccgttcccccgtaaccccg

SEQ ID NO: 133448 - DNA, 909 bp, Homo sapiens
  misc_feature: GYAE6OF01DLSHD.17.33.C11.1.454.CMB.1.raw
  modified_base (235)..(235): a, c, t, g, unknown or other
  misc_feature (235)..(235): n is a, c, g, or t
tcagcgtagactagcacgaccggtgctcgatttagagtgagctcggttgggtttgggggcgccaggggtcccttccaatatcagcaccatggcctggactcctctctttctgttcctcctcacttgctgcccagggtccaattctcagactgtggtgactcaggagccctcactgactgtcgtccccgaggaggacagtccactctcacctgtcgccttaccaaactcgtggacncacgtccaccgagttcgtacttaactactaccctaaacgttcggttaccacgccgaacgtaaaccgtacggaacaacgaccaaccccgacggggcaaccgtacctaagttttaactaacgttaaaccaaaaacctaaaaccaaaacctaaccttacccgtaccggtaaccccccgtcggaccccggtactttaccgtaccgtaacggtccccttacccccgtttaccgggttacggggggtaaccaaacggttccgttacccggaccccgttagtaacccgtaaccgtttggttccggttaggttcggttccgaccgtacgggccgttacgggaacgggtaaccgggtacggtaccgttacttaacccggttacgtttaaccgttccggttaaccgtttaacccttaccggtttaacggtttttcggggtcggtttcgtccggtttggttcgttaaccggttacgggttacccggggtaacggggtaaccgggaaccgttaacgtccggttaaccggtaccgtttaaccggtaaacgttacccggaaccggtaccccggtaaccgggttaccccgttcccccgggtacccccggttacccggttaccccgtaaccccgtttccggttacccccgtttacccccccggtccccgtttccccgtttaacccccggg

SEQ ID NO: 133449 - DNA, 847 bp, Homo sapiens
  misc_feature: GYAE6OF01C4K8M.17.33.C11.1.454.CMB.1.raw
tcagcgtagactagcacgaccggtgctcgatttagagtgagctcggttggggtttggggggcgccgaggggtcccttccaatatcagcaccatggcctggactcctctctttctgttcctcctcacttgctcgcccagggtccaattctcagacttggtggtgactcgaggacgccctcactgactgtcgtacccgagggaggacagtcactctcacctgtcgtcctaccaacgtacgtggacgcaacgtaccaccgagtcgtacttaactactacctaaacgttcgttaccaagtacgaaacggtaaaccgtggaaacaaccgacccgaacccggacggacctaaccgttacttaaagtttaactaaaaccgtaaaccaaaaacctaaaaccaaaacctcccgttaccgtaccggaacccccgtccgacccgttactacccgtacggaccggttccccgttacccgttaccggggtacggggaaactaaaccggtccttccggacccgttaagaacccgttcgttccgggtcggttacgggtcggtaccgtaccgtaccggcccggtaaggggaaccggtaacgggtaccgtcgttaaaccgttaacgtttaacgttccgtacccgttacctttaaccgtttaccggttagggttttcgggcgttcggtccgttaggttcgttaacggtttccgggacgggtacgggaaacggtccgtacggtgttacccggttacgttaacaacggtccgaacccgggttacccgaggtttcccctccccggacccttacggttcccttaccctttccgggtccccttacccccgtccttccccggtttaaccgg

SEQ ID NO: 133450 - DNA, 749 bp, Homo sapiens
  misc_feature: GYAE6OF01E0GND.17.33.C11.1.454.CMB.1.raw
  modified_base (223)..(223): a, c, t, g, unknown or other
  misc_feature (223)..(223): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtcgcttccaacnctggagcagtcaccagtcgacttactactacctaaacgtggttacccagtaccaacgtaaaaccgtggaaccaaagccaacccgagggcctaacctctaattttaacaacgtaaccaaaaccaaaccaaaccaccgtccctacggacccctcgcccgtattccaccgacggtccttaccccgtccggttacgggggactaaacggcctacgacccgtgaaccctacgtcgttccgtagggttcgtcgaccgtaggcccgtaggacgggacgtacgggaccttaggtaacttaacgttaccgtccggtaccttaccgttacgttacggtttcgggtggtacgtcgtagtccgtacgttacggttccggggaacggtacgggaacccgtaacgtccggttacgtacccggttacgttaaacggccgaacggtaccccgtaacgggtccctccccgggtaccccccggttcggaccccttaaccgttcccgttaccccggttcccccttacccgttccccgttaacccg

SEQ ID NO: 133451 - DNA, 576 bp, Homo sapiens
  misc_feature: GYAE6OF01BH5NG.17.33.C11.1.454.CMB.1.raw
  modified_base (296)..(296): a, c, t, g, unknown or other
  misc_feature (296)..(296): n is a, c, g, or t
  modified_base (391)..(391): a, c, t, g, unknown or other
  misc_feature (391)..(391): n is a, c, g, or t
  modified_base (442)..(442): a, c, t, g, unknown or other
  misc_feature (442)..(442): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttanagtacaaacaacaaacactcctacggacccctgcccgattctcacgcctccctccgtcggggcaacgctcgccctagactactgtctggtgtgcncgcgtgaggacgaggctgactatactgaccttactcttacgtttggtggtntcgtgtgtacttgttcgggtcgggacggtacgaagtccgtacgaccgttacttagtcacggtcccgaaggcccgtccgtccccccgtcggttcctaccgttcttacccggttcccctaccccgtcccttacccg

SEQ ID NO: 133452 - DNA, 646 bp, Homo sapiens
  misc_feature: GYAE6OF01BJQKK.17.33.C11.1.454.CMB.1.raw
  modified_base (349)..(349): a, c, t, g, unknown or other
  misc_feature (349)..(349): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctccacctgtcgcttccaacactggagcagtcaccagtgcttactataccaaactggttccagcacgaaacctcggaacaagccaccagggcactcatttatagtaacaaacaacaaacactcctcgacccctcgacccgtacttccncacgccttcccgtccgttcggggacaaacgcctcgcccgtgacacgttcgtctggtgtcgcacgaccgtggacgggacggaggcgtagtacttacgttacctcgtaccttcgtaccgtttacggtttaggttggtcgtcgttgttcgtcgttacggttcgggtacgggacggaccgaacgtccgtacgtacccgttacgttaacgtcgtaacgcccgacggtccgtcccggtccccccgttcggtaccccgtcgttacccgttcccggttcccccgtccccgttccccttaccccgg

SEQ ID NO: 133453 - DNA, 621 bp, Homo sapiens
  misc_feature: GYAE6OF01CYD76.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaaatggttccagcagaaaacctggaacaagcacccgaggcactcatttatagtaacaaacaacaaacactacctcggacccctgcccgattctcacggcctcctcgttggggacaagctcgcctgacactgtcgtggtgtcgcacgtccgtaggaacgggacgaggctagtaacttactactcgaccttaacttcgttacgttttgggtaggtctcgttgtcgtcgttacgttcggggacgggaacgggtaccgaacggcttaacggaccgttacgttaaacggtcaaccggaccccaagggtcccgtcccgtcccccgtacggtcctacccttccgttacccgttcccccctacccgttcccctacccg

SEQ ID NO: 133454 - DNA, 614 bp, Homo sapiens
  misc_feature: GYAE6OF01A39UB.17.33.C11.1.454.CMB.1.raw
  modified_base (229)..(229): a, c, t, g, unknown or other
  misc_feature (229)..(229): n is a, c, g, or t
  modified_base (395)..(395): a, c, t, g, unknown or other
  misc_feature (395)..(395): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcaagaaacctggaacaagcacccgaggcactcatttatacgtaacaaacaaacaaacactcctcggacccctgcccgtattctcacgcctccctcgtggggacaaagctcgccctgacactcgtctggtgngcacgccgtggtacggacgaggtctaggacttagttacctcgtacctacgttcttaacgtttggtagttgtctaggtcgtcgttagttccgggacggtacgggacctacggtcgtacggtaccgttacgttaaggtccaacggccccgtaaacggcccgttacccggccccccgttaccgtacctaacccgttccttcccggtttccccctaccccccg

SEQ ID NO: 133455 - DNA, 564 bp, Homo sapiens
  misc_feature: GYAE6OF01B4FP7.17.33.C11.1.454.CMB.1.raw
  modified_base (438)..(438): a, c, t, g, unknown or other
  misc_feature (438)..(438): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctaggacccctgcccgattcctcacgctccctccttggggcaaagctcgccctgacactcgtctggtgtgcagcctgaggacgaggctgactattaactgccctactctactttggngtgctgtgtctagttcgggacgagggacccaagccgtagtaccgtacgttaaacgcgtacgcccgtaaacggtcgtcccgccccccgttcggtccctaacttcccgttccgttccccctacccccg

SEQ ID NO: 133456 - DNA, 613 bp, Homo sapiens
  misc_feature: GYAE6OF01D6Y87.17.33.C11.1.454.CMB.1.raw
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (350)..(350): a, c, t, g, unknown or other
  misc_feature (350)..(350): n is a, c, g, or t
tcagcgtagactagcacgaccggtgctcgatttagagtgagctcgttgggtttgggggctggcgccagggtcccttcaatatcagcaccatggcctggactcctctctttctgttcctcctcacttgctgcccagggtccaattctcagactgtggtgactcaggacgaccctcactgactgtgtccccgagggagggacagtcactctcacctgtcgcttccaacnctggancacgtcaccgagtgcttactatccaaactggttccagcaagaaacctggacaacgccacccgagggccactctatttatagtaacaaacaacaacactctcgaccctgccgattccncacgcctcctcgtcgggacaagctcgcctgacacgtcgtcgtcggtgtcgctacgcgtagacggacgacgctaggacttagttacgtcgtacccttacgtccgtttacgtttgggtcgtgtacgtgttcgtcgttagtcgggacgggacggacctaagtcgtacgtaccggttacgttaacggccgtaacggacccgtaagggtccctacccgtcccccgtacgggtaccctaccgttcccgttcccgttcccccgtaccccg

SEQ ID NO: 133457 - DNA, 629 bp, Homo sapiens
  misc_feature: GYAE6OF01EP1D5.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccagggagggacagtcactctcacctgtcgtcttccaacacgtggagcagtcaccgagtgcttactactaccaaactggttaccagacaacgaaaccgtggacaacgccacccgagggcactctatttatagtaacaaacaaacaaacactcctacggaccctcgccctacttctacgacgcctccctccggttcggggacaaacgtcctcgccctacgacctacgtgtcgtggttgtcgcacgccgtaggaggacggacggcgtgtacgttattacgtcgtacctacttcgttacgttttggtggtcgtcgttgtcgtcgttacggtcgggcggacgggtaccgaacggtctacggtaccgttacttaacggtccgacggccgaacgggcctcccggtcccccgtcggtacctaccgttccgttccgtccccttacccccg

SEQ ID NO: 133458 - DNA, 721 bp, Homo sapiens
  misc_feature: GYAE6OF01D584V.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtcccaggagggacagtcactctcacctgtcgcttaccaacacgtggagcagtcaccagtgacttaactactaccaacgtcggttaccagacaacgaaaacccgtaggaaccaacgacccgaacccgacgggaccaaccttacgtaattttaacgtaacgtaaaaccaaaaccaaaaccaaacctacctacccgtaccggtacccccgtcgacccgtaacttccgtaccgaccggtcccttaccccgttccggtcgggggaacctaaacggtcctccgtaccctcggaacctacgttcgttcggttacggttcggtacgacgtacggtaccggtacggtacgggacggacggtacgtacgtacgttaacttaccgtcgtaccttaccgttcgtttacggtttgggttggtcgtcgtggtcgtacgttacggtcgggacgggacggacgacgtcgtacgtacgttactacgacaccgtaccgagccgtcccgtcccgtcggtccctaccttcgtcccgttccccgtccttcccgttcccg

SEQ ID NO: 133459 - DNA, 637 bp, Homo sapiens
  misc_feature: GYAE6OF01BH8H3.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactcggttaccagcagaacctggacaagcacccgaggcactcatttatagtacaaacgaacaaacactcctcgacccctcgcccgattcctcgacggcctcccgtccgttagggggcctaaaggcctcgccccgtagactacgtgtctggtagtcgcacggcctaggaggacgacggctagtactacgttactcgtaccttacgtcgttacgtttaggtggtgtcgtacgttgcgttacgttcgggacgggtacggaccgtaagtcgtacgtacccgttaccgtttaaacgtccgtaacggtcccgaaacgggtccttcccggtaccccccggttacgggtaccctaacgtttcccgttcccggtttccccccggttacccccg

SEQ ID NO: 133460 - DNA, 632 bp, Homo sapiens
  misc_feature: GYAE6OF01ENBVM.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagccacccaggcactcatttatagtaacaaacaacaaacactcctcggacccctgcccgtattcctcgacggcctcccgtccgttgggggaccaaacgctcgccctagacctacgtgtctgggtgtgcacgccgtggacgggacggaggctacggaacttacttacctcgtacccttacttcctttacgtttgggtggtcgtccgttgtcgtcgttacggttccgggacgggacgggaccaaggtcgtacggtacccgttacgttaacgtccgtaccggacccggtaaacggcccgttcccggaccccccgttcggtaccctaccgttcccgttcccgttcccccttacccccg

SEQ ID NO: 133461 - DNA, 706 bp, Homo sapiens
  misc_feature: GYAE6OF01AZSC7.17.33.C11.1.454.CMB.1.raw
  modified_base (357)..(357): a, c, t, g, unknown or other
  misc_feature (357)..(357): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccagggagggacagtcactctcacctgtcgcttccaacactggagcagtcaccagtgcttactactccaaactcggttaccagcaagaaacctggaacaacgccaaccgaggcactctatttatagtaacaaaaccaacaaacactcctacggacccctcgcccgattccncgacggcctcccgtccgttacggggacaagctcgcctcgacacgttcgtcgtggtcgtcgcgacgtccgtaggacgggacgacgggtctacgtaacttaacgttaccgtcgtaccctttacttccgtttacggttttgggttacggttcgtacgttcgggtttcgtaccgtttacgggttccggggaaccggggtacgggtaaccgtaacggtaccgtacgggtaacccgtttagttaaaccgtccggtaaccggtacccgtaacgggtcccgttacccgcccccgttaccggtcccgttaccgttacccgttacccggtttcccccgtccccgtttcccgttaccccg

SEQ ID NO: 133462 - DNA, 609 bp, Homo sapiens
  misc_feature: GYAE6OF01E4L99.17.33.C11.1.454.CMB.1.raw
  modified_base (325)..(325): a, c, t, g, unknown or other
  misc_feature (325)..(325): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactcggttccagcagaaacctgacaacgcaccgaggcactctattatagtaacaaacaacaaacacctccncgacccctcgccgatctccgacggtcctccctccggttcggggacaaacgctcgcccgtagacacgtcgtcgtggtgtcgcgacgcctggacggacgaggtctgtaacttacttactcgtccttacttcttacgttttggtcggttgcgttggtcgtcgttacggtcgggacgggacgggtaaccgaacggtcgtacgtaccgtacttaacggtccgacggacccgtacggccgtacccgtccccccgtcggtcccaccgttccgttcccgtcccctacccccg

SEQ ID NO: 133463 - DNA, 589 bp, Homo sapiens
  misc_feature: GYAE6OF01EA94Z.17.33.C11.1.454.CMB.1.raw
  modified_base (347)..(347): a, c, t, g, unknown or other
  misc_feature (347)..(347): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactactaccaaactcggttccagcaagaaacctggaacaacgcacccgagggcactctattataagtaacaaacaacaaacactcctcgaccctgcctatcncacgctcctcgtgggacaagctcgcctgacactgtctggtgtgcacgcgtaggaggacgagctgacgttattactcgtcctactcgttacgtttgggtgtctcgtaggtcgtcgttacgttcgggacgggaacggaccgaaggtcgtacggtaccgtacgttaagtaccgacgacccgaaggtccctccggtaccccccgttcggtaccctaccgttccgttcccggttcccccgtcccccg

SEQ ID NO: 133464 - DNA, 625 bp, Homo sapiens
  misc_feature: GYAE6OF01BUIYQ.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcacgaaacctggacaagccacccagggcactcatttataagtaacaaacaaacaaacactcctacggacccctgcccgtattcctcaggcctccctccgtgggggacaaacgctcgccctgacacgtgtctggtgtgcagccgtagaggacggaggtcgtgacttacgttactcgaccttactcttacgtttggtggttcgtcgttggtcgtacgttggttccggggtacgggaacgggtaccaaggccgtacgtacccggttacttaacggtaccgacgtacccgaacggtcccgtcccggcccccttcgggtccctaccgtttcccgttacccgtttccccctccccttcccgttaccccg

SEQ ID NO: 133465 - DNA, 616 bp, Homo sapiens
  misc_feature: GYAE6OF01BMFJE.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacacgtggagcagtcaccagtcgtccttaactactaccaaactggttaccagacaagaaaccgtggaacaacgaccaaccgacggcactctatttataacgtaacaaacaaacaaacactcctacggaccctcgccgtatcctcacgcctcctccgtcggggacaaacgctcgcctcgactactcgtcgtggtcgtcgcgacgccgtagacgggacgacggtctacgacttacttacgtctacctacgttacttacgtttggtcgttgcgttacgtcgtcgttacgttccgggacggacgggacaacggtcgtacggtaccgtacgttaagtccgacgtacccgaggtcccgtccgtccccgtcgtaccacgtttcctccgttcccctaccccg

SEQ ID NO: 133466 - DNA, 557 bp, Homo sapiens
  misc_feature: GYAE6OF01ELFVW.17.33.C11.1.454.CMB.1.raw
  modified_base (229)..(229): a, c, t, g, unknown or other
  misc_feature (229)..(229): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagcaccagggcactcatttatacgtaacaaacaacaaacactcctcggaccctgcccgattctcgacgctacccgtcgttggggacaaagctgccctgacactgtctggtgtgcacgcctggacggacgaggctagactattactgtcctactcttacgtttggtgtgtcgtgtgtcttagttcgggcggacgggaccaaggctcgtaccgtattaacgtcacgcccgaacggcctccgcccccgttcggtaccaccttccttcgtccccttacccccg

SEQ ID NO: 133467 - DNA, 855 bp, Homo sapiens
  misc_feature: GYAE6OF01CJDG5.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtgtccttccaacacgtggagcagtcaccagtcgtccttactactacctaaacgttcggttaccagtcaacgaaaccgtggaacaacgccaacccgagggcctactcgaatttataacgtaacaaaacaaacaaacctacctccgtacggacccctcgacccgtacttccgtacgacggtccttccccgtccggttacgggggaacctaaacggtctaccggccctacgtacctacgtcgttcggttggtcggttacgcgtacggtccgttacgggaacgggtaaccgggtaacggtcgttacggtaacctttaacgtttaaccgtaccgtacccgtttacccggtttacgttttaccggttttcggggttacgggtttccggtacgtttcggttacggtttacccgttacggggttttaccccgggggacgggggttaaaccgggggtaacccgtaaacgggttacccggttaaccggttacccgggtttaaccggtttaaaccggttacccggtaacccgggtacccccgtaaaggggtcccccggttacccggtccccccggttacccgggtttaaccctacccggtttcccttaacccccggtttccccccttaccccgtttccccgtttaaccccggg

SEQ ID NO: 133468 - DNA, 832 bp, Homo sapiens
  misc_feature: GYAE6OF01DOA0D.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacacgtggacgcagtccaccgagtcgacttactactccaaaacttggttacaaagcaacgaaaacctggaacaaacgaccaaccccaggggcaccgttcaatttaactacgtaacaaaacaaacaaaccacctccgtacggacccctcgaccccgtacttcctcgacggtccttccccttaccggttacggggggtacaaaacggcttacggtacccgtacggaccctaccgttggttaccgttcggttcggtacggtaccgaacgtacccgttcgggaacgggaccgggaacgggtcttacggtaaccttaagttaccgttcgacccgttaactttcgtttaccgtttttacgggggtcggtttacggtcgttcggttcgtacgtttaacggtttccgggggaacggggtaacggggtaacccgtaaacggtcccggttaccggtacccggtttaccgtttaaacggttacccgtaaaccgggaccccgtaaaacgggtcccgttccccggtacccccccggttaccgggttacccctaaaccccggttttccccggttaccccggtttaccccccccggttcccccgtttcccccgtttaaacccccggg

SEQ ID NO: 133469 - DNA, 697 bp, Homo sapiens
  misc_feature: GYAE6OF01A360F.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtgcttaccaacacgtggagcagtcaccagtcgccttactactaccaaacttcggttaccagacaacgaaaccgtggaacaacgccaccgaggcactctatttataacgtaacaaaacaaaccaaaccacctaccgtccggacccccgtcgaccccgtacttccgtaccgacggtccttccccgtccgggttacgggggaaccaaacgtccgtaccggcccttacgaccgtacgttcggtcgttacgggtcggtacgcgacgtccgtagggaacgggaccggacggtcgtacgtacttactttaccgtcgtaccttacttcgtttacggtttgggtcggttgtcgttgtcgtcttacggtcggggtaccgggaacggtacgacggtccgtacggtaccgttacgtacgtacaccggtaccgacgtcccgtcccggtccccgtcgtacctacccttccgttaccctcccctaccctcccgttacccg

SEQ ID NO: 133470 - DNA, 590 bp, Homo sapiens
  misc_feature: GYAE6OF01AV4GD.17.33.C11.1.454.CMB.1.raw
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (382)..(382): a, c, t, g, unknown or other
  misc_feature (382)..(382): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgcttccaacacgtgagcctagtcaccgagtcgcttactatccaaacgtgttaccagcaacgaaacctgacaagcaccgaggcacgtcattanagtacaacaacaacactctcgaccncgccgtattcnacgctcctcgtcgggacaacgctcgctgacatcgtctgttcncgacgtacgccgtagacgggtacgacgactagtaacttaactcgtcgacccttagtaacctttaggtttgtcggttgaaccgtgtacgtcgttaacgttcgggacggtaaacggccaaggctcggtacccttagtaacggtcaacgggtacccaaggttcctaacccggccccgttacggcctaccgtcttcccgtcccgttaccccg

SEQ ID NO: 133471 - DNA, 699 bp, Homo sapiens
  misc_feature: GYAE6OF01EXH3C.17.33.C11.1.454.CMB.1.raw
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
tcagcgtagactagcacgaccggtgctcgatttagagtgagctcgttggggtttggggggcgccaggggtcccttcaatatcagcaccatggcctggactcctctctttctgttcctcctcacttgctgcccagggtccaattctcagactggtggtgactcaggacgccctcactgactgtcgtcccagggaggacagtcactctcacctgtcgccttaccaactacgtggaacgctaacgtccaaccgtagtctcttaactactaccaaacgttcggttaccagacaacgtaaacccgtgggaacaagcccaaccggacggtacactactaatttaactaacgtaaacaaaaccaaactaaacctacctcccgtacggaccccctcggacccttacttcctacgacgtcctcccgtccggttggggacaagctcgcctnactntgtntggngtcgcncgtccgaggacgacggtacggcgttacgactttatccggttcacctttaccgttattcggtttagggtggtcgtacgttggtgtaaccgtttcgggtacggggtacgggaacggtacgtaacgtcggtcgttaaccggttagttaaccgaccgttccgacccggtaaggccctacccgggtccccgtcggttaccctacccgttccgttccccgttccccggtcccctttccgtacccgg

SEQ ID NO: 133472 - DNA, 734 bp, Homo sapiens
  misc_feature: GYAE6OF01DH6DP.17.33.C11.1.454.CMB.1.raw
  modified_base (234)..(234): a, c, t, g, unknown or other
  misc_feature (234)..(234): n is a, c, g, or t
tcagcgtagactagcacgaccggtgctcgatttagagtgagctcgttggggtttggggctggcgccaggggtcccttccaatatcagcaccatggcctggactcctctctttctgttcctcctcacttgctgcccagggtcaattctcagactgtggtgactcaggagccctcactgactgtcgtcccgagggagggacagtcactctcacctgtcgcttaccaacacgtgganccgataccaccaggtctactttaactactacctaaacgtcggttccaaggacaacgaaaccgaggaacaacgaccgaccggaacggcaactactaattttacaacgtaaacaaacaaactaaaccgacctaccgtaccggacccctacggaccctacgttcctacgtacggtacctcccgttccggtacgggggaacaacgtcgtccgaccgtacgacgtaacgtcgtacggttgtagtcgaccgacgccgtagggaacggacggtagtcgtaagtaaccttagtaccgtacgtacccttaacgttctttacgggtttggtcgtcgttcgtggtctacggttacgtacggggtacgggaacggtaaccctaggggtctaccggtacccggttaacgtttaacggaccgtaaccgggaacccgaaccggtcccgttacccggtaccccccgtaacgggttccctaacccggttccccgttacccggtccccccggttcccc

SEQ ID NO: 133473 - DNA, 748 bp, Homo sapiens
  misc_feature: GYAE6OF01DFJI2.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcaggacgccctcactgactgtcgtcccaggaggacagtcactctcacctgtcgcttaccaacacgtggagcgacgtacaaccgtagtcgtacttaactactaccaaaacgttcggttaccagacaagtaaaccctgggaacaacgccacccgagggtccaactctaatttaacgaacgtaaacaaaacaacaaaaccactacccgtaccggaccctcgacctattaactccgaacggtcctaccgtcggtagggacaacgtctacgccctagaccgtacgtgtcggttggtacgtcgacgtacggtccgtagggaacggacggtaacggtcgtaacgttaacgttaacttacgtacgtaccctttacgttaccgtttacgttttgggtcggttcgtcgtttagcggtacccgtttagggttaccggggacgggtaaccggtaacccgtaaggtccgttaccgggtaaccgttaaccgtttaaagggtccgaacccgggtaacccgtaacgggccccgttaccccgggacccccttaggggttacccccttaacgtttccccggttacccgttcccccttaacccccg

SEQ ID NO: 133474 - DNA, 537 bp, Homo sapiens
  misc_feature: GYAE6OF01E4IQM.17.33.C11.1.454.CMB.1.raw
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcacggctccctccttggggcaaacgctgccctgacactgtctgtgtgcagccctgacggacgaggctgactattactgcctactcttactttggtggtnctgtgnttattcgggcggagggaccaagctgtaccgtcttaagtcagaccctaaggccgtacgcccccgtcggcctaacgtccttcgttcccctacccc

SEQ ID NO: 133475 - DNA, 762 bp, Homo sapiens
  misc_feature: GYAE6OF01B314G.17.33.C11.1.454.CMB.1.raw
  modified_base (276)..(276): a, c, t, g, unknown or other
  misc_feature (276)..(276): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttccaacactggagcagtcacctagtgcttacataccaaacgtcggtcagacaagtaaaccnggaacaagcaacccgagggcaactcatttaacaagtaaccaaacaaacaaacacctacctacggacccctcgacccgtaattcgtacaacggtcctaccctaccggttaggggaactaaaacggtcctacgacccgttacgacgtaacgttcggttaccgtgggtacgttcggaccaacggtaccgtaggaacgggaacggtaacggtacgtaacgtaacgtttaacgttaaccgttacggtacccttaaccgttacccgttaacggttttacgggttggttacggtccgtttagggttaccgtaacgtttaacggttaccggggaccgggtaaacggggtaacccgtaaacggtaccgttacgggtaccccggtttaacgtttaaaccggtaccgaaccggtacccgtaaacgggcccgttacccggtaccccccgttacgggtaccctacccgtttccgttacccggtttcccctaaacccccg

SEQ ID NO: 133476 - DNA, 599 bp, Homo sapiens
  misc_feature: GYAE6OF01EVU7I.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcactgtgcttccaacactggagcagtcaccagtgacttactatacaaactggtcagcagaaacctgacaagcaccaggcactcatttatagtaacaaacaacaaacactcctacggacccctcgacccgaattcgtacacggcctcccgtcgttcggggacaaacgctcgccctagactactgtcgtggtgtgccaggcctaggacggacggagctagtaactagttactcgtacctcttaccttacgttttgggtggtcgtcgttaggttcgtacttacgttcgggacgggaacggaccgaacgtcgtacggtacccgtacttaaaggtccacgacccgaacggcctcccgtcccccgttcggtacacccgttcgttcccgtccccgtcccc

SEQ ID NO: 133477 - DNA, 676 bp, Homo sapiens
  misc_feature: GYAE6OF01EELK9.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtgcttccaacactggagcacgtcaccagtcgtcttactactccaaactgttaccagacaagaaacctggaacaagccaccaggcactctatttatacgtaacaaacaacaacactcctacgacccctcgaccgtatctacgacgtcctccctcggttcggggacaacgtctcgcctacgactactgtccgttgggtcgtcgacgacgtccgtaggaacgggacggaggtccttaggtaaccttagtttaaccgtcgtaccctttaccgtttaccgtttacggttttgggttcggttcgtccgttggttaccgtcgtttaacggttcggggacgggtaaccgggaacgtaacggtcgtacgtacccggttacgtttaacggccgtaacgacccgaacggtcccgtccccgggtccccgttccggtacctacccgtttccgtttcccgttcccccgtaccccg

SEQ ID NO: 133478 - DNA, 914 bp, Homo sapiens
  misc_feature: GYAE6OF01C79WU.17.33.C11.1.454.CMB.1.raw
  modified_base (161)..(161): a, c, t, g, unknown or other
  misc_feature (161)..(161): n is a, c, g, or t
tcagcgtagactagcacgaccggtgctcgatttagagtgagctcgttgggtttgggggcgccagggtcccttccaatatcagcaccatggcctggactcctctcttctgttcctctcacttgctgcccaggtcaattctcagactgtggtgactcaggacnccctcactgactcgtcgtccccgaggaggactagtccactcctccaccgtgtctaccttaccaacacgttggacgactacgtaccaccgtagtcgtacttactactaccgtaaagtcggttaccagaccaacggtaacctaggaacaacgacccgtaaccggacggtactactattaaacgtttaataaacggtaaacccaaaacaaacctaacccgaacctttcccggaacccggtacccctccgaccccgttagttacctacgacccggtcctttaccccggttacgggttaacgggaccctaaacggtccgcccgtaccctaggtaacctaccggttcgttacggtggttaccggtacgtaccgtaccgtccggtaagggaccggttaacgggaccggtacgtacggttaaccgtttaaccgtaccgtttaccgacccgtttaccgtttaaccggtttaccgggttttagggttcgttccggtacgttcccggttccggttacgtttacccggggttaaccggggtaaccgggtaaccggaacccgttaccgggttaccggttaaaccccgggttttaaaccgggttttaccggtaaaccccggttaccggttaaaccccggaaccccgggtttacggccccggtttaacccccccggttccccgggttacgttaccccccgtaacccgttttcccccgtttaccccgggtttacccccccttaaccccgggttacccctttaacccggg

SEQ ID NO: 133479 - DNA, 854 bp, Homo sapiens
  misc_feature: GYAE6OF01C0AB7.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctcgcccaggtccaattctcagactgtggtgactcgaggacgccctcactgactgtcgtcccgaggaggacagtccactcctcaccttgtcgtccttaccaacgtacgtggacacgacgtaccaccgtagttcgtaccttaactactaacctaaacgttcggttaccaagaccaaacgtaaaccgtggaaccaaacgacccaaccggacggactactacttaattttaactaaacgtaaaccaaaaacaaaccaaaacctaccgttaccgtacccggacccctcgtacctacttcctaccgacgttccccttcccggttaccgggttaacggggaacctaaacgtccgtacccgcccgttacggaacccttcggttacgttccgggttacggttcggtaccggtaccggtacgggttcccgtaaggggtaaacggggtccggtaacgggtacgtttaaaccgtttaaccgtttaaccgttttaacccgtccgtttaaccccgtttaactttccggttttaacgggtttgggttcggttcgtacgtttggttacgttacggttaaccgggttcggggtaacgggaaccggtaaccgtacggttacgtaccggttaccgtttaacgtaccggtaccgaacgtcccggtaacgcccgttaccccggtcccgttaccggttaccctacccgtttcccgttccccgtacccccgttcccttcccggttaaccc

SEQ ID NO: 133480 - DNA, 569 bp, Homo sapiens
  misc_feature: GYAE6OF01D7UON.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctagacccctgcccgattctcacggcctccctccgttggggacaaagcctcgccctgacactgtcgtggtgtgcagcctgaggacgaggctgactattactgtcctactcttacgtttgggtggtgtcgttgtgcgttagttcgggcggacggaccgaagtctcggtaccgttacgttacgtcctacggacccgaacggcctccggccccccgttcggtaccctaccttccttccgtccccctacccccg

SEQ ID NO: 133481 - DNA, 666 bp, Homo sapiens
  misc_feature: GYAE6OF01EMX01.17.33.C11.1.454.CMB.1.raw
  modified_base (242)..(242): a, c, t, g, unknown or other
  misc_feature (242)..(242): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtncttactatccaaactcggttccagtcagaaacctggaacaagccacccagggcactcatttatagtaacaaacaacaaacactacctcggacccctcgcccgattcctcacgcctcccgtccgttggggacaaagctcgccctgaccactgtcttgggtagtcgctacgccgtaggacgggacggacgggcgtacgtacttaagttaccgtcgtacccttacgttcctttaacgttttgggtgggttgtcgttggtacgtcgtacggtttccgggacgggtaacgggacccgtaacggtcgtaccggtaccggttaccgtttaaacggttccgtaacggacccgtaaacgggtcccgtacccgtaccccccggttcccggttaccctacccgtttccgttcccgttaccccccgttaccccccg

SEQ ID NO: 133482 - DNA, 598 bp, Homo sapiens
  misc_feature: GYAE6OF01AW202.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccgagtcgcttaactactccaaaacgtggttaccagcagaaacctggacaacgccaccagggcactcatttatagtacaaacaaacaaacactccgacgacccctgcccgactctcacgctccctcgtcggggcaaacgctcgcctcgacactgtcgtggtgtgcacgccgtacggagggacgaggtctagtacgttacttactcgtccttaactcttacgtttgggtggtcgtcgttgtcgtcttaggttccgggacgggacggacgtagcgtcgaccgttacgtacgcgaccgccgtaggtccgtccgtccccgtaccggtcctacctccgttaccgttcccccgtcccgttcccgttacccg

SEQ ID NO: 133483 - DNA, 922 bp, Homo sapiens
  misc_feature: GYAE6OF01B8BHP.17.33.C11.1.454.CMB.1.raw
  modified_base (231)..(231): a, c, t, g, unknown or other
  misc_feature (231)..(231): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacactggancagtcaccagtcgcttaactactaccaaactcggttaccagacaacgaaacctaggaacaacgccaacccgaggcactctaatttataacgtaaccaaaacaaaccaaaacctaacctaccgtaccgggtaaccccctacggaccccgtactttcctaccgtacggtacccgttccccgttacccgggttacggggggaacctaaaaacgggcccgttaccggtaccccgttacggtaaacccgtaacgtttccggtttacggttcggggttcgggttacggacccggtaaccgggtacccggtttacggggaaacggggtacccgggaacgggtacccgttacggttaaaccctttaacgttttaacccgttacggttacccccgtttaacctttacccggtttttaaccggtttttggggttcgggttcggttaccggttttcggttacgggttacccgttttaacgggttacccgggggtaaccggggtaaaccggggtaaccccggtaaacggtaccggttaaccgggttaaccccggtttaaccgtttaaaccgggtacccgtaaccccgggtaacccccggtaaacggggttcccccgttaacccccggttccccccgttacccggttaccccgttaaccccgttcccccggttttaccccgttacccccccgttaacccccccg

SEQ ID NO: 133484 - DNA, 718 bp, Homo sapiens
  misc_feature: GYAE6OF01CRFBZ.17.33.C11.1.454.CMB.1.raw
tcagcgtagactagcacgaccggtgctcgatttagagtgagctcgttgggtttggggctggcgccagggggtcccttccaatatcagcaccatggcctggactcctctctttctgttcctcctcacttgctgcccagggtccaattctcagactgtggtgactcaggacgccctcactgactgtcgtccccaggacgggacagtcactctcacctgtcgttccaacactggagcagtccaccagtcgtacttactactacctaaacgttcggttaccagacaaacgaaacccgtagggaaccaacgaccgaacccgagggaccacgtactaattttaataacgtaaacaaaacaaccaaaccacctaccgtaccggacccctacgacccgtacttccgacgaccggtccttacccgtccgttcgggggaccaaacgtctaccgccctaggacctacgtcgtacgtggtcgtcgacgtaccgcgtaggacgggtacgaaggtccagtacttaattaccgtacgtacccttactcgttacgtttgggtcgttacgtcgttagtcggtacgttacggtacgggaccgggtaaggaaccgtaggacccgttacggtaaccgttacgttaacggtacccgacggtaacccgtacggtcccgtcccgtcccccgttacgtccgtacccgttcccgtcccgttcccccgtcccccgttaacccgg

SEQ ID NO: 133485 - DNA, 536 bp, Homo sapiens
  misc_feature: GYAE6OF01E4O81.17.33.C11.1.454.CMB.1.raw
  modified_base (296)..(296): a, c, t, g, unknown or other
  misc_feature (296)..(296): n is a, c, g, or t
  modified_base (526)..(526): a, c, t, g, unknown or other
  misc_feature (526)..(526): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactgtccagcagaaacctggacaagcacccagggcactcatttanagtacaaaacaacaaacactcctcggacccctcgcccgtattctcaggcctccctccgttgggggcaaacgctcgccctgacactgtctggtgtgcagcctgacggacgagctagactattactgcctactctactttggtgtgtctgtgtctagttcgggcggtacggaccagcgtcgtacgtcttaagcacgcccaagcctccgccccgtcgtctactctcgttcccnccctcctccg

SEQ ID NO: 133486 - DNA, 857 bp, Homo sapiens
  misc_feature: GYAE6OF01D5KGX.17.33.C11.1.454.CMB.1.raw
tcagcgtagactagcacgaccggtgctcgatttagagtgagctcgttgggtttgggggcgccagggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtgcttccaacactggagcagtccacctagtcgtcttactactaccaaacgtggttaccagcaacgaaacctggacaagcacccagggacactctatttacgtaacgtaacaaaactaacctaaacaccgttacccgtacggaacccccttggaccccgtactttcccgtaccgtacgggacccttccccgtaccggtttacggggggaccaaaacggtccgtacggtaccccttacgaacctaacgttcggttacgttacgggttacgttacgtaccgtacggtacccgttacggaaccggggtacggaacgggtaccgttacggtaacctttaacggtttaaccccgttcgtacccgtttaacccgttaccggtttaccggtttttacggggttacgggttacggtaccgtttgggttaccggttaccgtttacggttaccggggtaccggggtaacgggtaaccccgaagggttccgttaacgttaccccgtttacgtttaaacggtacccgttaacccggaaccccggtaaccgggttacccgttccccgggtacccccctttaccgggttacccgttaacccctttacccggttaccccgttttacccccccgaaccccgtttcccccggtttaacccgg

SEQ ID NO: 133487 - DNA, 705 bp, Homo sapiens
  misc_feature: GYAE6OF01A4QIB.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagcccctcactgactgtcgtccccaggagggacagtcactctcacctgtgcttccaacactggagcagtccaccagtcgcttactactaccaactggttaccagcaacgaacctggaacaagccacccgagggcactctatttatagtaacaaacaaacaaacactcctacgacccctgcccgtacttcctcacggtcctccccgtcgttacgggggacaaacggcctcggtcccctagacctaccgttcgttcggtcggttcggtcgccgacgtccgtaggaacgggtaccgggacggtcgtacgtaactttacgttaaccgtccgttaccttaccgtttacgtttaccgttttcggggttcggtccggttcgtttaggttcgtacggtttcggtaccggggtaccggggaacggaccgtaacggtcgtacggtaccgttcgttaacgtccggtaaccgacccgtaggccccgtacccgtcccccgttcggtacccttaccttccgttaccccttcccccgtccccttccggtttaccccg

SEQ ID NO: 133488 - DNA, 685 bp, Homo sapiens
  misc_feature: GYAE6OF01A8NIP.17.33.C11.1.454.CMB.1.raw
  modified_base (227)..(227): a, c, t, g, unknown or other
  misc_feature (227)..(227): n is a, c, g, or t
  modified_base (324)..(324): a, c, t, g, unknown or other
  misc_feature (324)..(324): n is a, c, g, or t
  modified_base (343)..(343): a, c, t, g, unknown or other
  misc_feature (343)..(343): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtcgcttaccaacncgtggagccagtccaaccgtagtcgtctttaactactaccaaaacttggttccaggtccaagaaaccgtggaacaagccaccgaggcactcatttanagtaacaaacaaacaaacnctacctcggaacccctcgacccgtattcctcgacggccttcccgttcggttacggggaccaaacgtctcgtccctgaacctcgtcgtcgtggtcgtcgcgacgccgtagggacggacgacggtctagtactacgttactcgtaccttacttctttacggtttggtggttcgcgtttggtacgtcgttacggttcgggacgggtacggaaccgtacggtcgttaccggtaccgttaacgttaaccggcgtaccggtaccccggtaacgggtcccgttaaccccggtcccccgttacggtccccgtaaccgtttcccgttaccccgttacccccgttacccccg

SEQ ID NO: 133489 - DNA, 773 bp, Homo sapiens
  misc_feature: GYAE6OF01DFQ83.17.33.C11.1.454.CMB.1.raw
  modified_base (169)..(169): a, c, t, g, unknown or other
  misc_feature (169)..(169): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacnccctcactgactgtcgtccccgaggagggacagtcactctcacctgtcgccttaccaacacgtggagccagtaccacctaggtgcttactactacctaaacgtaggttaccaggacaacgtaaaccctaggaacaaacgaccgaaccccgaacggggacctacctacttaatttaactaacggttaaaccaaaaccaaacaaaacctaccttacccgtaccggaacccccgtaccgaccccgtacttacctacgacggtaccctccccgttcggttcggggacaaacgtccgtcgtacccgtacgacgtactacgttcgtacgggttcgcgtacgacgtcgtacgggaacgggacggacggtcgtacggtaacgtttacgttacgttaccgtacccttaaccgtttccgtttacgtttacgggttcggttcggtcgttaggtcggttacgttacgggtacggggtacgggtacgggtaaccgaacggtaccgtacggttaacccgttacgttaacggtacgtaaccggacccggtacggtccgtccccgtaccccgttccggttaccctacccgttcccgttcccgttcccccttaaccccccg

SEQ ID NO: 133490 - DNA, 710 bp, Homo sapiens
  misc_feature: GYAE6OF01A2242.17.33.C11.1.454.CMB.1.raw
  modified_base (231)..(231): a, c, t, g, unknown or other
  misc_feature (231)..(231): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccaggtccaattctcagactgtggtgactcaggagccctcactgactgtcgtccccaggagggtacagtcactctcacctgtgccttccaacacgtgggacncgaagtccaccagtcgcctttactactaccaaacgttcggttaccagacaacgtaaaccgtaggaaccgaacgaccgacccgacggacactacgtatttaagtaacgtaacaaaccaacaaacgacctacctcgacccctcgaccgtactcctcgacgtcctcccgtcgttcggggacaacgtccgtcgtacctacgtaccgtacgtaccgttctcgggtcgtcgaccgtacgtcgtacggtaacggaccggtacggtacgtacgttaacttacgttaccgtacggtaccctttacgtaccgttttaacgtttcgggttcggtgttaccgttcggttcgtaccgttacggttaccgggtacgggtacggaaccgtacgtcgtaccgtacgttacgttaacggttcaccggccgttagcccgttcccgtacccgtccgtaaccgttctaccgttcccttccctcccttcccgttaacccg

SEQ ID NO: 133491 - DNA, 632 bp, Homo sapiens
  misc_feature: GYAE6OF01AX7L5.17.33.C11.1.454.CMB.1.raw
  modified_base (298)..(298): a, c, t, g, unknown or other
  misc_feature (298)..(298): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcacccagggcactcatttanagtaacaaacaacaacactcctacggacccctagcccgtattcctacacggtcctcccgtccgttgggggacaaacgctcgccctgacactcgtacgtggtgtcgcacgccgtaggaggacgaggtctagtacttattactacgtccttactcttacgtttcgggtagtcgtacgttgttacgacgtttacggttaccgggacgggtacggtaaccgtaacggccgttacggtaccgttacgttaacgtaccgtaaccggacccgtaaggccgtcccgcccccgtcgtacccgtacgttccttacccgttccccgtcccgttcccgttacccgg

SEQ ID NO: 133492 - DNA, 652 bp, Homo sapiens
  misc_feature: GYAE6OF01AN6G6.17.33.C11.1.454.CMB.1.raw
  modified_base (483)..(483): a, c, t, g, unknown or other
  misc_feature (483)..(483): n is a, c, g, or t
  modified_base (513)..(513): a, c, t, g, unknown or other
  misc_feature (513)..(513): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtccaccagtcgacttactataccaaacgtcggttaccagctaagaaccgtaggacaacgccaccgagggcactctaatttactaacgtaacaaacaaacaaaccactaccgtacgaccccctacgaccccgtactcctccgacggtccttcccgtcggtcggggaccaaacgcctcgtccctagacctacgtcgtcgtggtagtcgcgacgccgtaggacggacggacgtcgtagtaacttacgttaacncgtaccttactcgtttacgttggtacggtntcgtaggtacgtcgttacggtccgggacggaacgggaccgacggtcgtacggtaccgttagttaacgtcgacggacccgtacggtcccgtcccgtccccgtcggtacctaccggttcccttcccggtaccccgtccccg

SEQ ID NO: 133493 - DNA, 660 bp, Homo sapiens
  misc_feature: GYAE6OF01AICTN.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacacgtggagcagtcaccagtgctttacataccaaactcggttccagacacgaaacctggacaagccaccgaggcactcatttaggtataacaaacaacaacactcctcggacccctcgccgtattctacacggcctcccgtccggttacgggggacaaacggctacgcccgtagactacgtcgtacgtgggtcgtcgacgacgccgtaggaggacggtagctagtacttattacgtcgtccttaacttccttacgtttggtcggtgtcgttgtcgtacgttacggttccgggtacgggaacgggaaccgtaacggaccgtacggtacccgttacgttaacgtaccgaccgtacccggtaacggtcccttccggtaccccccgttcgggttaccctacccgttccgttacccgttcccccgtccccgttcccgttacccgg

SEQ ID NO: 133494 - DNA, 780 bp, Homo sapiens
  misc_feature: GYAE6OF01CL2MT.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccgagggtccaattctcagactgtggtgactcgaggacgccctcactgactgtcgtcccgagggaggacagtcactctcacctgtcgccttaccaacacgtggacgaccgtagtaccaaccgtagtcgtacctttactactacctaaacgtcgttaccagacgaacgaaaccgtagaacgaacgaccacccgagggacctactactaagtttaaactaacgtaaacaaaaacaaaccgtaaacacctacccgtaccggacccctcgacccgtactacgtaccgacggtcccttcccggtacgggttacggggaacaaacggtccgtaccgaccgtacgaactacgtcggtcggttagggtcgtggaccgtcgaccgggtagaacggggtaacgtacgggtaccgttaacgtaacgtttaaccgttaccgtacggtaccctttaccgttacgtttaacggtttgggtaacggttgtcgttaggtccgttaaacggttcggtacgggggtaacggaacgggtaccaacggtccggttacggtaaaccggttcgtaaacggtccgaaaccggtaaccccgtcgggtaccctccccggttaccccgttaccggtaaccttcccgtccggtttaccccctccccttacccccg

SEQ ID NO: 133495 - DNA, 663 bp, Homo sapiens
  misc_feature: GYAE6OF01AUO4D.17.33.C11.1.454.CMB.1.raw
  modified_base (214)..(214): a, c, t, g, unknown or other
  misc_feature (214)..(214): n is a, c, g, or t
  modified_base (521)..(521): a, c, t, g, unknown or other
  misc_feature (521)..(521): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgcccgagggagggacagtcactctcacctgtnccttccaacactggagcagtccaccagtcgaccttaactactaccaaactcggttaccagcaacgaaacctggaacaacgccacccgaggcctactctatttaatacgtaacaaaccaaacaactactccgtaccgaccctcgaccgtacttcctcgacgtccctccctccggttaggggaccaaacgctcgcccgttgaacctacgttcgtcgtcgggtagtcgaccacggtccgtagagggtagtcggacggtcgtagtaacttacttaccgtccgtaccttacttcgtttacgtttggtcggtntcgttgtcgtagttcggtcgggacggacggacctacggccgttacgtaccgttacgtaaacgtccgaacgtacccgaggttcccgtcccgtccccgttacggtctacccgttccttccccgttacccctccccgttaccccg

SEQ ID NO: 133496 - DNA, 725 bp, Homo sapiens
  misc_feature: GYAE6OF01CSRSL.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggacgggacagtcactctcacctgtcgcttccaacactggagcagtcaccagtgcttactatccaaacgttcggttaccagaccaacgaaaaccgtcggaacaacggaccaacccgacgggcctaacgtactaattttaagttaacgtaaacaaaacctaaaccaaaactaccgttacccgtacgggtaacccccttagacccccgtacttaccttaccgacggtacccttccccgtccggtttacggggggacctaaacggtccgtacgaccccttagaccgtacgttcgttccgtgggttacgtcgacgacgtccgtagggaacggacggagtcgtagactttacgtacctcgtaccctactccgtttacgtttgggtacggttcgtcgtgtcgtacgttacggttcgggcgggtaacggcgaaggtccgtcggttaccgtacgttacggtccgaaggtaccccgacggtcccgtacccggtcccccttacgggtacccttaccgttccgtttcccgttccccgtttaccccg

SEQ ID NO: 133497 - DNA, 682 bp, Homo sapiens
  misc_feature: GYAE6OF01DXGVE.17.33.C11.1.454.CMB.1.raw
  modified_base (340)..(340): a, c, t, g, unknown or other
  misc_feature (340)..(340): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtcccgaggaggacagtcactctcacctgtgcttaccaacacgtggacgcacgtcaccgagtgtcttaactactaccaaaacttcggttaccaagaccgaacgaaaccgtaggaaccaacgaccaaccccgagggaccacgttacctaatttaanaacgtaaacaaaaccaaacaaacacctaccgtaccgaccccgtcgaccgtaaccttcgtaccgacggtcccttacccgttccgttacgggggaacctaaacggcctaccggaccctaggtacctacggttcgttaccgttgggtcgtcgccgtacgaccgtggaacgggtaacgacgggtctaggtaccttacgttactcgtaccgttactcgtttacgtttggtcggtgtcgtagtctcgtacgtcgggacggacgtacgacgtctacgcctactaacgtcgaactacccggtacgccgtcccgccccgtcgtacctacctcgttcccgtcccttaccccg

SEQ ID NO: 133498 - DNA, 795 bp, Homo sapiens
  misc_feature: GYAE6OF01CH6TI.17.33.C11.1.454.CMB.1.raw
tcagcgtagactagcacgaccggtgctcgatttagagtgagctcggttgggtttggggctggcgccaggggtcccttccaatatcagcaccatggcctggactctctctttctgttcctcctcacttgctagcccagggtccaattctcagactgtggtgactcgaggacgccctcactgactggtcgtcccgagggagggacacggtcactctcgtaccgtgtcgtccttaccgaacgtacgtgggactcgacggtaccaccgtagtcgtacttaccgtatacctaaacgttcggttaccgagaactaacggaaaccgttggaaccaacggacccgaaccgtaagggacctaacgttaccgttaagtttaacaacggttaaaccaaaaccgtaaacctaaacctaccgttacccgtacgtacccccgtaggtaccgtaacttcgtaccgaccggtcctacccggttcgggtacggggacctaaacggccgttcgacccgtacgaccgtacggtcgtcggtggtacggtcgtaccgaacggtccgtacggacgggacgtacgggtctagtaacttacgtaccgtacgttacccgttacgttcgtttaccggtttaggtcgggttcgtcgttaggtaccgtacggttacgttaccggggacggtaacggtaccacggttactaccggttacccgtagtttaaccggccgtacccgggtaccgtacgggttcccgttacccgtacccggttaccggtccttaacccggttcccgttacccgttccccgttacccccg

SEQ ID NO: 133499 - DNA, 595 bp, Homo sapiens
  misc_feature: GYAE6OF01D9CB3.17.33.C11.1.454.CMB.1.raw
  modified_base (310)..(310): a, c, t, g, unknown or other
  misc_feature (310)..(310): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctccacctgtgcttaccaacacgtggagccagtccaccagtgacttactactccaaaactggtttccagcaagaaacctggacaagcacccaggcactcatttanagtacaaacaacaaacactcctacggacccctgacccgattcctacacggccttacccgttcccgttagggggccaaagcctcgccctgacctactcgtcgtggtgtcgcacgcgtgaggacgaggctagacttattacgtctcctacttccgtacgtttggtggtcgtcgttaggtcgtacgttacgtcggacgggacggacgtaagcgtcgtaccgtagttacgcgtacgacccgagtcccgtccgcccccgtcgtcctacttcccttccgtcccgtcccccg

SEQ ID NO: 133500 - DNA, 603 bp, Homo sapiens
  misc_feature: GYAE6OF01AKJOO.17.33.C11.1.454.CMB.1.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (401)..(401): a, c, t, g, unknown or other
  misc_feature (401)..(401): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacnctggancagtcaccagtncttactatccaaactggttccagcagaacctggacaagcaccaggcactcatttatagtacaaacaacaaacactcctcggacccctgcccgtattctacaggcctcccgtccgttcggggacaacgctcgccctgacactgtcgtggtgtcgcgacgtccgngaggacgacggtctacgtacttattacgtcgcccttactcgttacgtttggtgttggcttgtcgtctcgttcgggcggtacggacgtaagtccgtacgtaccgttcttaaacgtccgaacgtccccgtacgggcctcccggtacccccgttcccggtcctacccgttcccttaccgttccccctcccgttccccgttacccg

SEQ ID NO: 133501 - DNA, 678 bp, Homo sapiens
  misc_feature: GYAE6OF01D3ZQ3.17.33.C11.1.454.CMB.1.raw
  modified_base (347)..(347): a, c, t, g, unknown or other
  misc_feature (347)..(347): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactactccaaaactggttcccagcaacgaaacctggaacaagcaccagggcactcattatagtaacaaacaacaaacactcctacggacccctgccgattcncacgcctcccgtcgttggggacaaacgctcgcctgacactgtctggtcgtcgcacgcgtgacgggacgacggtcgtgacttattacgttacgacccttacgttcgttaaccgttttgggtcgggttcgtcgtttcggttcgtacgtttacggttccggggtacggggtaacgggacccgtaacggtaccgttacgggtaacccgtttaccgttaaacgtcccggtaaccggtacccccggtaaacggggtcccgtacccggtaccccccccgttaccgggttacccctaacccggttttcccgttaccccggttcccccgttacccccccg

SEQ ID NO: 133502 - DNA, 897 bp, Homo sapiens
  misc_feature: GYAE6OF01A5Z94.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtccccgaggagggacagtcactctccactgtcgtccttaccaactacgtggacgacacgtccaccagtcgtaccttaactactaccctaaacgttcggttaccctaacgacgtaaacggaaaaccgtacggaaccgaaaccggacccgaaaccccggaacgggaccctaaccgtttaccttaaacgttttaactaaacggttaaaccaaaaacctaaaacccaaaaccctacccgttaaccccggttaccggtaaccccccgttaccggtaaccccgttaacgtttaccccgtaccggtaaccggttaccccgttccccccgggtttacccgggtttacggggggaaccctaaaaccggttcccgtacccggtaccccggttaaccgggtaacccgttaacccggtttcgggtttacccggtttaggggtttccggtacggtacccgttaaccgggccggttaaccgggaacggggtaaccgggtacgggtaccgttacgggtaaccttaccgtttaccggttaccgttaccgtttacccgtttacggtttacggttttcgggttacgggttcgtacggtttcggttcgttacgttacggtaccgggacgggtaacggacgtacgtcgtaccgtacgttacgtacgaccgtacgaccggtacgcccgtcccgtccccgtacgtcccgtacctccgtcccgtcccgtccccg

SEQ ID NO: 133503 - DNA, 834 bp, Homo sapiens
  misc_feature: GYAE6OF01C5L4K.17.33.C11.1.454.CMB.1.raw
  modified_base (241)..(241): a, c, t, g, unknown or other
  misc_feature (241)..(241): n is a, c, g, or t
tcagcgtagactagcacgaccggtgctcgatttagagtgagctcgttgggtttggggctggcgccagggtcccttccaatatcagcaccatggcctggactcctctctttctgttcctcctcacttgctgccccagggtccaattctcacgactgtggtgactcaggagccctcgactgactgtcgtacccgaggagggacacgtcactctcacctgtgtccttaccaactacgtggaacnccagtccaccgtagttcgtaccttaactaacgttacccgtaaaacgttcgggttacccaacggaccgaaccggtaaaaccggtaggaaccgaacggacccgaaccccggacggggtacctaccttacttaacttttaacgtaacggtaaacctaaaaaccgaaaaccctaaaaccctaacccttacccgtacccgggtaacccccgtaccgtaccccggtaactttacccgtaccgaaccggtcccgttccccgttaccggttacgggggaacctaaaacggtcctaccggtacccctacgacctaacgttcgtcgttcggtacgtcgacgtacggccgtaggtaacgggacgtacggtactacgtaacgttacgttaaccttcgtaccttacgttcgttaacgtttgggtacggttcggtcgttacgggtacgttccgttacggttaccggggacgggtaacgggtacccgtaacggtccgttaccggtaccgttacgttaaccggtaccgtacccgacccgtaaccggcccgttaccccgcccccggttacggtcccttaccgttcccgttccccgttccccgtacccccg

SEQ ID NO: 133504 - DNA, 662 bp, Homo sapiens
  misc_feature: GYAE6OF01A3MRP.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtgtccccaggagggacagtcactctcacctgtcgcttccaacactggagcagtccaccagtgcttactataccaaactggttccagcaagaaacctggaacaagccaccgaggcactcatttatagtacaaacaacaacactccgtacgacccctgacccgtattcctacacggtcctacccgtcggttaggggacaaacgctcggcctagacctacgtcgtacgtggtgtcgactacgccgtacggacggacggagggtacctacggtaacttaagttaccgtacgtacccgttacttccgtttaacgtttcgggtacggttcgtcgttgttcgtacgttacggtcggggaccgggtaacggtaccaaggtccgttacgtaccggttattaaccggtccgacggtacccgtacggccgttccggcccccgttggtaccctaccgttcccgttacccgttccccgtcccgttcccgtacccg

SEQ ID NO: 133505 - DNA, 760 bp, Homo sapiens
  misc_feature: GYAE6OF01EERW1.17.33.C11.1.454.CMB.1.raw
  modified_base (378)..(378): a, c, t, g, unknown or other
  misc_feature (378)..(378): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtcccgaggaggacagtccactctcacctgtcgccttaccaacacgtggagcacgtccaccgtagtcgtaccttaactactaccctaaacttcggtaccagacaacgaaaccgtgaacacgccaaccgacggccactactatttacgaacgtaacaaacaacaactacctcgaccgaccctcgaccgtatccncgacgtcctcccgtcggtagggacaagtcgtcgcccgtgacctacgttcggtcgtggtacgtgacgacgtccgtaggacgggacggtacgtctacgtaacgttacttcgtacgtacctttacgttacgtttggtttcggtcggtcgttaccgttggtacggttcgtttaacgggtccggggtacgggtaaccggtaccgttaaccgggtccgttaaccggggttaaccccgttaaaccggttttaacccgggtacccgtaacccgggtacccccggtaaccgggttaccccgtcccccccgggttacccccggttacccgttacccgtttaacccccggtttcccgttttaccccccggggttccccccctttaccccccgg

SEQ ID NO: 133506 - DNA, 862 bp, Homo sapiens
  misc_feature: GYAE6OF01C57KF.17.33.C11.1.454.CMB.1.raw
tcagcgtagactagcacgaccggtgctcgatttagagtgagctcgttgggtttggggctggcgccaggggtcccttccaatatcagcaccatggcctggactcctctcttctgttcctcctcacttgctgcccaggtccaattctcagactgtggtgactcaggacgccctcactgactgtcgtcccgaggagggacagtcactctcacctgtcgtcttaccaacacgtggacgcagtccaaccagtgtacttactaactacccgaaaacgtcggttacccagacctaaacggaaaacccttaggaaccgaaacgccgaacccgaacggggcactctaagtttactaacgtaacaaaacaaaccaaacacctcctacggacccctgacccgtactctacgacggtccctcccgttccggttacgggggactaaaacgtccgtacgaccccgtcgtaaaccgtcgttacgttcggtcgggttggttacggacgaccgggtccggttaaggacgggtaaaccggacgggtaccttaacggaacctttacgttttaaccgtaccggttaccccttaacgtttaccgttttacggtttcgggggtttacggttcggttccggttacggttcggttacgttacggggtttaccgggggtacggggtaaaccggggtacccgtaaaagggtcccgttaacggtaccccgggttttaaacggtttaaaccgttacccggtaacccgggtaccccggtaaaccggggttaccccggttaccccggtccccccccggttttaacggggtttaacccccaccgttttaccccccggttacccccggttttccccccgtttaaaccccccccg

SEQ ID NO: 133507 - DNA, 753 bp, Homo sapiens
  misc_feature: GYAE6OF01AKME2.17.33.C11.1.454.CMB.1.raw
  modified_base (171)..(171): a, c, t, g, unknown or other
  misc_feature (171)..(171): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccaacactggagcagtcaccagtgcttactatccaaactggttccagcaacgaaacctggacaagcaccgaggcactcatttatagtaacaaacaacaacactcctacggacccctgacccgtacttctcacggtccttccccgttccggttcggggggaccaaacggtcctaccggcccctaggaacctaccgttcggttaccggttcggttcggttacggaccgtacggtcccgttacgggaacgggaaccggtacgggtaccgttacggtaacgttaacgtttaccgtacgttacccgttaaccttaccgtttaacggttttcgggttcgggttcgttcgttcggttcgttacgtttacgggtttccggggaccgggtaacggggtacccgtaacggtcccgtacggtaacccggttcgttaaaccgttccgaaccggtacccggtaacgggtcccgttaccccggtcccccgttccggttaccctacccgttcccgttcccgtttacccccgtccccgtttcccgttaaccccg

SEQ ID NO: 133508 - DNA, 823 bp, Homo sapiens
  misc_feature: GYAE6OF01DDK04.17.33.C11.1.454.CMB.1.raw
  modified_base (250)..(250): a, c, t, g, unknown or other
  misc_feature (250)..(250): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttaccaacactggagcagtcaccagtgcttactanccaaactgttccagcaagaacctgacaagcaccgaggcactcattatagtaacaaacaaacaaactactaccgtacggacccctcgacccgtacttctactaacggtcccctaccccgttcccggttacggggggaccctaaaaaggtcccgttaccggtaccccgttcgggtaaaccctaccgttacgggttcccgttacgggggttcgtttaccggacccggtaaccggtccccggttaaggggaaaccgggggaaaccgggtaccgggtaccgttaacggtaacccgtttaacgtttaacccgttacgggtacccccgtttaactttacccggttttaacggtttttggggtcggggttacggtcccgtttgggttacggtttaccggttaacggtttaccggggaccggggtaaccggggtaacccgaaagggttcccgtacggtaaacccggttacgttaaacgggtaccctaaccgggtacccggtaaacgggtccccgttcccggacccccccggtttaccgggtaccctaccgttacccgttccccggttccccccgtacccccg

SEQ ID NO: 133509 - DNA, 586 bp, Homo sapiens
  misc_feature: GYAE6OF01EP0V1.17.33.C11.1.454.CMB.1.raw
  modified_base (305)..(305): a, c, t, g, unknown or other
  misc_feature (305)..(305): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacacgtggacgcacgtcaccagtgtcttactactccaaactggttccagacagaaacctgacaagcaccaggcactcatttanagtaacaaacaacaaacactacctcgaccctcgacccgtatctcgacgtcctccctccgttcggggacaacgtctacgcctcgactactgtctggtgtcgcacgcgtaggacggacgagcgtagacttatacgtcgtaccttacttcgttagtttggtggtctcgttgtgtcgttagttcgggcggaacggaccagtcgtacgtaccgtacgttagccgtacgacccgtacggccctccgcccccgtcgtacctaccttcccttccggtcccctacccccg

SEQ ID NO: 133510 - DNA, 811 bp, Homo sapiens
  misc_feature: GYAE6OF01DVVBT.17.33.C11.1.454.CMB.1.raw
  modified_base (236)..(236): a, c, t, g, unknown or other
  misc_feature (236)..(236): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcgaggacgccctcactgactgtcgtcccgagggaggacagtcactctcaccgtgtgtccttaccaacacgtggacnctacgtccacctagtcgtacttactactacctaaacgttcggtaccagaccgaacgtaaaccgtaggaaccaacgaccgtaacccggacggtaccaacgttacttaacgttttaacgtaaaacgtaaaaccaaaaacctaaaaccgtaaacctacccgttaccccggtaaccggtaccccctaccggtaccccgttaacgttccgtaccggtaaccggttccccgttaaccccggtccggggttaacgggggaaccctaaacggtcccgtttacccgacccgtagtaacctcggttcgtcggtggtcgtcggacctacggtacggtaggacggtacggtacgtcgtaacgttacttacttccggtacgtaccttaacgtttccgtttacggtttcgggacgttcgtacgttcgggttcgttacgggttccggtaccggggtaaccggaaccggaacgttcggtaccgtaccggttaccgtacgttacggaccgtaaccggccggtaacggccctcccggtcccgtacgttaccctaccgttccgtccccgttacccgccccgttacgttacccgg

SEQ ID NO: 133511 - DNA, 771 bp, Homo sapiens
  misc_feature: GYAE6OF01B2536.17.33.C11.1.454.CMB.1.raw
  modified_base (374)..(374): a, c, t, g, unknown or other
  misc_feature (374)..(374): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctcgccgagggtccaattctcagactgtggtgactcgaggacgccctcactgactgtcgtcccgagggaggacagtcactctcacgtgtcgtcttaccaacacgtggacgacacgtacaaccgtagtcgtacttaactactaccgtaaacgttcggttacaagacgaaacgaaccgtaggaacaacgacccgaaccggtaggacctaactacgtaattttaacaacgtaaacaaaacaaacaaacncctaccgaccgtaccctcgaccgtacttcgacgtaccgtcctcccgttcgggtacgggaacaacgtcctaccgccgtagacctacgtcgtcggtggcgtacgacggtcgtaggacggacgtacggtacgtacgtaacttacgttaccgtaccgtaccgttaccgtttaccgtttacgggtttcgggttaacgggtcgttacggtttcggtaccggtttaccgggttacgggtttaccggggacggggtaaacgggtacccgtaacggttccggtacgggttaaaccgttaccggtttaacggaccgtaccggacccggtacgtcccccggtccccggttaccccgtcgtacccttacccgttacccggttccccttacccccgtcccgtttacccgg

SEQ ID NO: 133512 - DNA, 1185 bp, Homo sapiens
  misc_feature: GYAE6OF01ANVOK.17.33.C11.1.454.CMB.1.raw
tcagcgtagactagcacgaccggtgctcgatttagagtgagctcgttgggtttgggggcgcctagggggtccctttccaatatcagcaccatggcctggactcctactactttctgttcctcctcacttgcctgcccagggtccaagttctccagacttggtcggtgacctcgtaggacgccccttcgacctggaccgttcgggtcgtacccccgaaggggtaggggacaaggttccaaccgtcctccacccttggttccgtcctttaccccaaacaccgttgggacggtccaacggttccgacccgtacggttcgtaccttttaacctagttacccgtaaaaacgttcgggtttacccctaacggcccgtaacggggtaaaacccttagggggaaaccctaaaccggggacccgtaaaccccccggaacccggggggggacctaacccgttacccggtaaagttttttaacggtaaacggtttaaacccaaaaaaccggtaaaacccgtaaaaacccgtaacccttttaccccgtttaaccggggttaaaccccccccctttcggggaacccccccggtttaactttttccccggttaccgtaaaccgggggttccccctttacccccggtttaccccgggttttaccgggggggggtaaacccaaaaaccgggtcccggttttaaccggccccccgtaacggtaaccccgtaacccggttaccgggttacccggtttcggggttacccggttaccgggtaccggtaaccgggccccgttttacggggaacccggggtaaccgggtaacggggtacccgtttaaccgggtaaacccgttaacgttttaacccggtaccggttaccccttaaacccgtttacccggtttaccggtttttaccggggttcgggtttacccggttccgtttacgggtttccgttaccggtttaaccgggtttaccggggacggggttaaaccggggtaacccgttaaacggggtccgttaaccggggttaaccccggttggttttaaaacccggtccggtaacccggtacccggttaaaccggggtcccgttccccgggttccccccgttttaaccggtacccggtttaaacccttttccccggggttaccccgttttaccccgaaacccccccgtttcccgggtttaaacccccgg

SEQ ID NO: 133513 - DNA, 677 bp, Homo sapiens
  misc_feature: GYAE6OF01B2961.17.33.C11.1.454.CMB.1.raw
  modified_base (318)..(318): a, c, t, g, unknown or other
  misc_feature (318)..(318): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccaggagggacagtcactctcacctgtgcttaccaacacgtggacgcagtcaccagtcgtcttactataccaaacgtcggttaccagcaacgaaccgtggaacaacgccacccgagggcactactatttanaagtaacaaacaacaaactacctcctacggacccctcgaccgtacttcctaccgacggccttccccgttcccggttacgggggaccaaacgtcctccgacccgtagacctacgtcgttcgtgggtagtcgcgtaacgtccgtaggacggacggacggtcgtacgtacttacgtacgttctaccgttacttcgttacgtttgggtagtcgtacgttgttaccgtcgttacggttcggggaccggtacggggacctaggtccgtaacgtcccgttaacggttacgtaccgtacgacccgtaacggccttacccggtccccgtacggtacccttaccgttcctcccggttccccctaccccg

SEQ ID NO: 133514 - DNA, 764 bp, Homo sapiens
  misc_feature: GYAE6OF01ESZEK.17.33.C11.1.454.CMB.1.raw
  modified_base (562)..(562): a, c, t, g, unknown or other
  misc_feature (562)..(562): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttccaactacgtggacgcacgtcaccagtgtacttaactactacctaaacgttcggttaccagaccaacggaaaacctacggaacaaacggaccaaccccgaacggggcctacctacgtaacttttaacgtaacggtaaaccaaaaacctaaaacctaaaacctaccttaccgtaccgggtaaccccctcgtacccccgtaattccctacgacggtcctaccccgttccggttagggggacaaacgtccgtacgtcccgtacgtaaccgtacgtcggtacgttcgggtgtcggaccgtacgtccgtacggacgggtacggaacgtcgtaacgtacttaacgtttacncgttaccttaccttacgtttacgtttgggtcgttgtcgttgtcgtacgttacggttacgggacgggtacggtaaccgtacgtacgtcggtaaccgttacgttaacggtaccgaccggtaccccggtagggtacccgttaccccggtacccccgttacgggttaccctaacccgtttccgttacccgtcccccgttaaccccg

SEQ ID NO: 133515 - DNA, 874 bp, Homo sapiens
  misc_feature: GYAE6OF01ENIZE.17.33.C11.1.454.CMB.1.raw
tcagcgtagactagcacgaccggtgctcgatttagagtgagctcggttggggtttggggggcgccaggggtcccttccaatatcagcaccatggcctggactcctctcttctgttcctcctcacttgctgcccagggtccaattctcagactgtggtgactcgaggacgccctcactgactggtcgtccccgagggagggacagtcactctcacctgtcgccttaccaacacgtgggacgaccagtccaaccgaggtcgtacctttaactaactaccgaaaacgttcggttaccaagacgtaacggaaaacccgtacggaaaccgaaacggaccctaaaccccggaacggggacctaacgttacgtaacttttaaacgtaaccgttaaaaccaaaaaccaaacctaaaaccctacccgttacccgtaccgggtaaccccctccggtaacccgttacgtttaccttaccggaaccggttccctaccccggtttaccgggttacggggggaactaaaacgtccgttacccggcccgttacgaaccgttacgttcggttcggtacgggttacggtcgtacgtaccggtccggttagggaacgggtacggacgggtcgttacgtaactttacgtacgtaccgtaccttacgttaccgttagtttagggtcgttcggtacgttcggtacggttccgtagggttaccggggacgggtaaccgggtaaccgtaacggttcccggacgtttaaccggttacccgtttaaacgacccggtaccggtacccgtaccggggtccctccccggttacccccggttacgtcccgttaaccttccccgtttacccggtccccccggttcccttccccgtttaacccgg

SEQ ID NO: 133516 - DNA, 646 bp, Homo sapiens
  misc_feature: GYAE6OF01E1170.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctacacctgtgccttccaacactggagcagtccaccagtgacttactactaccaaactggttaccagcaacgaaacctggaccaagccacccgacggcactcattatagtacaaacaacaacactcctcggacccctcgcccgattctcacgcctcccgtcgttggggacaaagctcgccctacgactactgtcgtggtgtcgcacgccgtagacgggacgtaggctagaccttattacgtcgtaccttacgttcctttaacgtttcgggtaggttcgtccgttaggtcgtacgttagttccggggacggacgggaccgaacggtcgttccggtaaccgttaccgttaacggtcgaccggtaccccggtaacggtccctcccggtcccccgttccggtacccgttacccgttcccgttccccggttccccgttacccccg

SEQ ID NO: 133517 - DNA, 788 bp, Homo sapiens
  misc_feature: GYAE6OF01AZ7JN.17.33.C11.1.454.CMB.1.raw
  modified_base (228)..(228): a, c, t, g, unknown or other
  misc_feature (228)..(228): n is a, c, g, or t
tcagcgtagactagcacgaccggtgctcgatttagagtgagctcgttgggtttgggggcgccgaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggtancagtccaccagtcgacttactactacctaactggttaccagtcaacgaacctggaacaacgcctaaccgacggctacttactacgttttaactaacgttaacaaaacaacgaaaccgtacctacccggtacggaaccccctacggaccccgtaacgtttcgcgaacggtccttcccgtcgttacgggggactaaacgtcgtcgtccctacggaacctacgtcgttaccgtggttacgtcgacgtacgtccgttaggaacgggtacggtacggtacgttacggtaacttaacgtttaccgtacgtacccgttacttaccgtttacgtttcgggttcggttacgtcgtttacggttcggtaccgttacggtaccgggtacgggtacggaacccgtaaggtaccgttaacggtacccggttacgtttaaccggtaccggtaaccggtacccggtaaaccgggtcccgttacccggttaccccccggttaccggttacccgttaacccgtttcccggttacccccggtttaccccgttccccccgtttccggtttaacccccgg

SEQ ID NO: 133518 - DNA, 746 bp, Homo sapiens
  misc_feature: GYAE6OF01EX2W5.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcgaggacgccctcactgactgtcgtcccaggaggacagtcactctcacctgtcgcttaccaacacgtggagcagtccaccgtagtcgtactttaactactacccgtaaaacgttcggttaccacgacaacgtaaaccgtaggaaccaacgacccaaccgagggacctacgttacttaatttaactaacgtaaaccaaaaccaaaccaaacctacctacccgtaccgtaccccgtccggtacccgtacttccgtacgtaccggtcctacccgtcggtacggggacaacgtcctcgacccgtcgacgtacgtcggttcgtggtcgtcgaccgtacgtccgtagggaacggacggtacggtacgttagtaacgttacgttaccgtaccgtaccttaccgttacgtttacggtttggtcggttctcgtcgttgtaccggttacggtacggggtacggtaacggtacgtaacgtcggtaacgttacgttaacgtaacgtaccgtaccggacccgtacgcccgtcccggtaccccgttccgtacccgtcccgtttccgttacccccgtttcccctcccgttcccgttacccgg

SEQ ID NO: 133519 - DNA, 649 bp, Homo sapiens
  misc_feature: GYAE6OF01BVHQ6.17.33.C11.1.454.CMB.1.raw
  modified_base (215)..(215): a, c, t, g, unknown or other
  misc_feature (215)..(215): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
tcagcgtagactagcacgaccggtgctcgatttagagtgagctcgttgggtttggtgctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtncttaccaacactggagcagtccaccgagtcgcttactatccaaactggttccagcaagaacctgacaagcaccgaggcactntatttanacgtaacaaacaacaaacactaccgcgacccctgacccgtacttctcacggtcctcccgtccgttcggggacaaacgtctacgccctgacacgtcgtcgtggtgtgccgacgtccgtggacggacgaggtctacgtacttacttacgtcgtaccttacttcgttacgtttggttcggagttcgtacgtcgtaccgtttaggttcgggacgggacgggtaaccaacggtacgtacgtaacccgttacggttaacgaccgaaccgggtccccgaaacggtccccgttacccgtccccccggttacggttacccctaaccgtttccccgttcccggtttacccccccc

SEQ ID NO: 133520 - DNA, 686 bp, Homo sapiens
  misc_feature: GYAE6OF01BZQ1A.17.33.C11.1.454.CMB.1.raw
  modified_base (172)..(172): a, c, t, g, unknown or other
  misc_feature (172)..(172): n is a, c, g, or t
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
  modified_base (483)..(483): a, c, t, g, unknown or other
  misc_feature (483)..(483): n is a, c, g, or t
tcagcgtagactagcacgaccggtgctcgatttagagtgagctcgttgggtttggggctggcgccagggtcccttccaatatcagcaccatggcctggactcctctctttctgttcctcctcacttgctcgcccgagggtccaattctcagactggtggtgactcgaggacnccctcactggactgtcgtcccgagggaggacagtcactctaccncgtgtcgccttaccaacacgtgggacncacgtccaccgtagtcgtacttaacctaactaccgtaaacgttcggttaccacgacgaacgtaaaccgtacggaacaacgaccgaaccgacggactactactaagtttaacgaactaaaccaaaacaaacaaactaccgtaccgtacgtaccccgtacgaccgtttacgttcgacggtccttaccgtcggtacggggactaacgtcgtcgtccgtacgacgtctcgtacgtagtcgtacncgacgtcgtagggacgacggtacgtcgtagtactaacgttcgtacgtaccgttacgttcgttacggttcggtgtcgtcgttgtacggttcgtacgggtcggacggtaacggtacagtcgttaacgtaccgttagttaacgcgaccgaccgagtcccgtaccgtcccgtacgtcctacttcccgtccggtcccctcgttacccg

SEQ ID NO: 133521 - DNA, 629 bp, Homo sapiens
  misc_feature: GYAE6OF01BZV0M.17.33.C11.1.454.CMB.1.raw
  modified_base (357)..(357): a, c, t, g, unknown or other
  misc_feature (357)..(357): n is a, c, g, or t
  modified_base (586)..(586): a, c, t, g, unknown or other
  misc_feature (586)..(586): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccgaggagggacagtcacctctcacctgtcgccttaccaacacgtggagcagtcaccagtcgtcttactactaccaaactggttccagcaagaacctgaacaagccaccgaggcactcatttatagtaacaaacaaacaaacacctcctcgacccctcgcccgattaccncgacggcctccctccggttcgggacaaacgccgtcgccctcgacctacttcgtcgtggtcgtcgcgacgtcgtaggaacggacggacggtactagtaacttaacttacgttcgtaccctacgttacctttacgtttgggttgtcgtacgttgtcggtacgttcggttacgggcgggtacgggaccgaagtccgtagtaccgttacgttacgtcgacgcccgacgtcccncccgtccccgtcgtcctaccgttccgtccgttccccgtacccc

SEQ ID NO: 133522 - DNA, 677 bp, Homo sapiens
  misc_feature: GYAE6OF01AP7AZ.17.33.C11.1.454.CMB.1.raw
  modified_base (233)..(233): a, c, t, g, unknown or other
  misc_feature (233)..(233): n is a, c, g, or t
  modified_base (537)..(537): a, c, t, g, unknown or other
  misc_feature (537)..(537): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttcgctcgcccgagggtccaattcctcagactggtggtgactcgaggacgccctcactgactgtcgtcccagggaggacagtcactctcacctgtcgtcttaccaacncgtggacgcacgtccacgaggtctacttactactaccaaacgttcgttaccacgcaacgtaaccgtaggaacaacgaccaccgacggctactatacttacgaacgtaaccaaacaaacaacctacctaccgtaccggacccctgtacccgtatccgtacgacgtcctcccgtcggtacgggactaacgctccgtcctacgacgtactcgtcggtcggtacgcgccgacgtccggtaggacgggacgaggtcgtaatacgttacttacgtcgtaacctttacgtcgtttacggttgttacgggtnttcggttacgttcggtaccgtttacgggtccgggacgggtaacggtaaccgacggtaccgtcgtaccgttaacgtcgtacgacccgaccggtcgccgtcccgtacccgttcgtactcctcccgttcccggtcccctcccg

SEQ ID NO: 133523 - DNA, 825 bp, Homo sapiens
  misc_feature: GYAE6OF01D3JQC.17.33.C11.1.454.CMB.1.raw
  modified_base (170)..(170): a, c, t, g, unknown or other
  misc_feature (170)..(170): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcagggacnccctcactgactggtccgtacccgagggagggacacgtacactctacaccttgtcgtccttacccaacacgtggacgcacgtccaccgtagtcgtacttaactactacctaaacttcggttaccacgacaacgtaaaccgtaggaacaacgaccaaccgagggacctactacttaatttataaacgtaaacaaaaccaaacaaacctacctaccgtaccggacccctcgacccgtacttacgtaccgacggtcccgttacccgttcgggttacgggggaacctaaacggtccgtccgtcccgtacgtaaccgtacggttcgttcggttacgggttcgtcgacgtacgtccgtaggaaccgggtacggacgtacgttagtaaccgtttactttaccgttccgtacctttacccgtttaccgtttacggtttttcgggtcgggttacgtcgtttacggtcgttaccggtttacgggttaccggggaccggggtaacggtaaccgtaacggtccggttaacggttacccgttaaccggtttaaccggtaccgtacccgggtaaccccggtacgggtccccgtttaccccgccccccgggtttaccggtacccttacccggttttccccgtttccccggttcccccctttaaccccccg

SEQ ID NO: 133524 - DNA, 792 bp, Homo sapiens
  misc_feature: GYAE6OF01D76QU.17.33.C11.1.454.CMB.1.raw
  modified_base (173)..(173): a, c, t, g, unknown or other
  misc_feature (173)..(173): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctcgcccagggtccaattctcagactgtggtgactcgaggacgccctnactgactgtcgtcccgaggaggacagtcactctccaccgttgtcgtccttacccaaacgtaccgtagggacacgtacgttaccaaccgtagttcgtactttaaactactaccctaaacgttcgttaccacgacgaacgaaccgtacggaacaacgaccgaacccgaggcctaacgtacttaaactttaacgtaacgttaaaaccaaaacccaaaacctaaaccgtacccgttacccgtacccggtacccccgtacggtaccccggttacttccgtaccgtaccggtccccgttaccccgttaccggggttacggggaacctaaccggtccgttcccggacccgtagaccgtaccgttcggtcgtcgggttacggcgtaccgacgttccgagggaaccggtacggtacggtcgttaacgtaacgttacgtttaccgtccgttacccgttacgtttaccgttttacggtttgggttcgtacggttcgttcggttcgttacggtacggtaccggggacggtaccggacgtacgtcgtaccggtacgttacgtacgaccgaccgaccgtaccggcgtccctacccgtatcccgttactccgtccctaccctccctccgtaccg

SEQ ID NO: 133525 - DNA, 780 bp, Homo sapiens
  misc_feature: GYAE6OF01DGQCH.17.33.C11.1.454.CMB.1.raw
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggacgccctcactgactgtcgtccccgagggagggacagtcactctccacctgtgccttaccaacactggagcacgtccaccgtagtcgtcttacactaccaaacgtcggttccagcaacgaaacctacggaacaacgccacccgagggcacgtactatttataagtaactaaaccaactaaacacctaccgtaccggaccccgtacgaccccgtacttcgccgacggtcctaccccgtttccggttcggggggaccaacggtctcccggtaccctcggtaacccacggtttcggttcggttcgggtcggttacgcctaccggtccgtagggaacgggacggacgggtaccgttacgtaacctttacgttaaccgtccgttacccttaccgtttccggtttttaaccggttttcggggtttcgggttaggtttcttagggtttacgttacgggttacgttacccggggacggggttaacgggacccggtacggtacccggttacggtacccggttactttaacggtaccggtaaccggtacccggtaacggtccgtaccccggtcccccggttcgaaccttcccgtttactccccgttcccccgttaaccccccg

SEQ ID NO: 133526 - DNA, 801 bp, Homo sapiens
  misc_feature: GYAE6OF01BKR2R.17.33.C11.1.454.CMB.1.raw
  modified_base (171)..(171): a, c, t, g, unknown or other
  misc_feature (171)..(171): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactggtggtgactcgaggacnccctcactgactggtcgtcccgagggagggacagtcactctccacctgtcgtccttaccaactacgttgggacgctacgtccaacctaggttcgtacctttactactaaccctaaaacgttcggttaaccagacaacgtaaaccgtggaacacgaccgacccggaggcctactacgttaatttaacgaacgtaaaccaaaacaacctaaacctaccgtacccgtaccggaacccccgtcgaccccgttattcccgacgtaccggtacccttccccggttaccggggttacgggggaacctaaacggtccgttaccgaccccgttagtacctacgtttcgtacggttcgggtcggtcgaccgtacggtaccgtaggggaaccggtaacggaccggtacgttaacgtaaccgtttaacgtttccgtaccgttacccgttaccgtttccgtttaacgggtttgggttacggttcgtcgtttggtaccgttcgttacgggtccggtacgggaacggtaccaaggtccgtacggttaccgttaagttacgtccgacccgggaaccgtcggtaccctaccccgggtcccccttacgggtacccttaccgttcccgttccccgtccccttacccccg

SEQ ID NO: 133527 - DNA, 735 bp, Homo sapiens
  misc_feature: GYAE6OF01BTZJZ.17.33.C11.1.454.CMB.1.raw
  modified_base (230)..(230): a, c, t, g, unknown or other
  misc_feature (230)..(230): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgccttccaacactggancagtcaccagtgcttactactaccaaactcggttaccagacaacgaaaaccgtggaaccaacgaccacccgaacgggccaacctctaatttaataacgtaaaccaaaaccaaaccaaaaccaaccttcccgtaccggtaccccctacggaccccgtaactttcctcgaacggtccctccccgttaccggttcgggggacctaaaacggcctcgaccctcgaacctacgtcgttcgtggtcgtcgcacgtccgtaggacggacggaggtctagtaacttagttactcgtccttactccttacgtttggtggttcgtcttggtcgtacgttacggttccgggtacgggaacgggtaccaacggtcccgttacggtaacccgtttacgttaaaccgtaccgtaaccgggtaccccgtaacggtcccggttcccgtccccccggttacggttcccgtaaccctttcccggttaccctttacccccctaccccgtttccccgttaacccg

SEQ ID NO: 133528 - DNA, 691 bp, Homo sapiens
  misc_feature: GYAE6OF01A5TF7.17.33.C11.1.454.CMB.1.raw
  modified_base (428)..(428): a, c, t, g, unknown or other
  misc_feature (428)..(428): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgccttccaacacgtggacgacacgtccaccagtcgtacttactactaccaaacgttcggttaccagtacaacgaaacctaggacaacgccaacccgagggcctaacgtactatttaagacgtaacaaacaaacaactacctccgtaccgacccctcgtaccgtaatcctacgacgtcctcccgtacggtcggggactaagctacgcctagacncttagcgtggtgcgtacgtaccggacctgggacgggtacggacggtacgtacggtaacttacgttaccgtcgtacccttaacgtttccgtttacggttttcgggtggttacgtcgttaggttccgtacggttacggtcgggaccgggaacggaccgtaacggtcgtaccgttacgtaccgttacggtacgacccgaccggtaccggccgttaccccggaccccttcggtacctaccggttcctttacccgccccttacccccg

SEQ ID NO: 133529 - DNA, 596 bp, Homo sapiens
  misc_feature: GYAE6OF01D45LH.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacactggagcagtcaccagtcgtacttactataccaaactcggttaccagcaagaaacctggaacaaggccaccgacggacactacgtatttaataagtaacaaaacaaacaaaccactaccgtacgaacccctcgaccgtacttctacacgcctccctacgttcggggacaaacgctcgccctgaccatgtacgtgtagtcgacacgcgtgaacggacgtagctacgactagttactcgtacctacttcgttacgtttaggtgggtctcgttgtcgtacttagttcggagggtacggaccagccgtagccttagtacgtcacgaccgacgaccgtccgacccccgtgtacctacttcctccgtcccctaccccg

SEQ ID NO: 133530 - DNA, 782 bp, Homo sapiens
  misc_feature: GYAE6OF01AMU3H.17.33.C11.1.454.CMB.1.raw
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtcgccttaccaacacgtggagtcagtccaaccgtagtcgtcttactactacctaaacgttcggttaccacgacaacgaaaccgtggaaccaacgccaaccgagggaccaccttactactttactaacgtaacaaaacaaaccaacctaacctccgtaccgtaccccgaccgtacccgtaacttccgtacgaccgtccgtaccccgttcgggttacgggggtaccaaacggtcctaccgtcccgtacgacctcgtacgttcgtacggtcgtcggtcgtaccgtccggtacggacgggtaccgacgggttccgtaacgtacgtttacgttacctaccgtacccgtttaccttaccggtttacgtttcgggttcgggttcgtacgttgttaccgggtttacgtacggttccggggtaaccggggacgggtaacccgaacggttccgtacggttaacccggttagttaccgggtaccggaccggtacccggtacccgggccgttacccggttcccccggtccgtaccgttaccttccggttaccccggttccccgtccccgttccccgtttaccgg

SEQ ID NO: 133531 - DNA, 704 bp, Homo sapiens
  misc_feature: GYAE6OF01BJS34.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtcgcttaccaacactggagcagtcaccagtgcttactactaccaaactggttaccagacaacgaaacctggacaacgccaccgaggcactctaatttatacgtaacaaacaacaaacactccgtacgaccctcgaccgtactctcacgcctccgtcgtaggggacaacgctcgcctacgactactcgtcgtggtcgtcgacgacgtccgtaggacgggaacgaggtacgtaggaacttacgttaccgtcgtacccttacgttacgtttacgtttcgggttcggttcgtacggtttcggtcgtaccgtttaacgggttcgggtaccggggtaacgggtaaccgtaacggtccgttaacggtaccggtttaaccgtttaaacggtccgtaaccggacccggtaacggtcccgttaccccggtcccccgttacggttacccgtacccgtttcccgttaccccgtttcccccgtacccccgttcccgttaaccccgg

SEQ ID NO: 133532 - DNA, 531 bp, Homo sapiens
  misc_feature: GYAE6OF01D2UX9.17.33.C11.1.454.CMB.1.raw
  modified_base (452)..(452): a, c, t, g, unknown or other
  misc_feature (452)..(452): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaaacaacaaacactcctcggaccctgccgattctcagcctccctccgtggggcaaagctcgcctgacactgtctggtgtgcagcgtgacggcgaggctgaacttatactcgtcctactcttacgtttggtgtgctgtgtctagtcgggnggacggaccagctcgaccgttgtacgtcgacgcccgaggctccgccccgtgtcctctcgtcttcccgccctcctacccg

SEQ ID NO: 133533 - DNA, 850 bp, Homo sapiens
  misc_feature: GYAE6OF01CT9BT.17.33.C11.1.454.CMB.1.raw
tcagcgtagactagcacgaccggtgctcgatttagagtgagctcgttggggtttgggggggcgccaggggtcccttccaatatcagcaccatggcctggactcctctctttctgttcctcctcacttgctgcccagggtccaattctcagactgtggtgactcaggacgccctcactgactgtcgtccccgagggaggacagtcactctcacctgtcgcttaccaacactggagcagtcaccagtgcttactactaccaaactcggttccagacaagtaaaccgtggaacaacgccaaccgaggaccactactaatttaactaacgaaacaaaactaaacaaaacctaccttaccgtaccggtaccccctacgtaccccgtacttaccgtacgaaccggtcccttaccccggttaccgggttacggggggaacctaaacggtcccgttaccggtaccccgttacggtaacccgtaccgtttacggttcccggtttggggtacggttacggacccgtaacggtcccggtaagggaaccggggtaacgggtaacggtacgtttacggtaacctttaacgttaccgttaccgtaccctttaacgttaccgtttacggtttgggttacggttcgtcgtttcggttacgtccggtttaacgggtcggggacgggtaaccgggtaaccgaacgggttcccgttaaccgggtaacccgtttaacgttaaccggtaccgtaacccgggtaacccgtaccgggttccccgttccccggtcccccggtttaccgttaccccgttacccgtttccccggttacccccgtttacccccctacccgtttccccgtttacccgg

SEQ ID NO: 133534 - DNA, 662 bp, Homo sapiens
  misc_feature: GYAE6OF01EXQSV.17.33.C11.1.454.CMB.1.raw
  modified_base (319)..(319): a, c, t, g, unknown or other
  misc_feature (319)..(319): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccagggagggacagtcactctcacctgtcgcttccaacactggagcagtccaccgagtgacttaactactaccaaactggttaccagacaacgaaacctggaacaagaccacccgaggcactactatttaanaacgtaacaaaaccaaacaaacctacctcctaccggacccctcgaccccggtattcctacgacggtcctcccgtccgggttacggggaccaaacgtcctacgccctacgactactgtacgtggtgtcgacgtcgcgtaggacggacgagtcgtagtactacttactcgtaccttacgtcgttagttcgggtgtcgtcgtggtacgtacggttagtacgggacggtacgggacctaacggtcgtacgttaccgttacgttaacgccgtaccggaccggtaaccggccgtcccggtacccccgtcggttaccctacccgttccgttcccgtccccgttacccccg

SEQ ID NO: 133535 - DNA, 634 bp, Homo sapiens
  misc_feature: GYAE6OF01A62V7.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtccaccagtgcttactatccaaaactggttccagcaagaaacctggacaagcaccagggcactcatttatagtaacaaacaacaaacacctcctacggacccctcgcccgtattctcacgcctccctccgttggggacaaagctgccctagacactgtcgtggtgtcgcgacgtccgtaggacggggacgaggtctagaccttaacgttaccgtcgtacccttacttcgttaaccgtttgggttcggttcgtcgttggttcgtacgttacggttccgggacgggtaacgggaccaacggtccgtacggtaccgttacgtttaacggccgtacgacccggacggtcccgtcccgtacccccgtcggtcctaccgttcccgttcccgtcccccgttcccccg

SEQ ID NO: 133536 - DNA, 706 bp, Homo sapiens
  misc_feature: GYAE6OF01AL5ZC.17.33.C11.1.454.CMB.1.raw
  modified_base (168)..(168): a, c, t, g, unknown or other
  misc_feature (168)..(168): n is a, c, g, or t
  modified_base (238)..(238): a, c, t, g, unknown or other
  misc_feature (238)..(238): n is a, c, g, or t
  modified_base (557)..(557): a, c, t, g, unknown or other
  misc_feature (557)..(557): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcagganccctcactgactggtacgtcccgagggaggactagtcactctccacctgtcgtcttccaaacacgtgganccagtccaccgtagtcgtcttactactacctaaacgtcggttaccagcaacgaaaccgtggaacaacgccaaccgaggccactactatttacacgtaacaaacaaacaacctactccgtacgaccctcgacctactctcgacgtcctacccgtcggttacggggaccaaacgtcgtccgtacctacgactaccgtcgttacgtgggtcgtactcggtaccggaccgtagggtaacgggaccgtaacggggtactacggttaaccttacgttaccgtaccggttacctaccgtttcgtttaacgtttgggtcgttacgtnttaggtcgtaccgttacggtacggggcggtaaggacctacggacctacggtaccgttacgttaacggtcctaccgggacccgaccggtccgtccccggtaccccggttcgacccttaccgtttccccgtcccgttaccccggtaccccc

SEQ ID NO: 133537 - DNA, 815 bp, Homo sapiens
  misc_feature: GYAE6OF01C5TPY.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctcgcccagggtccaattctcagactgtggtgactcaggacgccctcactgactgtcgtcccgaggaggacagtcactctcacctgtcgtccttaccaacacgtggacgcagtccaaccgtagtcgtacttactactacctaaaacgttcggttaccaagacaacgaaaccgtaggaacaacgaccaaccggaggacctaacgtacttaattttaacgtaacgtaaaccaaaaaccaaaacctaaaacctaccgttaccgtaccggtaacccccttaccggtaccccgtactttaccgtaccgtaacgggtcccctttccccggttaccgggtttacggggggaaacctaaaccggtcccgtacccggtacccttaacggtaaccgtaccgtttcggtcggttacgggtcgtacggacgtacggtcccgtagggaacgggtacggtacggtccgttaacggttaacttaacgtttaccgtcgttacctttacttcgtttacggttttaggtggttcgttacgttcggttcgtacggttacggttacggggacggaacggacgtaacggtcgtacggttaaccgttacgttaacggtcgaaccggtaccgtaacggtccgttcccggtaccccgttcggttaccctaccggtttcccgtacccgtttccccctcccgtttccgttacccg

SEQ ID NO: 133538 - DNA, 887 bp, Homo sapiens
  misc_feature: GYAE6OF01CZNYK.17.33.C11.1.454.CMB.1.raw
  modified_base (176)..(176): a, c, t, g, unknown or other
  misc_feature (176)..(176): n is a, c, g, or t
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
tcagcgtagactagcacgaccggtgctcgatttagagtgagctcgttgggttggggctggcgccaggggtcccttcaatatcagcaccatggcctggactcctctctttctgttcctcctcacttgctgcccgagggtccaattctcagtactggtggtgactcgaggacgccctnactgactggtcgtcccgagggaggacagtcactcgtacacctgtcnctaccaagcgtggagtcagtccaacgngtcgtacttaactaactacctaacgtcgtaccgaacgtacaaacggtaaaccgtacggaacaacggaccaaccggagggacctacgtaactaatttaactaaacgtaaaccaaaaccgtaaacctaaacctaccgtaccgtaacccggtaaccccgtaccggtaaccccgttaacttacgacccggtaaccggtccccgttaccccggttaccgggttaacgggggaacctaaaaccggtcccgtaccggttacccgtaacgtaacccggtacgttaacggttcggttacgggttacggtacgtacccgtacgggtaacccggttaagggaaccggggtaaccggtaaccggttacggttaacgtaaccgtttaaccgttaccggtacgttacccccgtttaagtttaccggtttaacggtttcgggtacggttaacggttccgtttacgggtccggttaacggtttccgggtaaccggggtaccggggtaacggtaccggtaaccggttaccgggttaacggtaacccggtttacgttaaccgggtaccgtaccggtaacccgggtacggtccccggttacccgtacccccggtacgtaccttacccggttaccgttcccgttaccccggtaacccg

SEQ ID NO: 133539 - DNA, 706 bp, Homo sapiens
  misc_feature: GYAE6OF01DA0FR.17.33.C11.1.454.CMB.1.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (487)..(487): a, c, t, g, unknown or other
  misc_feature (487)..(487): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcaccgtgngcttccaanactggagcagtcaccagtgcttactataccaaactcggttccagcaagaaacctggacaagcaaccagggcactcattactagtaacaaacaacaaccactcctacggacccctcggaccacttctacacggtcttcccgtcggttacggggaccaaaagtccctacggtcccctacgggaacctacgtcgttccgtgggttcggttcgaccgacgtaccggttggaaacgggaccggaaggtccgtagtaccgttactttacnccggttacccttacttaccgtttaacggttttcgggtcgggttcgtcgtaggttcgttaccggtttaggtttccgggggacgggacggggtaacccaaacggtccgtaacggtacccgttagtttaacggtaccgtaccgacccgaaacgggttccctaccccggtacccccgttcggttacccttacccgttctttccccgttccccttaaccccccg

SEQ ID NO: 133540 - DNA, 676 bp, Homo sapiens
  misc_feature: GYAE6OF01C1IXU.17.33.C11.1.454.CMB.1.raw
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtcccgagggaggacagtcactctcactgtcgcttaccaacacgtggacgcagtccacagtgtacttaactactaccgtaacgttcggttaccagtaccaaacgtaaaccgtaggaccaacgacccgaccgaacgggcctaactacttaattactaagtaaaccaaaacaaaccaaacnccgttaccnccggacccctcgacccgtattccacgcgtccttccgtcggtcgggacaacgtctccggtcctacgactacgtgtcgtaggtcgtgcgacgtcgtaggaggacgaggctacggtacttacgttactccgtacctacgttaccgtttacggttcgggtggttcgtcgtaggttccgttagttacgggtccgggacgggtaacggtacgaacgtccgtacgtaccgttataccggtacaccggtacccgagttccccgacccgtccccgttacgtccgttaccttccgtcccgttcccctaccccg

SEQ ID NO: 133541 - DNA, 542 bp, Homo sapiens
  misc_feature: GYAE6OF01AEKOW.17.33.C11.1.454.CMB.1.raw
  modified_base (391)..(391): a, c, t, g, unknown or other
  misc_feature (391)..(391): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttaactatccaaaactggtccagcagaaacctggacaagcaccaggcactcattatagtaacaaacaaacaaacactacctggacccctgcccgaatctcacggcctccctccttggggcaaaagctgcctgacactgtctgtgtgcanccgtgaggacgagctgactatactgcctatctaacttggtgtgctgtgcttattcggcgtagggaccaaacggctcgaccgtacttaacgtcgaagccccaaagggcctcgaccccctccgggtactacctccgttgttcccccgtccccg

SEQ ID NO: 133542 - DNA, 708 bp, Homo sapiens
  misc_feature: GYAE6OF01EQLOT.17.33.C11.1.454.CMB.1.raw
  modified_base (172)..(172): a, c, t, g, unknown or other
  misc_feature (172)..(172): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (534)..(534): a, c, t, g, unknown or other
  misc_feature (534)..(534): n is a, c, g, or t
  modified_base (618)..(618): a, c, t, g, unknown or other
  misc_feature (618)..(618): n is a, c, g, or t
tcagcgtagactagcacgaccggtgctcgatttagagtgagctcggttggggtttggggggcgccaggggtcccttccaatatcagcaccatggcctggactcctctctttctgttcctcctcacttgctgcccaggtccaattctcagactggtggtcgactcgagggacnccctacatgtctcgtccgtacccgaagggaggacngtacnctctcgtcgtgtcgtcctaccaacgtcgnggaacncgtacgtccacgtagtctacttactacaaccgtaacgttcggtacacgtacaacgtaacgtagaacaaccgccgaaccgaggacctaaccgtattaacttacgtaaactaaaccaaaacaaacctaacacctccgaccgtacccgtcaaccgttctacgtaccgtcgtcccgttacccgtacggtacggggaccctaaggtcctacccgtccggtacaccggtacgttcggtacgtacggttcgtacggtacgtacggtcggtacgggaacggtacgtaaccgggtnttaacgtaaccgttataccgtcgtacctacgttttacctgggttcggtcgtcgtagtcgtcgtaagtcggtacggcgaaccgtnacgtctacggtcttaacacgtacaccgaccgtgacccggtccgtacccgtcaaccgttcctccgtacctttccccgacccttcgtacccg

SEQ ID NO: 133543 - DNA, 860 bp, Homo sapiens
  misc_feature: GYAE6OF01A9AF3.17.33.C11.1.454.CMB.1.raw
  modified_base (300)..(300): a, c, t, g, unknown or other
  misc_feature (300)..(300): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcaagaacctgacaagcacccgaggcactcatttanaagtacaaaacaacaaacactacctacggacccctcgacccgtattcctaccgacggtccttccccgttcccggttacgggggaccgtaaaacgtccgtaccgaccccgtacgaccgtaaccgttcggttccgttcgggtacggttcggtacccgtaaccggtccgttacgggaaccggggtaaccgggtaacggggtccgttaaggtaacccgtttaacgttttaacccgttaccggtaccctttaacccgtttaccgttttaaccggtttttcgggggttaccgggtttcggttccggtttacgggttacggttaccggttttaacggggttcccggggtaaccggggggtaaccggggtaaccggaacggttccgttaaccgggtaaccccgggtttaacggttttaaaacccgggtaccggttaaccccgggaacccccggttaaccgggttaccccggttacccccgggttaccccccccgggtttaccgggtttaccccgtaaccccgtttccccggttttacccgggttcccccccccggtttacccccccgg

SEQ ID NO: 133544 - DNA, 841 bp, Homo sapiens
  misc_feature: GYAE6OF01DNCTY.17.33.C11.1.454.CMB.1.raw
  modified_base (178)..(178): a, c, t, g, unknown or other
  misc_feature (178)..(178): n is a, c, g, or t
tcagcgtagactagcacgaccggtgctcgatttagagtgagctcggttggggtttggggctggcgccaggggtcccttccaatatcagcaccatggcctggactcctctctttctgttcctcctcacttgctcgcccgagggtacctaattctcagactggtggtgtactcgaggacnccctcactgacgtgtcgtacccgagggacgggacagtctactcctcgacctgtcgtaccttaccaacacgtggagtaccacgtacaccgtaggttctactttaactaaccttaccgtaaacggtcggttaccagaaccgtaacgaaaccgtcggaaccgaacgccccgtaacccggacgggtacctaacttacgttaaagtttaaccgtaaaacgtaaaacccaaaaaccctaaaacaaaacccgtaccgttccccgtaaccccgggttaccccctaccgggtaacccgttaacttccgtacccggaaccgggttcccccttacccggggttaccggggttaacgggggaaccaacggtccctaacggtcccgtaacggtaccgtacgttggttccggtagggtacgttcggaccgacgggttccggaacggggtacgggtaccgtaaggtccggtaacttaaacgttacgttaccgtcccttaaccgttaccgttaacggtttcggtttgggtcgtccgtggttcgtcctagggttacggccgggacggtaacggacgacgttccgtacgtaccgtttaacgaccggtccgacgcccggtaaccggtccccgttcccggccccgttcgtcctacccgttccctcccggttccccttacccgg

SEQ ID NO: 133545 - DNA, 709 bp, Homo sapiens
  misc_feature: GYAE6OF01C0902.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactaccaactggttccagacaagaaacctggacaagcaacccgagggcactctatttatagtaacaaacaacaaacactcctacggacccctcgacccgtacttcctacgacggtcctccccgttccggttacggggggaccaaaaggtccgtacgtccccgtacgaccacgttgtctgggtgttcgcgtacggccgttaggacgggacggacggtctacggtaccttagttacgtcgtaccctacttacctttacgttttacgggtggttacggtcgttcgttcggtaccgttaggttccggggtacggggtaaccgggaccgaacgggtccgttacggtaacccggttacgttaaaccggtccgtaaccggtaccccggaaacgggtccccgttacccggtcccccggttccggttacccgtacccgtttcccgttcccggtttcccccgttaccccccg

SEQ ID NO: 133546 - DNA, 678 bp, Homo sapiens
  misc_feature: GYAE6OF01B2FXT.17.33.C11.1.454.CMB.1.raw
  modified_base (316)..(316): a, c, t, g, unknown or other
  misc_feature (316)..(316): n is a, c, g, or t
  modified_base (340)..(340): a, c, t, g, unknown or other
  misc_feature (340)..(340): n is a, c, g, or t
  modified_base (460)..(460): a, c, t, g, unknown or other
  misc_feature (460)..(460): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccagggaggacagtcactctcacctgtcgcttaccaacacgtggacgcagtccaccagtgccttactataccaaacttcggttccgagacgaacgaaccgtagacaagccaccgagggcactctatttanacgtacaaaacaacaaccactccncggaccctcaccgtacttccactacggccttcccgtccgttcgggggacaaacgtcctccggcctcgacctactgtcgtggtgtcgcacgccgtggagacggagctagtactacgttacncgtcttacctacgtttacgtttgggtcggttcgacgttcgtcgttacgtttccggttacggggaccgggtaacgggaaccgtacggtccgtaccggtacccgttaccgttacgtacccgaaccgtacccgtaacccgggtccgttccccggcccccgttcccggtaccctcccgttacccggttccccgttcccccgtcccccgttccctttacccgg

SEQ ID NO: 133547 - DNA, 885 bp, Homo sapiens
  misc_feature: GYAE6OF01DWU11.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccgagggaggacagtcacctctcacctgtcgtccttaccaacacgtggacgacgagtccaccgagtcgtactttaactactacctaaaacgttcggttaccacgaccgtaaacgaaaccgtacggaaaccgaaaccgacccgaaccccggtaacggggcctaactttaccgttaaacttttaacgtaaacgtaaaccaaaaacaaaaccaaacctacctacccgtaccggaaccccctcgtacccgtactttccgaccggttacgccccttcccggttccgggttacggggaaccgtaacgtcccgtaccggtaccccgtgaacccgttaccgttcggttcggttcggttggtcgaccgtacggccgtagggaacggtacggtacggtccgttaacgtaacctttaacgttaccgttaccggttaaccctttacgtttaccggttttacgggtttgggttacggttcgtcgtttaacggtcggtacgggttttaccggttccgggggaaccgggttaacgggaaccccgtttaacgggccgtttaaccggggttaaccccgtttaaggtaaccgggttaacccgtaacccggtaacccggtacccgggttacccccgttccccggtccccccggtaaaccgggttccctttaaccccggttcccgtttcccccggtttaccccccttaaccccccgg

SEQ ID NO: 133548 - DNA, 835 bp, Homo sapiens
  misc_feature: GYAE6OF01A8UVJ.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcagggcctcctctgtgtacgtgtcccgtacccggaagggacggacgtacgtacctaccttcctacctaccgttggtccgttcccttaacccaaacctacggtacgggacgacgtaccgtacccaaccgtaggtcttaccttaactacctaacctaacgttaccgtacgacgacgaaaccgtaaccggtacgaacgaccgacccgaaccggacggacctaccgtactttaattaagtaacgtaaacaaaccgaaaacctaacctacccgtacccgtaccccgtacccgtacccgtaccgttacttccgacgtaccgtccccttcccggttaccggggtacggaaccgtaacgtcgtcccgtaccgtacgacctacgttcgttcggtggttcgacgaccgtacgtcggtaagggaaccgggtacggacgttacgtaacgttaactttacgttaccgtcccgttaccctttacgttccttttacggggttgggtacgttcgtggtttgtccgttacgtttaccggggtaccgggaacgggtaacctacgtacggttcggtaaccggttaccgtttagtaccggaccgtaccgtaacccgggtaccgtccccggttacccccgttcccggtagtaacccccttccgttacccgttccccccgtacccccttaccccg

SEQ ID NO: 133549 - DNA, 712 bp, Homo sapiens
  misc_feature: GYAE6OF01B582I.17.33.C11.1.454.CMB.1.raw
  modified_base (229)..(229): a, c, t, g, unknown or other
  misc_feature (229)..(229): n is a, c, g, or t
  modified_base (334)..(334): a, c, t, g, unknown or other
  misc_feature (334)..(334): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcgaggacgccctcactgactgtcgtcccgagggaggacagtcactctcactgtgtcttccaacagtggancagtcaccgagtcgtacttactaactaccgaaacgttcggttaccaggacaaacggaaacctagggaaccaaacgccaaccggagggacctacgtcttaatttanaacgtaaccaaaacaaccaaactaccgtccgtaccggaccctacgacccgttatcgtaccgacggtacctcccggttacggtacggggaactaacgtctaccgtacctagaacctacgtcgtcgtcgggtagtcgaccgtcgtcgtagggacggacggtacgtacgtacgtaacttacttaacgtccgtacctttaacttacgtttacggtttagggtcggttcgtcgttggtcgtacgttacgggttacggggacgggtaaccggtacgacgtacgtaccggttaccgtacgttacgaccgtacggaccgtaacggtccttcccgacccggtcgtacctccggttcctacccgttcccctacccgttcgttaacccg

SEQ ID NO: 133550 - DNA, 929 bp, Homo sapiens
  misc_feature: GYAE6OF01D74I0.17.33.C11.1.454.CMB.1.raw
tcagcgtagactagcacgaccggtgctcgatttagagtgagctcgttgggttggggctggcgccaggggtcccttccaatatcagcaccatggcctggactcctctctttctgttcctcctcacttgctgcccagggtccaattctcagactgtggtgactcaggagccctcactgactgtgtcccaggaggacagtcacgtctcaccgtgtcgcttccaacactggagcagtccacctagtcgcttacgtactacctaaacgttggttaccagaccaacgaaaacccgttcggaaccaacggccgaaccccgacggggtaccaaccgttctaacgttttaactaacggttaaaccaaaaccaaaccgtaaaacctaccgttacccgtaccggtacccccgtcggtacccccggtaatttaccgtaccgtacggtaccccttaccccggttcccggttacggggggtaaccctaaaaacggtcccgttaccggtccccgtacggtaaccgttaaccgttacggtttaccggttacgggttacggtacggtacccgtaaccggtacccgtacgggtaacggggtaaaccggtacgggtaccgtttaacggtaacctttaaccggtttaaccgttaccggttaccccgtttaaccgttttaccgtttaaccgggtttttacggggttaacgggttcggttaccgtttcgggttaccgttacccggttacgggttttaccgggggaccgggtaaccgggggtaacccgtaacgggtaccggttaccgggttaaacccgtttacgttaaacccgggttaccgtaaaccgggtaccccggtaacgggttaccccgttacccggttacccccccggttacgggttacccctacccgtttcccggtttaccccggttcccccgtttaaccccccgg

SEQ ID NO: 133551 - DNA, 660 bp, Homo sapiens
  misc_feature: GYAE6OF01EW1WB.17.33.C11.1.454.CMB.1.raw
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
  modified_base (355)..(355): a, c, t, g, unknown or other
  misc_feature (355)..(355): n is a, c, g, or t
  modified_base (496)..(496): a, c, t, g, unknown or other
  misc_feature (496)..(496): n is a, c, g, or t
tcagcgtagactagcacgaccggtgctcgatttagagtgagctcgttgggtttgggggcgccaggggtcccttccaatatcgagcaccatggcctggactcctctctttctgttcctctcacttgctgcccagggtccaattctcagactgtggtgactcgaggacgccctcactgactgtcgtcccgagggaggactagtcactctcaccgtgtcgccttccaacncgtggacgcaggtcaccgtagtgcttaactactacctaaactcggttccagcaacgaaactgacaanccaaccgaggcactacgtatttactacgtaacaaacaaacaaactacctccgtacgacccncgtaccgtattcgcgacgtcctccgtcggtagggacaacgcgtcgacctgactacgtgtacgtgtacgtcgacgcgtacgtggacgacggagtctagtactattacgtcaccttacgttccgttagtttcggtaggttcgnttaggtgtcgttaacggttcgggtaccgggaagttaaccgaggtcgtacgtaaccggttgttaaccggaccgttaccggacccgtaaggcccgttaacccggtccccgttacgacccttaccgtccgtttaccccggtccccttccccgttcccgttaacccgg

SEQ ID NO: 133552 - DNA, 746 bp, Homo sapiens
  misc_feature: GYAE6OF01B2RAE.17.33.C11.1.454.CMB.1.raw
  modified_base (231)..(231): a, c, t, g, unknown or other
  misc_feature (231)..(231): n is a, c, g, or t
tcagcgtagactagcacgaccggtgctcgatttagagtgagctcgttgggtttggggggcgccaggggtccttccaatatcagcaccatggcctggactcctctctttctgttcctcctcacttgctgcccagggtccaattctcagactgtggtgactcgaggacgccctcactgactgtcgtcccgaggagggacagtcactctcacctgtcgcttccaacactggacncgtacgaccaccgtagtcgtacttactactaacctaacgttcgtacacgtacgaacgtaccgtacgacaacgaccaacggacgacctactacgttaactttaagtaacgtaaacaaacctaaaacaaacctaccgtaccggtaacccgtacccgtaccgtaccgtttacttccgtaccggtaccgttccccttacccggttccggggttaacgggaacgtaaaccgtccgtacccggtaccgtacggtaacctcggttacgtcggttacgtcggtacgacgtaccgtcggtacggaacgggtacgtcgtacgtacgttaacgtatacccgttgtaccttacgttcggtttacgttgggtactgtacgtcgtcgttacggttcgggtacgggaccgggtacgtaaccgtcggtaccgtaacggttccgttaagtacccgtacgaacccgtcgggtaccgtcccgtccccggtacgttccacgttccgttcgttcccctccccgctttcccgtaccg

SEQ ID NO: 133553 - DNA, 740 bp, Homo sapiens
  misc_feature: GYAE6OF01E2ZII.17.33.C11.1.454.CMB.1.raw
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcgaggacgccctcactcgacttcgtcgtccccgagggacgggacacgtcactcctccacctgtcgtccttaccaacctacgtgggacgacctacggtaccaaccgtagtcgtacctttaactaactacccgtaacgttcggttaccacgtaccaaacgtaaaccgtggaaccaacgaccacccgacgggaccacttactaatttaagaacgtaaacaaaaccaaacaacctacctcccgtaccgacccctaccgacccgtacttccaccgacggtcccttcccgttcgggtacgggaacctaaacggcccgtccgaccctacgactacgtcgtcggtaggttcgtacgcgtaccggtcgtacggacgggactacggactacgtaacttacgttaccgtccgttaccctttacgtttacgttcgtttgggtcgtacgtcgttgtacgtacgttacggtcggggacgacggtaccgagtccggtaccgtaccgttaacttacggccgagtacccgacggtcctaccccggttccccgtacggttacccaccgtttccgtccccgttccccgttaccccg

SEQ ID NO: 133554 - DNA, 702 bp, Homo sapiens
  misc_feature: GYAE6OF01BJI4C.17.33.C11.1.454.CMB.1.raw
  modified_base (229)..(229): a, c, t, g, unknown or other
  misc_feature (229)..(229): n is a, c, g, or t
  modified_base (456)..(456): a, c, t, g, unknown or other
  misc_feature (456)..(456): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtcccgagggacggacagtcactctcacctgtctccttacaacncgtggacgcacgtccaacctaggtctacttaacgtactacctaaacgtcggttaccagacaacgtaaacctggaactaacgccaaccgcggactactactaattaacaagtaaaccaaacaaacaacctacctaccacggtaccctcgaccgtatccgacgtcggtaccttcccgtcgggtagggaactaacgtcctacgcccgtagacctacgttcggtcgtggtntcgacgacgtacggtaggaacgacggtacgacgtacgtaacttacgtaccgtactacccttacgtacctttcggtttacggtcgtacgtcgtaggttccgtacggttacgggttcgggaaccgggtacggtaccgtaaggttccgaacggttaccgtaacgttaacgtccgaaacccggccgtaggtcccccgtaccgtccccgttcgtacctaccggtttccccgtcccgttcccccgtaccccg

SEQ ID NO: 133555 - DNA, 1165 bp, Homo sapiens
  misc_feature: GYAE6OF01BJWW5.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacacgtggagcagtccaccagtgacctttactactacctaaacgttcgggttaccagtacaacgtaaaacccgttagggaacaaacggaccaacccccgaacgggggacctaacccttacctaaacgtttttaaacttaaacgggtttaaaacccaaaaaaccgaaaaacccgaaaaaccctaacccgtttacccccgttaaccggggtaaacccccccctttaccgggtaaccccccgggtaaaccttttacccttaacccggtaaccgggttacccccgttccccccggttttaccccgggttttcggggggggggaaccctaaaaacccgggtcccgtttaccgggtaccccccgtttaacggtaaccccgtaaaccgtttaccgggtttaccggtttacggggttacggggttttcgggaccggttaaaccggtccccgggttacggggaacggggggtaacccgggtaacggggtaccccggttaacgggttaacccgttttaaactttaaccccggtttaccgggttaccccctttttaaacccctttaccggttttaaaccccggttttttttacggggggtttaccggggttttcgggttaacccgggttttcgggtttaaccgggtttacccggttttaacggttttttacccgggggggaaccgggggggttaacccgggggttaaaaccccggttaaacgggttccccggttaacgggttaccccggtttaaaccgttttaaaccgggttaaccggtaaccccgggtaaccccgggaaaacccggggtttccccggttaacccccgggtaccccccccccgggttcccgggttttacccccggttaaaccccggtttaccccgggttttacccccggttttacccccccccggtttccccccccggtttccccccgtttttaaacccccccgggg

SEQ ID NO: 133556 - DNA, 658 bp, Homo sapiens
  misc_feature: GYAE6OF01BDW4W.17.33.C11.1.454.CMB.1.raw
  modified_base (358)..(358): a, c, t, g, unknown or other
  misc_feature (358)..(358): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtcgcttccaactactggagcagtcaccagtgcttactataccaacttggttccagcaacgaacctaggaacaagccacccgaggcactactatttagtactaacaaacaacaaacactcctcggaccctacgaccgtattccncgacgtcctccgtccgttggggaccaacgcgtcgcccgtagactacgtcgtcgtggtcgtcgcgacgccgtagaggacggtaggcgtagacttacgtacgtcgtaccctacttacgttacgtttaggcgggttcgtcgttaggtcggtacgttacggttcgggacgggtacggtaccgaaggtccgtacgtacccgttacgttaaccgtaccgtacggacccggtaacggtcccgtcccggtaccccccgtacggtacccgttacccgtaccgtttccccgttacccccgttaccccccg

SEQ ID NO: 133557 - DNA, 729 bp, Homo sapiens
  misc_feature: GYAE6OF01BH0EE.17.33.C11.1.454.CMB.1.raw
  modified_base (223)..(223): a, c, t, g, unknown or other
  misc_feature (223)..(223): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggacgccctcactgactgtcgtcccaggagggacagtcactctcacctgtcgcttaccaacncgtggagacagtcaccgtagtcgtctttaactactaccgaaacgttcggttaccacgtaccgaacgaaaccgtaggaaccaacggaccgaaccccggagggtaccctaactacttaagtttaactaacgtaaaccaaaacctaaaaccaaacctaccttacccgtaccggaacccctcgtacccgtacttcgtacgacgtcccttacccgtcggtacggggacaacggtcgtaccgccgtacgtactacgtcgtcgtggtcgtacgcacgtcgaggacggacgacggctacgtacttacgttacgtccgtactacttcgttacgtttcgggtacgttcggtacttggtacgttacgttacggtccgggtacgggaccggttaacgtacgtcggttacgtaccgttaacgttaccggacctaccggccgtaaccgtcccggtcccgtccccggttaccgtacccgtcccggttccgttccccgttccccttcccgttcccgtaccgg

SEQ ID NO: 133558 - DNA, 612 bp, Homo sapiens
  misc_feature: GYAE6OF01EFNNE.17.33.C11.1.454.CMB.1.raw
tcagcgtagactagcacgaccggtgctcgatttagagtgagctcgttgggttttgggctggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgccttccaacactggagcagtccaccagtgcttactataccaaactggttccagcaacgaaacctggacaacgccacccgagggcacgtctatttaataacgtaacaaacaacaaaccactacctacgacccctgccccgtattcctcacggcctcccgtccggttcggggacaaacgctcgccctacgacctactgtacgtggtgtcgcacgcgtaggaagggacgacggtctaggtaaccttacgttacctcgtacctacttcgttacgtttggtacgtgtcttgtgtcttaggttcgggacggtacggaccgtacgtcgtacgtacgtaacgttacgtcgacgacccgaacggcctcccgccccgtcgtaccaccttcgttccgtccccgtaccccg

SEQ ID NO: 133559 - DNA, 653 bp, Homo sapiens
  misc_feature: GYAE6OF01APCPY.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgttcccgaggagggacagtcactctcacctgtcgcttaccaacacgtggagcagtccaccagtgtcttactatccaaactcggttccagcacgaaacctggaacaacgcacccgaggcactctatttataagtaacaaacaacaaacacctcctacggacccctgcccgtattctccacggtccctcccgtccggttcgggacaacgtctcgccctacgactactcgtcgttcgggttgtacgcgtaacggtccgtacggacgggtaccggaacggtcctagtaaccttactttaccgtccgtacccttacgttacctttacggtttgggtcggtgtcgtggtcgtacgttacggttcgggacgggtacgggaaccgtaacggtcgtacggtcccgtaacgttacgtcccgagtacccgaggccctcccgtcccccgtcgtaccaccgttcttcccggtccccgttccccg

SEQ ID NO: 133560 - DNA, 839 bp, Homo sapiens
  misc_feature: GYAE6OF01COOOU.17.33.C11.1.454.CMB.1.raw
  modified_base (539)..(539): a, c, t, g, unknown or other
  misc_feature (539)..(539): n is a, c, g, or t
tcagcgtagactagcacgaccggtgctcgatttagagtgagctcgttgggtttgggctggcgccagggtcccttccaatatcagcaccatggcctggactcctctctttctgttcctcctcacttgctgcccagggtccaattctcagactgtggtgactcaggacgccctcactgactgtcgtcccagggacggacagtcactctcacctgtcgcttaccaacgaccgtggacgcagtccaccgagtcgtacttaactaactaccgtaaaacgttcgggttaccaaggacaaacggtaaaaccgttacggaaccgaaaacggtcccgaaccccggtaaggggaaccctaaccttaaccgttaaattttaacgtaacggttaaaacctaaaaacctaaaacaaaacctaacccgttacccgtaccgggtaaccccctacgtaccccggtaacttaaccgtccgaacggttccctacccgttaccgggttacgggggacaaaccggtccgtacgtacccgtacgacctaacgtgttccgnggttcgtcgacgtacgccgtagggaacggtacggtacggtacgtacgtaacttaacgttaccgtacgtccgttaccgttacgtttacgttttgggacggttcgtccgttacggtccggttacgtacgggtttaccgggacgggacgggaacccgtacggtcgttacccggtaaaccggtttaccgtaacgggtacccgtaaccggaacccggtaccgggtaccccgttaccccggtacccccggtttccggtaaacccttccccggtttacctacccccgggtttccccgttccccccgg

SEQ ID NO: 133561 - DNA, 644 bp, Homo sapiens
  misc_feature: GYAE6OF01CGYFI.17.33.C11.1.454.CMB.1.raw
  modified_base (172)..(172): a, c, t, g, unknown or other
  misc_feature (172)..(172): n is a, c, g, or t
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (447)..(447): a, c, t, g, unknown or other
  misc_feature (447)..(447): n is a, c, g, or t
tcagcgtagactagcacgaccggtgctcgatttagagtgagctcgttggggtttgggggcgccgaggggtcccttcaatatcagcaccatggcctggactcctctctttctcgttcctctcacttgctcgcccgagggtcctaattctcagactggtggtgactcgaggacnccctcactgactgtcgtacccgaggacggacngtcactcncnctgtnctacatacgnggancagtcacgagtctcttactactacgtaacgtcgtacaagcgaagaacgtgaacacgccacgcgacactactatacaactaacaaacaacactactccgacgacctcgacctactcgaccgacgtcctaccgtacggtacggactacgcctcgcctagcgtacgtcgtgtagtacgcgacgtcgacgtgtaacgggacagtcgtacgtaacgttntacgcgttaccgtacgttcgttaggttcggtagtcgtacggttcgtcgttacggttcggacgggacgggtacgtaactacggtcttaccgggaacctttacggaccgtccgaaaccgtccggtaccggtcccttcccggaacccggttcgttaacccgtccgtacccgtttccccgcccttccccgtagttccccgg

SEQ ID NO: 133562 - DNA, 761 bp, Homo sapiens
  misc_feature: GYAE6OF01CCOMR.17.33.C11.1.454.CMB.1.raw
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactggtcgtccccgagggagggacagtcactctcaccgtgtcgcttaccaacncgtggancacgtccacgngtcgcttactactaccaaacgtggttccagacaagaaccnggaacagccaccgaggcactactatttanaacgtaacaaaacaaacaaacacctccgtacggacccctcgaccgtacttctcgacgtccctcccgttcggttacggggaacaaacgtccgtaccgcccgtagaacctcttcggtacgtgggtacgtcggaccgtacgtccgtacgggaacgggtaccggagggtactacggtaaactttacttaccgttccgtaccttaccgtttcctttaacgggttttgggtacggttgtccgttacggtaggtttaccgtttacgggttcccgggggaagggtaacccgggtaaccctaacgggttccccgttacgggtaaaccccggtttacgttaaaccggcccggtaacccgggaaccccgtaccggtaccccggtacccccgtcccccgggttacggtacccctacccgtttccccgtttacccgttccccccgttaacccccg

SEQ ID NO: 133563 - DNA, 792 bp, Homo sapiens
  misc_feature: GYAE6OF01CTQI0.17.33.C11.1.454.CMB.1.raw
tcagcgtagactagcacgaccggtgctcgatttagagtgagctcgttgggtttggggctggcgccaggggtcccttcaatatcagcaccatggcctggactcctctctttctgttcctcctcacttgctgcccagggtccaattctcagactgtggtgactcgaggacgccctcactgacttgtcgtccccagggagggactagtcactctcactgtgccttaccaactacgtgggacgcaggtccaaccgtaggtgccttaactactacctaaaacctggttacccagtaccaacgaaaacccgtgggaacaaacgaccaccccgaacggggacctactacctaattttaataacggttaaaccaaaaaccaaaccgaaaacctaccttacccgtaccggtaacccccttccggaccccgtaacttcctaccgaccggtaccttccccgttcccggttacggggggaactaaaacggtcctaccggtaccccgttcgaaacctaccgttacggttcgttcgggtggttcggtaccgacggtccgttagggaacggggtaacggacgggtaccgtaggtaaccttacttaaccgtcgtaccccgttacttaccgttttacgtttcggggttggttcggtcgttaggttcgtaccgttcggttcggggacgggtaacggggacctaaggtccgtcggtacccgttacgttaacgtccgaaccggtcccgaaacggtcccgtacccggtcccccgttacggtaccctcgttccctaccgttcccctaacccccg

SEQ ID NO: 133564 - DNA, 834 bp, Homo sapiens
  misc_feature: GYAE6OF01CKT5T.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgccttaccaacacgtggagcagtccaccgagtcgtaccttactactaccaaaacgttcggttaccaagaccgaacgaaaacccgtacgggaaccaaacgcccaaaccccgacggggtacctaaccgttaccttaaagttttaaacgtaaacggttaaaaccaaaaaaccgtaaaaacccaaaaacctacccttaccccgttaccgggaacccccccttaggacccccggttaactttccgtacccggtacggtacccttcccccggttaccgggttaacggggggaaccctaaaacggttccgtaccgggtaccccttacgaaccgtaacccgtttcggtacggtttcgggtacggttacggtacccgacgttacccggttgggaaccgggtaacgggacgggtaccgttacgtaacgttaacgtttaccgtacgtacccgtttaacttacgtttcgtttagggtcgtctcgtagttcgtacgttacgtcggggacggacgtacgacgtcgtacggtaccgttacgtacgtccgtacgacccgtaacggccgttcccgtaccccgttcggtacccttaccgtacccgttcccgttaccccgtcccgttcccgttaacccgg

SEQ ID NO: 133565 - DNA, 740 bp, Homo sapiens
  misc_feature: GYAE6OF01DC6BD.17.33.C11.1.454.CMB.1.raw
  modified_base (457)..(457): a, c, t, g, unknown or other
  misc_feature (457)..(457): n is a, c, g, or t
tcagcgtagactagcacgaccggtgctcgatttagagtgagctcgttgggtttggggctggcgccaggggtcccttccaatatcagcaccatggcctggactcctctcttctgttcctcctcacttgctcgcccagggtccaattctcagactgtggtgactcgaggacgtccctcactcgcgtcggtcgtccccgaagggagggactacggtccaccttctccacctgtcgtccttaccaactcgtggacgcacggtaccacctagtcgtacctttactactaacctaaacgttcgttaccacgacaagtaaccgaggaaccaacgccgaaccggacgggtacctacctacttaactttaactaacgtaaaccaaaacaaaccaaacctacctccgtaccgaccctcgacctactccgtcaccgtcctaccggtcggtacgggaccaacggtcccncgtaccgtacgtaccgtcgtcggtcggtggtcggtcgcgtacggccggtacggacgggtaacggccggttagtacgtaacttcgtaaccgttccgtaccttacgttcgtttacggtttcgggtacgtcggttcgtcggtacgtcgttacggtcggggacggtaaccgaccggtagtaccgttacggtaccgttaccgtaccgacgtaccggtaacccggcggttcccaccccggttcccgttaccgacccttacgttccccttcccgtccccgtttacccccg

SEQ ID NO: 133566 - DNA, 681 bp, Homo sapiens
  misc_feature: GYAE6OF01AOVXA.17.33.C11.1.454.CMB.1.raw
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
tcagcgtagactagcacgaccggtgctcgatttagagtgagctcgttggggtttggggggcgccaggggtcccttccaatatcagcaccattggcctggactcctctctttctgttcctcctcacttgctgcccagggtccaattctcagactgtggtgactcaggagccctcactgacttggtcgtcccgagggaggacagtcactctcacctgtcgcttccaacncgtggacncacgtcaccgagtcgtcttaactactaccaacgttcggttaccagtacaacgaaaccgttcggaacaacgaccgacccgaggcctactctaagtttacaacgtaaaccaaaacaaacaaacctacctccgtacggaccctcgaccctagtcctacgacgtccctccgtacggtacgggaacaacgtctcgccctagacgttacgtcgtacgtgggtgtcgacgcgtccggtaggacgggacgtaggtacctaggtaaccttagttaccgtacgttacccttacttcgtttacggttggttacggttgtccgttgtaccgtcggttcggtacggggacggacggactacggtctaacggtccgttacgtacgtacgacgtccgacggtcctcccggacccgttgtcccgtaccgttcgttaccggtcccctacccgttccgtacccg

SEQ ID NO: 133567 - DNA, 639 bp, Homo sapiens
  misc_feature: GYAE6OF01BWUI7.17.33.C11.1.454.CMB.1.raw
  modified_base (179)..(179): a, c, t, g, unknown or other
  misc_feature (179)..(179): n is a, c, g, or t
  modified_base (207)..(207): a, c, t, g, unknown or other
  misc_feature (207)..(207): n is a, c, g, or t
tcagcgtagactagcacgaccggtgctcgatttagagtgagctcgttgggtttgggaggattcaggacaatctccagcatggccggcttccctctcctcctcaccctcctcactcactgtgtagggtcctgggccagtctgtgctgactcagccaccctcagtgtctcgggaccccggnagaggtcaccatatcttgtctggaaacngctccgcatctacaactaaactatttttgctggtaccagctaattcccaggactcccggcccccgtatcctcatctaataagaaactgaactcgaacgtccggtccccgtccggggttccctcgacccgtatttcctcgtcggcctccagttcgtcttcggcctaaccgtcgacgtcccttccgacgaacctgtacgaggtcgggccttcccgggtaccgaggagtggacgtcagttactttacgttacgtgtcgacgtaccggtaggtctacgactacgtaccgtagtaacgtcgggttcgtcggttcggacggaggtccgaggtcacggactaccgagtccgacgtccgaaggtccgtaccgccccgtaggtcctccgttcctacccggttacccctacccttccggtaccctcgttccgtcggtaccgg

SEQ ID NO: 133568 - DNA, 621 bp, Homo sapiens
  misc_feature: GYAE6OF01ARXK6.17.33.C11.1.454.CMB.1.raw
  modified_base (175)..(175): a, c, t, g, unknown or other
  misc_feature (175)..(175): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (416)..(416): a, c, t, g, unknown or other
  misc_feature (416)..(416): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (461)..(461): a, c, t, g, unknown or other
  misc_feature (461)..(461): n is a, c, g, or t
  modified_base (505)..(505): a, c, t, g, unknown or other
  misc_feature (505)..(505): n is a, c, g, or t
  modified_base (572)..(572): a, c, t, g, unknown or other
  misc_feature (572)..(572): n is a, c, g, or t
tcagcgtagactagcacgaccggtgctcgatttagagtgagctcgttgggtttggggggtcggccgaggggtcccgttccaactatcagcaccatggcctggactcctctctttctgttcctcctcacttgctgcccaggtccaattctcagactgtggtgactcaggagccctnactgactgtgtccccaggagggacagtcactctcacctgngccttccaaacactggagcagtcaaccngtgtcttactatcccaaaactcggttaccagacagtaaaccctcgggacaacgcaaccccgaggccactcgaatttatacgtaacaaactaaacaacgtactccctacggaccccctcgcccgtattccgtacacggtcctacccgtccgttaggggacaaacgctcgacccngacctactgtcctagggntcgacncgccgngtacggacgaggtcngtactatccgtgccttacactttgtttcggcggttgccttggtntaccgttgttcggggaccggtaaggaccacggtatccggacggtctttaagccgactccggagttcncccgtccccgtcgtccgtactcccgttactccccgtcccgtcccttacg

SEQ ID NO: 133569 - DNA, 1047 bp, Homo sapiens
  misc_feature: GYAE6OF01BFD0J.17.33.C11.1.454.CMB.1.raw
  modified_base (236)..(236): a, c, t, g, unknown or other
  misc_feature (236)..(236): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcgaggacgccctcactgactgtcgtccccgaggaggacagtcactctcacctgtcgccttaccaacacgtgggaacncgacgtaccaaccgtagttcgtacctttaacttactaccgtaaaacgttcggttacccgaagaccgtaaaccgaaaaccgttacgggaaaccaaacggacccgaaccccggaacggggtaccaaccgttaactaactttttaacgttaacggttaaaaccaaaaaacctaaaacctaaaaccctaaccgttacccgttacccgggtaaaccccccgttcggtacccccggttaacttaccttaccggtaacccgggttacccgttacccccgtttaccgggttacggggggtaacgtaaacggtccgtacccggtccccgttacgaaccctacgttcgggttcgttcgggtcgggttaccgtaaccggtacggtccggttaacgggaaccggggtaaccggtaacggggtacccgttaacggttaaccctttaacgtttaacccgttacgttaacccgtttaacccggttttaccgttttaacccgggtttttgggttaccggggttcggttacccggtttggtaaccggttttaccggtttaaccggggttacccgggggtttaacccggggaaaccgggggtaaacccgttaaccgggtacccggttaacccgggtttaaacccggtttacccggttttaaaaccgttaaccccgggtaaacccggttaaccccgggtaaacccgggttcccccggttaaccccggttacccccccggtttaaccccggtttacccgttaccccgtttccccgttttacccccggtttaccccccccgttaccccgtttcccccgtttaaacccccggg

SEQ ID NO: 133570 - DNA, 692 bp, Homo sapiens
  misc_feature: GYAE6OF01DNRWM.17.33.C11.1.454.CMB.1.raw
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (375)..(375): a, c, t, g, unknown or other
  misc_feature (375)..(375): n is a, c, g, or t
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggacgccctcactgactgtgtccccaggagggacagtcactctcacctgtgccttccaacactggagcaagtccactagtgaccttacactacctaactggttccagacaagaaaccgtgaacaacgcacccgaggcactactattataagtaacaaacaacaaacnctcncgaccctcgaccatctcgacgcctccctcgttcgggganaaacgccgtcgaccctgactacgtacgtcgtcggttcgtcgccgtacgcccgttaggacgggaacggcgggtactacgtactttacttacttcgtcccttactcgtttacgttgggttcggttaggcttggttacgcgtttacggttaccggggtacgggtaaccgggtaccgtaaaggtcccgttaacggtacccggttttaacgttaaacgtaccgtaacccggtacccggtaaccggcccgtttacccccggggtccccccgttaccggttaccctaccgtttccccgttccccgttcccccgttaaccccccg

SEQ ID NO: 133571 - DNA, 696 bp, Homo sapiens
  misc_feature: GYAE6OF01AO0OS.17.33.C11.1.454.CMB.1.raw
  modified_base (223)..(223): a, c, t, g, unknown or other
  misc_feature (223)..(223): n is a, c, g, or t
  modified_base (466)..(466): a, c, t, g, unknown or other
  misc_feature (466)..(466): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtgcttccaacnctggagcagtcaccagtcgcttactataccaactggtccagacaacgaaaccgtggaacaacgccacccgagggacactcgtaatttagtaacgtaacaaaacctaaacgaaacctacctacccgtaccggaccccctcgaccccgttacttccgtacgaccggtccttaccccgtaccggttcggggggaaccaaacggtcctcggtcccgtaggactaccgttcgtcgtggtgtacgccgngccgtaggacggtacgacggtctagtaacttacgttaccgtccgtaccttacgtcgtttaacgtttcgggtacgttgtaccgttggtacgtacgttacggtaccggggtacgggaacggaaccgtacgtccggtacgtaccgttacgtacgtcgaccgtaccggaacgtccgtcccgtcccccgtggtacccgtctcccgttccggtaccccctcccgttccgttacccg

SEQ ID NO: 133572 - DNA, 859 bp, Homo sapiens
  misc_feature: GYAE6OF01CHD4W.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctcgcccagggtccaattctcagactgtggtgactcgaggacgccctcactgactgtcgtccccgagggagggacacgtcactctccacctgtcgtccttaccaacacgtaggacgacacgtaccaaccgtagtcgtaccttaactactacccgtaaaccgttcggttaccagacgaaacgtaaaccgtagggaacaacgccaaccggacggtactaactactaactttaacgaaacgtaaaccaaaaccaaaaccgaaaacctaccgtaccccgtaccgggaccccctacggtaccccgtaacgttacctccggtaaccggttccccgtaccccggtttaccggggttacgggggaaaccctaaacgggtcccgtaccggtacccctacggtaacccgtacggttcggttccgggtggttacggtaccggtacgaccggtaccgtaagggaacgggaaccggtaacgggtccgtaacgttaacgttacgttaccggttaccgttacccgtttaactttaccggtttacggttttgggtacggttcgttacggtttcggttaccgtacgggtttaacgggttaccggggaacggggtaaccgggtaccgaacgggtccttaaccgggtacccgtttacgtaacgtaccgtaaccggacccggtacggtcccgtacccggttccccgtacccggttacctcccgttcccgttcccggttcccccgtcccccg

SEQ ID NO: 133573 - DNA, 746 bp, Homo sapiens
  misc_feature: GYAE6OF01CBQEU.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccaggtccaattctcagactgtggtgactcaggacgccctcactgactgtcgtcccaggagggacagtcactctcacctgtcgcttaccaacactggagcagtcaccgagtcgtaccttactactaccaaacgttcggttaccacgcaacgaaaaccgtggaaaccaagacccaaccccgaggggaccaccgttactaaattttactaaacggtaaccaaaaaacctaaaaccaaaacctaaccctacccgtaccgggtaccccctaccggccccggtaactttcctaccgacggtcccgttccccttccggttacgggggacaaacggtcgtcgacccgtacgaaccgtcgtacgttcgtagggtggtcgtcgaccggtccgtgggaacgggtacggacgggtcttacgacgtttaacttccgtacgtcccttacttccgtttaagtttcggttggtacgtccgtgttcgtacttacggtacgggtacgggtaacggaccgtacgtacgttacgtaaccgtttacgtaacgtacgcgacccggtaagtccggttcccgcccccgttcggtaccctaccttccgttcccgttaccccctccgttcccgttaacccg

SEQ ID NO: 133574 - DNA, 740 bp, Homo sapiens
  misc_feature: GYAE6OF01E584U.17.33.C11.1.454.CMB.1.raw
tcagcgtagactagcacgaccggtgctcgatttagagtgagctcgttgggtttggggggcgccagggtcccttccaatatcagcaccatggcctggactcctctctttctgttcctcctcacttgctgcccagggtccaattctcagactgtggtgactcaggacgccctcactgactgtcgtccccgaggagggacagtcactcctcacctgtcgcttaccaacacgtggacgcagtccacctagtcgtacttaactactaccaaacgtcgtaccacgacgaacgaaccgacgaacgaacgaccgaccgacgactactataattaacaacaaacaaaccaaacctaaccgtaccgtacccgaccgtacccctaccgtaccgtactaccgaccgtaccgtcccgttacccggtaccgggtacgggaaccgtaaccgtccgtaccgtaccgtacgtaccgtacgtgttacgtggtcgtacgaccgtacgtaccggtaggacgggacgtacggtactacgttaacgttacttaccgtaccgtaccgttacgttcgtttacggtttcggtcggtcgttcgttacggtacggttacggttacgggtaccggggtaaccggtaaccggtaaccgtacggtaccgtaccgtacgttaccgtaccggaccgtaccggaccgtacggtcccgtccccgtcccgtaccgtcctccgttccccgtccccgtccccgtcccgtccgtaccg

SEQ ID NO: 133575 - DNA, 658 bp, Homo sapiens
  misc_feature: GYAE6OF01ASF1F.17.33.C11.1.454.CMB.1.raw
  modified_base (230)..(230): a, c, t, g, unknown or other
  misc_feature (230)..(230): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttcaacactggancagtcaccagtgcttacactaccaaactggttccagcacgaactggacaagcacccgaggcactctaattatagtaacaaactaacaaacactaccgtcggacccctgcccatctcgacggtcctcccgtcgtcggggacaagcctggccctggactacgtgtacgtggtgtgctcgcctggaggacgaggctagtacctattacgtcgtacccttacgttccttacggttttgggtacgggtcgtacgttcggttcggtaccgttacgggtttccgggacgggtaacgggtaacccaaggtccgtccggtaacccggttacgttaacggtccaaccggtacccggtaacggtccccgttccgggtcccccccgttaccgggacccttaaccccgttcccggtttccccgttcccccctaacccccgg

SEQ ID NO: 133576 - DNA, 768 bp, Homo sapiens
  misc_feature: GYAE6OF01CEHCA.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacactggacgcagtccaccagtgcttactactacccaaacgttcggttaccagtaccgaacgaaaaccgtacggaacaacgaccgaaccccgaacgggcctaacctactaattttacgtaacgttaaaccaaaaccaaaacaaacctaccttacccgtaccgggtaaccccctcggaccccgtacgtttcctaccgacggtcccttccccgttccggttacgggggacctaaaacggtccgtccggacccgttcggaacctaccgttcggttcgttcgggttcggttaccggccgtaacgggtcccgttacgggaacgggtaacgggacggtaccgttacgtaaccgtttacttaccgttccgtacccttaccgttaccgtttacggtttgggtcggttcgtcgttgtcgtacgttacgtcgggacgggaacggtaccgtaacggtcgtacgtaccgtacgttacgtccgacgacccgtacgtcccgtcccgtccccgtcggtaccctacgttcccttacccgttcccctaccccgttccgttaccccg

SEQ ID NO: 133577 - DNA, 811 bp, Homo sapiens
  misc_feature: GYAE6OF01BAWYI.17.33.C11.1.454.CMB.1.raw
  modified_base (168)..(168): a, c, t, g, unknown or other
  misc_feature (168)..(168): n is a, c, g, or t
tcagcgtagactagcacgaccggtgctcgatttagagtgagctcgttgggtttggggctggcgccaggggtcccttcaatatcagcaccatggcctggactcctctctttctgttcctcctcacttgctgcccagggtccaattctcagactgtggtgactcaggacnccctcactgactgtcgtcccgagggagggacagtcactctcacctgtcgcttaccaacacgtggacgcacgtccaaccgtagtcgtaccttaactactacctaaacgttcggttaccaagacaaacgtaaaccgtacggaaaccaacgcccgaaccggacgggacctaacgttactaattttaagaaacgtaaaaccaaaaacctaaaccaaaccgtacctaccgtaaccggaccccgtacgacccgttaacttaccgtacgtaaccggtcccgttcccggttaccggggttacggggaaaccaaacggtccgttaccggacccgtacgtaaccttacggttcgttacgggttacgggtcggtacgtaccgtacgggtaccgttaacgggacgggtaaccggtaacgggtacttacgggtaaacctttaacgttaccggttaaccgttaccgtttaccttacggtttacggttttgggtcggttcggttcgttacgggttcgtaccggttacgggtttaccggggacgggtaaaccggtacctaaggtccggtaaccgttaccggttaacgtaacggacgtacgaccggtacgccgtacccgtcccgtacgtccttacggttacccgttcccgtcccgtcccg

SEQ ID NO: 133578 - DNA, 639 bp, Homo sapiens
  misc_feature: GYAE6OF01BAF7I.17.33.C11.1.454.CMB.1.raw
  modified_base (213)..(213): a, c, t, g, unknown or other
  misc_feature (213)..(213): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtnccttccaacacgtggagcagtccaccagtgcttactataccaaacgtggttccagcaacgaacctggacaagccaccgaggcactcatttatagtaacaaaacaaacaacactccncgaccctcgccgtactcncgacgcctcccgtccgtacggggacaaacgccgtacgccctagacctacgtcggtcgttgggtcgtgacgtacgccgtagggaaggtaccggaaggtcgtacgtaacttactttacgtcgtaccttacttctttacgtttggttcggtgtcgtgtcgtacgttagttccgggtacggacgggtaaccacggtcgtacggtaccgttagtttacgacgtaccgacccgtaggcccgtcccgtccccgtcggtccgtcccgttccgtcccgttccccgtccctcccgttacccg

SEQ ID NO: 133579 - DNA, 831 bp, Homo sapiens
  misc_feature: GYAE6OF01ANXTS.17.33.C11.1.454.CMB.1.raw
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacactggagcagtcaccagttacttactataccaaactggttccagcagaacctggacagcaccgaggcactntattanacgtaacaaacaacaacactccgtaccgaccctcgacccgtattcctacgacgtccctcccgtccggttacgggggaccaaacgtctaccggccctacgaccctacgtcgttccggtgggttacgtcggtaccgaccgggtccgttacggggaacgggtaacgggtaccgggtacggttaccggtaaccgtttaacgtttacccgttacggttaccccgtttaacggtttacccggttttaaccgggtttttcgggggtttacggttccggttacggtttcgggttaccggtttacgtttaccggggtaccggggtaccgggggtaaaccgggtaacccgttaacggtaccggttacccgggttaaccgtttacccgggtttaaaccggcccggtaaacccgggtaaccccggtaaccgggttcccccggtcccccgggttaccccccggttcccgggtaaccccgtttacccggtttaccccgtttacccccgggtttccccccccgttacccccgtttaccccccggg

SEQ ID NO: 133580 - DNA, 662 bp, Homo sapiens
  misc_feature: GYAE6OF01BNBXH.17.33.C11.1.454.CMB.1.raw
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggacgccctcactgactgtgtccccagggagggacagtcactctcacctgtgcttccaacactggagcagtccaccagtgcttacacttaccaacttcggttccagcgaagaaaccgtggaacaacgacccgaacccgacgggaccacctactatttataacgtaacaaaacaaaccaaacacctcccgtacggacccccgtgccccgtattccgtacgacggtcctccccgttaccggttcgggggacctaaacgtccgtcgccctcggacctacgttcgtcgttgggtagtcgcgacggtcgtaggacgggtacgnggctagtacttattaccncgtaccttcgtctttacgttcggtgtgtcgttggtcgtacgttacgtacgggtccggaggtacgacgtacgtcggtacgttacgttacgtaccacggtaccgacggcctcccgtccccgtcgtaccgttacctccgttacccgtcccctccccgttccgttcccg

SEQ ID NO: 133581 - DNA, 979 bp, Homo sapiens
  misc_feature: GYAE6OF01C6Q1O.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtcccgagggaggacagtcactctcaccgtgtcgtccttaccaactactgggacgacgacgtaccaccgtagttcgtacctttaactaactaccctaaacgttcggtttaccaaggaccgaacgtaaaaccgtacggaacaaacggccaacccggacgggacctaaccgtacttaaatttaacgtaaacgtaaaccaaaaccaaaaccgaaacctaccgtacccgtaccggtaacccccgtcgtaccccgttaacttccgtaccgtaccggtccccttcccggttacgggtaccgggggtaaccaaacggttccgtacccggtaccccgtacggtaaacccgtacgtttcggtttccggtttcgggttacgggttccggtaaccgtaccgggtaccggttaacggggaacggggtaacccgggtaacgggttaccgttaaccgggttaaacccttttaacgtttaacccggttacccgtttaaccccgttttaacccgtttaccgggttttttaaccggggttttcgggggttttaccggggttcggtttccggtttacggggttaccgggtttaccgggtttaacccgggtttaacccggggggaccggggtaaacccggggtaaccgtaaccgggttcccgttaaccgggttaacccgttacgggtttaaccgtaaccgggaccggtaaccccggtaaccgggtcccgttaaccccccgggtccccccgttaaccgggttcccccttaacccgttttccccgttcccccggtttccccccgttaaccccccg

SEQ ID NO: 133582 - DNA, 665 bp, Homo sapiens
  misc_feature: GYAE6OF01BTSEB.17.33.C11.1.454.CMB.1.raw
  modified_base (170)..(170): a, c, t, g, unknown or other
  misc_feature (170)..(170): n is a, c, g, or t
  modified_base (299)..(299): a, c, t, g, unknown or other
  misc_feature (299)..(299): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctnactgactgtcgtccccaggagggacagtcactctcacctgtgcttccaacactggagcagtcaccagtgcttactataccaaacttggttccagcagaaacctggacaagcaccgaggcactcatttanagtacaaacaacaacactctgacccctgccgattctcacggcctccctcgttcggggacaaagctcgcctgacactgtctggtgtcgcacgtctaggacggacggacggtctaggaacttacttaacgtcgtaccttacttccttaacgtttggtcggtgtacgttcggtcgtacgttacgttccggggtaccgggtaacgggtaccgaacggtccgtacggtaccgttaccgtttaaacggaccttaaccggaccccggttaacgggcccgttacccgggccccccgtttacccggggtacccttaacccgttcccgttaccccggtttccccccggtccccgtttcccccgtttaacccccggg

SEQ ID NO: 133583 - DNA, 728 bp, Homo sapiens
  misc_feature: GYAE6OF01C9LX4.17.33.C11.1.454.CMB.1.raw
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
tcagcgtagactagcacgaccggtgctcgatttagagtgagctcgttgggtttgggctggcgccaggggtcccttccaatatcagcaccatggcctggactcctctctttctgttcctcctcacttgctgcccagggtccaattctcagactgtggtgactcaggacgccctcactgactgtcgtaccccagggagggacagtcactcctcacctgtgccttaccaacactggagcagtccaccgagtgcttacataccaaagtcggtccagtcaagaaacctggacaagcaccgaggcactacattanagtaacaaacaacaaacgacctcncggaccctcgacccgatacncgacgcctccctcgtcggggacaaacgtcgtcgtccctagtaccacgtcgttcgtcggttagcgtacgacgtacgtagggacggacggacggtacgtacgtaacttacgttaaccgttcggtacccttaaccgtttcctttaacggttttcgggtcgggttcgtaccgttggtccgttacgttaggttaccgggtaacgggtaccggggtaccgtaacggtaccgttacgggtaaccccgtttaacgttaaacggtaaccggtaacccggtaacccggtaaacgggaccccgtttcccggaaacccccccggttcccgggttaaaccctacccggtttaccccgtcccggtttccccccttaaaaccccccccgg

SEQ ID NO: 133584 - DNA, 844 bp, Homo sapiens
  misc_feature: GYAE6OF01E1OFT.17.33.C11.1.454.CMB.1.raw
  modified_base (231)..(231): a, c, t, g, unknown or other
  misc_feature (231)..(231): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccaggtccaattctcagactgtggtgactcaggacgccctcactgactgtcgtccccagggaggacagtcactctcacctgtctccttaccaactactggancgacgtccaaccgtgtacgtcctttactactaccgtaaacgttcggtacccgaagtccgaaacgaaaaccgttcggaaccaacgacccgaacccggacggggtcctaacctacttaacgttttaagaacgttaaaacccaaaaacctaaactaaaaccctacgttaccccgtaaccgggtacccccctaggtaccccgttaactttccgaccgaacggttcccttaccccgttccgggttacggggaactaaacggtccgtccggacccttagaaccgtacgtcggttacggttggtacgtcggaccgtacgtccggtaggaacggcggtaacggtcgttaagtaccgttacttaccgacgttacccgttacgtttaccgtttaacgggttttcgggtacgtttcgtcgttacgggttagttacggtttaccggtccgggggtaacgggtaacccggttaaccggtaccggttacccgtaccggttaacccgttacggttaccgtaaccccgaaccggtcccggtaactccccggtaccccgtccccccgttacggttacccttaccttccccgttaccccgtaccccccgtttaacccgtcccggttacccg

SEQ ID NO: 133585 - DNA, 806 bp, Homo sapiens
  misc_feature: GYAE6OF01D8XQ2.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtgtcccaggagggacagtcactctcacctgtcgcttccaacacgtggacgcagtccaccagtcgtctttaactactaccaaaacgttcggttaccagtacaaacggaaaaccgtggaacaacgccaacccgagggcctaacttctaattttaataacgttaaaccaaaacaaaccaaaacctacctccgtacgggaaccccctcggacccgtaacttccgtactacgggcctttccccgtccggtttacggggggaacctaaacggtccgtaccgtcccgtagaacccgtagttcggtttcgtgggtcggttacggccgtaacggtccgttacgggaaagggtacggtaacgggttacgtaacgggttaacctttacgttaacccgttcgttaccctttaccgttaccgttttaacggttttcgggttcggttacggtcgtttagtcggttcgttaacgggtttcggggaccgggtacgggaacctaacggtcttaccgggtaaccttacgttaacggtccgacggtcccgtaagggtcccgttaccccggacccccgtttccgggtaaccctacccgtttcccgtttaccccgttacccccttacccgttccccgtttaacccgg

SEQ ID NO: 133586 - DNA, 807 bp, Homo sapiens
  misc_feature: GYAE6OF01B8NAQ.17.33.C11.1.454.CMB.1.raw
tcagcgtagactagcacgaccggtgctcgatttagagtgagctcggttggggtttggggctggcgccaggggtcccttccaatatcagcaccatggcctggactcctctctttatgttcctcctcacttgctgcccagggtccaattctcagactgtggtgactcgaggacgccctcactgactgtcgtcccgagggagggacagtcactctcacctgtcgtccttaccaaacacgtcgggacacgaacgtccaaccgtaaggttcgtaccttaacctaactaaccctaaaacgttcggttaaccaggtacaaacgaaaaccgtacggaaccaacggacccgaaccggaaggggcctaactacgttaaacttttaacgtaaacgtaaaaaccaaaaaccaaaaccgaaaacctacccgttaccgtacccggacccccttacggaacccctaacttccgtaccgtacggtacccttccccggtacggggttaacggggaacctaaacggtccgtaccggtaccctaacgtaccgtacggttcgtcggtgggtacgtcgacgtacggccgtagggacggtacggaggtctacgtacttacgttactaccgtccttaacttcgtttacgttgggttcggtcgtcgttcgttagtcgttacgggttacgggacgggtaacgggtacgtacggtaccgtacggttaacccggttaagttaaccggtaccgacgggtacccgtacggtccccgttaccccggtcccgttaccggtacccgtactttcccgtaccccgttccccgttacccccg

SEQ ID NO: 133587 - DNA, 701 bp, Homo sapiens
  misc_feature: GYAE6OF01B62EL.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccgagggagggacagtcactctcacctgtcgtcttaccaacgtacgtaggagacctagtccaaccgtagtcgtacttaactactaccctaaacgtcggttaccagcaacgaaaccgtgacaagccaccgaggcactactatttataacgtaaacaaacaaaccaaacctactaccgtacggacccctcgaccccgtaattccaccgtacgtccctaccccgttcggtacggggaccaaacgtccgtccgtaccccgtagacctacgttcgttaccggttggttacgtcgtaccgtacggtccgtaagggacgggtacgacggtccgtagtacttagttacctcggtacccttacttcgtttagtttgggtcgtgtacgttggtcgtacgttacggtccgggacggtacggtacacggtccgtaccggtacttacgttaacggccgaaccgaccgtacggtccgtaccccgtccccggtcgtccctaccgttccctcccgttccccgttaccccg

SEQ ID NO: 133588 - DNA, 694 bp, Homo sapiens
  misc_feature: GYAE6OF01B7VEF.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtcgcttccaacacgtggagcagtcaccgagtcgtcttactataccaaacgtggttaccagcaagaaaccgtggaacaagccaccgagggcactctatttatagtaacaaaacaaacaacactacctacggacccctcgcccgtattcctcgacggcctcccgttccggtcgggggaccaaaggtcctacgtaccctacgacctacgtcgtacgttgggtcgttcgaccacggtccgagggaacgggacggtacggtcgtacgtaactttaagttaccgtcgtaccctttacttaccgtttacgttttgggtggttacggtcgttaggttcgtacgttacggttcggggacgggtaacgggtaaccgaaggtacgtccggtaacgttacgttaacgtacgtacccggaccgaccggtaccgtcccggtcccccgtcggtacctaccttccgttacccgttcccctacccctcccgttaccccg

SEQ ID NO: 133589 - DNA, 636 bp, Homo sapiens
  misc_feature: GYAE6OF01DMI1H.17.33.C11.1.454.CMB.1.raw
  modified_base (166)..(166): a, c, t, g, unknown or other
  misc_feature (166)..(166): n is a, c, g, or t
  modified_base (226)..(226): a, c, t, g, unknown or other
  misc_feature (226)..(226): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcagganccctcactgactgtgtcccaggagggacagtcactctcacctgtgccttcaacactggancagtcacagtgcttacatccaaactggttccagcaagaacctgacaagcaccgaggcactcatttataagtaacaaacaacaaacactcctcggaccctcgaccgattcncncggcctcccgtcgttcggggacaaacgctcgcctgacgacgttcgtcgtggtcgtcgtcgacgtaccgtggaacggacggtaggtcgtagtaacgttaagttaccgtcgtacccgttacctttccgttacggttttggttcggttacgtcgttagtcgtcgttacggttccgggcggggtacggaactaaggtcgtacgtacccgtattacgtcgaaccgtacccgaaggtcctacccggtccccttcggtaccctacccgtttacgtcccgtttaccccggtcccttcccgttaccg

SEQ ID NO: 133590 - DNA, 667 bp, Homo sapiens
  misc_feature: GYAE6OF01BJJJR.17.33.C11.1.454.CMB.1.raw
  modified_base (314)..(314): a, c, t, g, unknown or other
  misc_feature (314)..(314): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccaggtccaattctcagactgtggtgactcaggagccctcactgactgtgtccccagggagggacagtcactctcacctgtcgccttccaacacgtggacgcagtcaccagtgacttactataccgaaattcggttccagacaacgaacctaggacaacgccaccgaggtcacctactatttanacgtaacaaacaacaacactccgtacgaccctgaccgtactctacgacgtcctcccgtaccgttaggggaccaaagccgtcgtcccgtagaccgtacgtcggtcgttcggtcgtagccgtacgtaccgtaggacgggtacggagggtactaggtacgttaattaccgtcttacccttacttactttacggtttcggtcggttgtccgtttcgtagtacgttacggttcggggtaccggtaacgggtaccaaggtcgtacggtaaccggttaccttagtaccgacgtaccgaggtcccgtccgtaccccctcgttacccacttccgttaccctcccctaccttcccgttacccg

SEQ ID NO: 133591 - DNA, 631 bp, Homo sapiens
  misc_feature: GYAE6OF01DMYCB.17.33.C11.1.454.CMB.1.raw
  modified_base (224)..(224): a, c, t, g, unknown or other
  misc_feature (224)..(224): n is a, c, g, or t
  modified_base (266)..(266): a, c, t, g, unknown or other
  misc_feature (266)..(266): n is a, c, g, or t
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgcttccaaacnctggagcagtcaccagtcgcttactatccaaactggttccancagaaacctggacaagcaccaggcactcattatagtaacaaaacaacaaacactacctggacccctagcccgatctcacggtcctccctcgttcggggcaaaacgctcgccctgaccacttacggtcctgggtacgtcgcgacgcccgtgaacgggacggacggctcggaacttattactcggtaccctacttccgttacgtttgggtacggtcgtactttcgggtgtacgttgtaccgggacggagggaccgaaggtcctaggtacccgtagttaacgtccgtaacgcccggaaacggtcccggtaccgtaccccccgttcggtacctaacccgttccgttacccgttcccccgttaccccccg

SEQ ID NO: 133592 - DNA, 639 bp, Homo sapiens
  misc_feature: GYAE6OF01ARGJQ.17.33.C11.1.454.CMB.1.raw
  modified_base (347)..(347): a, c, t, g, unknown or other
  misc_feature (347)..(347): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccgagtgcttactatccaaactggttccagcagaaacctggaacaagcaccgaggcactcaattataacgtaacaaacaaacaaacactacctcggacccctgcccgattcncacgcctcccgtcgttcggggacaacgctcgccctcgactacgtcgtcgtggtgtcgcgacgccgtaggacggtacgacggctaggtaactacttaccgtcgtaccttacttccgttacgtttacgggtggttgtcgttcggtcgtacgttacggttccgggacgggtaacgggtaaccacgtccgtacgtaccggttacgttaaacggtccgaacggacccgtaacggcccgtacccggtacccccgttccggtacctacccgttcccgttcccggttcccccgtcccccg

SEQ ID NO: 133593 - DNA, 707 bp, Homo sapiens
  misc_feature: GYAE6OF01BFF6L.17.33.C11.1.454.CMB.1.raw
  modified_base (309)..(309): a, c, t, g, unknown or other
  misc_feature (309)..(309): n is a, c, g, or t
  modified_base (326)..(326): a, c, t, g, unknown or other
  misc_feature (326)..(326): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacactggagcagtcaccagtgtacttactactaccaaacgtcggttaccagtcaacgaacctggaacacgcaccgaggcactctatttanactaacaaacaacaacnctcctcgacccctgacctatccacacggccttcccgtcgttacggggacaacgcgtacgaccctagaacctacgtcgttacgtgggttcgtacgccgtaacgtccggtagggaacgggacggtacgggtcttacggtacgttaacgttacccgttcgtacccgtttaccttaccgtttaacggtttcgggttaggttcgtcgttcggtcgttacgttacgggttcgggtaaccgggtacgggaaccgtacggtacgtacggtaacccgtttagttaaaccgtccgtaacggtacccgtaacgggtcccgtccccggtaccccgttccggtaccctaccgttccgtttacccccgtccccttaccccgttcccgttaacccg

SEQ ID NO: 133594 - DNA, 578 bp, Homo sapiens
  misc_feature: GYAE6OF01DSUZW.17.33.C11.1.454.CMB.1.raw
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcacccagggcactcatttanagtacaaacaacaacactcctgacccctgcccgattcncaggctccctccttggggcaaagctgccctgacnctgtctgggtntgtcagcctgaggacgnggctgacttnttactcgcctactcttacgtttggtgtcgcgttgtcggtcttacgttcgggcggtaacggggaccaacggtcctaggtacccgttcgttaaacggtccaaggccccggaaggtcccctcggaccccccgttcggtaccctaccgttccttccgttcccccttacccccg

SEQ ID NO: 133595 - DNA, 730 bp, Homo sapiens
  misc_feature: GYAE6OF01C1JS3.17.33.C11.1.454.CMB.1.raw
  modified_base (480)..(480): a, c, t, g, unknown or other
  misc_feature (480)..(480): n is a, c, g, or t
tcagcgtagactagcacgaccggtgctcgatttagagtgagctcggttgggtttggggctggcgccaggggtcccttccaatatcagcaccatggcctggactcctctctttctgttcctcctcacttgctgcccagggtccaattctcagactgtggtgactcaggagccctcactgactgtcgtccccagggagggacagtcactctccacctgtgccttaccaacactggacgcaagtcaccagtgacttacataccaaactggttaccagacaacgaaaccgtaggaacaacgaccgacccgacgggactactctaatttactaagtaacaaaaacaacaaaacacctaccgtacggaacccctgaccccgtaattccgtaccacggtcccttccccgttaccggttacgggggacctaaaacggccttacggaccccttaggaacctacgttacgtaccgtgggtacgtcgtacncggtaccgtaggaacgggacggacggtctacggtaacttacttacgtacgtaccctacttccgttaacgtttggggtcgttgccgttggtacgtacgttacggttcggggacggtaacgggaacctaacggtcgttacggaaccgtttacgtttaaacggccgtaacccggacccgtaaacggtcccgttaccccgaccccggttcggtaacctaccgtttacccgtccggtttccccccgtaacccccg

SEQ ID NO: 133596 - DNA, 864 bp, Homo sapiens
  misc_feature: GYAE6OF01CCXSN.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtgcttaccaacactggagcgagtccaccagtcgtcttaactactacccaaaacgttcggttaccagccgaaacgaaaaccgtaggaacaacgacccaacccgacgggacaccgtacttaattttaacgtaaacgtaaaccaaaaacctaaaaccaaaacctaacccgttacccgtaccggtaacccccgtaccgaccccgttaacttccctaccgtaaccgggtccccttacccccgttaccgggttaccggggggaacctaaaacggtcccgttaccgtaccccgttacgtaaccgtaccgttcggttaccgttgggttcggtacgacgtacggtaccgtacggaacgggacgggaacggtccgttacgtaacgtttaattaccgttacgtacccttaacgtttacgtttacgttttgggttacggttcgtcgtttggtcgttacgttacgggttaccgggaccggggtaaaccgggaacccgtaacgggtaccgttaccgggtaaccgtttaaccgttaacggtaccgtaaccggtaccccggtaaagggtccccggttccccgtacccccggtttacccggttcccgttaacccgttccccgtttaccccggtttacccccccgttccccgttccccgtttaaccccgg

SEQ ID NO: 133597 - DNA, 780 bp, Homo sapiens
  misc_feature: GYAE6OF01CQ4GK.17.33.C11.1.454.CMB.1.raw
  modified_base (607)..(607): a, c, t, g, unknown or other
  misc_feature (607)..(607): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactggtggtgactcaggacgccctcactgactgtcgtccccgagggagggacagtcactctccaccgtgtcgtccttaccaactacgtggagcagtccaccgtagtgtaccttaacctactacctaaacgtcggttacccaagaccgtaacgtaaaacccgtgggaaaccaacggcccaaccccggaagggtcctaacttaccgttaaattttaacgtaaacgtaaaccaaaaaaccaaaccaaaacctacccgttacccgtacccggaaccccctacggtacccctacttcccgacgtaccggtccccttcccgttaccgggttacggggaactaacgtcctcggccctacgacctacgtggtcgtcggtagcgtcgacgcggtaggacggacgtcggacttagtacgttaacgttacgttccgtccgtttacgtttcgtttcggtttaggtcggtntcgttggttcgtacgttagggtccgggtacgggaccgtaaccggacgtccgttacggttaacgttaccggttaaacgtccgaacccggtacccgtacggttccctccccggtccccgttacggttcccttaccgttccgttcccccgttcccctcccccgtccgtttacccgg

SEQ ID NO: 133598 - DNA, 740 bp, Homo sapiens
  misc_feature: GYAE6OF01BXQ2N.17.33.C11.1.454.CMB.1.raw
  modified_base (299)..(299): a, c, t, g, unknown or other
  misc_feature (299)..(299): n is a, c, g, or t
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacataccaaactggttccagacagaaacctgacaagcaccgaggcactctatttanagtaacaaacaacaaacacctcctacggacccctcgacccgtattcctcgacgtcctcccgtaccgttaggggacaaacgctacgcctgactacgtacgtcgtggtgtcgaccgacgtccgtaggacggtaccggaggtccgtagtaccttaagttaccgtacgtacccttaacgttaccgtttaacggtttgggttacggttcgtcgttaggttcgtacgtttaccggttccggggtaccggggtaacgggtaacccgtaacggtaccgttacggtaaacccggtttacgtttaaacggtacccgtaaccgggtacccggtaaaccgggtcccggttccccggtacccccccggtttaccgggttaccccttaaacccgtttcccgtttaccccggtttacccccccgtacccccgtttcccccggttttaaacccccgg

SEQ ID NO: 133599 - DNA, 747 bp, Homo sapiens
  misc_feature: GYAE6OF01AEWZH.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccgaggagggacagtcactctcacctgtgccttaccaacacgtggagcacgtcaccgagtcgtcttactactaccgtaaacgtcggttaccagtaccaaacgaaaccgtggaacaacgccacccggaggaccactactaatttaataacgtaaaccaaaacaaacaaaccaccgtaccgtaccggaacccctcgacccgtacttccgtacgaccggtcctacccgttcgggtacgggggaacaaacggtccgtaccgtcccgtacgtaccgtacgttcgtcgtgggtacgtcgacgacgtccgtagggacgggaacggtagtcgttacgtaacttacttaccgtaccgttcccgttacgtttaccgtttacggttttgggtcggttcgtaccggttggtcgtacggttacggtaccggggacgggaccgggaacctacggtaccgttacgtaaccggttaccgtaacggtccgtaaccggtacccggtacggtaccccgtccccggtaccccgttccggtacccttacccgtttccgttaccccgtccccccgttaccccg

SEQ ID NO: 133600 - DNA, 700 bp, Homo sapiens
  misc_feature: GYAE6OF01DAFA2.17.33.C11.1.454.CMB.1.raw
tcagcgtagactagcacgaccggtgctcgatttagagtgagctcgttggggtttgggggctggcgccaggggtccctttccgaactatcgaagcaccgaatcggcctggactcctctctttctgttcctcctcacttgctcgcccagggtccaaacttctactagtactggtggtagaactcgaggacgccctcactgtacttgtcgtacccgaggacgggtaccacgtcactcgtcaccgtgtcgtccttaccgaactacgtggacgactacgtccaccgtaagtaacgtacctttacctaactaaccgtaacgttccggtaccgacgaccaaacgtaaccgtacggaacaacgaccgaccgacgactaacgtacttaagttaacgtaacgtaaacaaaacaacaactacctaccgtaccggaccctcgtaccgtactacgtacgtcgtccgtaccgtacggtacggactaacgtcgtacgtacctacgtacacgtcgtcgtacggtcgtacgacgtacgtcgtaggacggtacgtacgtacgtacgtacgtacgtcgtacgtaccgtacgttacgttacggttcggtcggtctcggtgtcgtacgtaggtacgggacggtacggacgagtacgtacgtacgtagtacgcacgacgacgtccgtccgtcccgtactacctcttaccgtccctcccgtcc

SEQ ID NO: 133601 - DNA, 644 bp, Homo sapiens
  misc_feature: GYAE6OF01B1Z57.17.33.C11.1.454.CMB.1.raw
  modified_base (354)..(354): a, c, t, g, unknown or other
  misc_feature (354)..(354): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtcgccttaccaacactggagcagtccaccagtgcttactataccaaactgttccagcaacgaaaccgtgacaagccacccgagggcactctatttatacgtaacaaaacaacaaacacctcctacgacccctcgcccgtattcncgacggtcctcccgtcgtcggggacaacgctcgccctagacctacgtcgtcgtggtgtcgacgtacgccgtggacggacgaggtctagtactatacgtcgtccttacgtcgtttagtttcggttggtcgtcgttgtcgtacgttacggtcgggaccgggtacgggaccgaaggtccgtacgtacccgttacgttaacggtaccgtacggacccggtaacggtccgtcccgtcccccgttacgtcccgtaccgttcccgttacccgtcccccgttcccgtcccttaccccg

SEQ ID NO: 133602 - DNA, 1198 bp, Homo sapiens
  misc_feature: GYAE6OF01D4QZJ.17.33.C11.1.454.CMB.1.raw
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
tcagcgtagactagcacgaccggtgctcgatttagagtgagctcgttgggtttgggggcgccgaggggtcccttccaatatcagcaccatggcctggactcctcttctttctgttcctctcacttgctgcccaggtccaattctcagactgtgtgactcgaggacnccctnactgtactgtcgtcccgaggaggacagtccactctcaccttgtcgtccttaccaactcgtaggacgtcaacgtccaaccgtaggtctacctttaactaccttaacctaacgttcgttaccaagaccgaaacgtaaaccgaggaaccgtaacgaccgaccgacggactacttacttaattttaacgaaacgtaaaccaaaaaccaaacctaaacctaccttacccgtaccgtaacccccgtacgtaccccgttacttaccgtacggtaacccggtccgtttacccccggttacgggttaacgggggaaccctaaacggttccccggttacccggtaaccccccgttaaggtaaaccccggtttacccggtttacgggtttttaccggtttaccggggtttagggtttaccccggtacccgggttaaccccggtttaacccggggtaaacccggggggttaaacccgggggtaacccgggggtttaaacccggggtttaaacccccggggttttttaaaacccggggttttttaaaacccccgggttttttaaaaccccgggtttttttaaaaccccccccgggttttttaaccccccgggttttttaaaaaccccccccggggttttttttttttaaaaaccccccccgggtttttttaaaccccccggggggttttttttttttttaaaaacccccgggggggtttttttttttaccgggggggggttttttttaccccggggggtttttttttaaaaacccgggggttttttttcccccggggggggtttttttttaaaccccggggggtttttttaaccccccggggggtttttttttaaaaccccccggggggtttttttttaaaaccccccccgggggggggggtttttaaaacccccccgggggggggttttaaacccccggggggggggggttttaaaaaaacccccccggggggtttaaaaacccccccgggggtttaaaaacccccgggggttttttaaacccccccggggggtttttt

SEQ ID NO: 133603 - DNA, 786 bp, Homo sapiens
  misc_feature: GYAE6OF01E437T.17.33.C11.1.454.CMB.1.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactggtggtgactcaggacgccctcactgactgtcgtcccagggaggacagtcactctcncctgtncttcaacacgtgagcagtccacgagtcgtcttaactactacctaacgtcgtaccagaccaacgaaccgtaggaacaacgccaaccgagggaccacctactaatttaagtaacgtaaaccaaaacaaaccaaacctacctccgtaccggaccccgtccgtccgtacttccgaccgacggtcccttccccgtcgggttacggggtacgaaaccgtcgtaccgacccgtacgacgttacgtcgttcggttgggtcggtcgccgtacggtaccgtacgggacgggtaccggaggtacgtaacgttaacgttacgtttaaccgtacccgttaccgtaaccctttaccggttttacggtttcgggttacggttcggttcgttcggtcgttaccggttacgggtccggggtaccggggtaccgggaaccggtaccggtacggttaccgttaccggtacgtttaaccgaccgtacccggtacccgtaggtaccccgttcccggttaccccgtcccgttaccccgtaccgtttaccccgttaccccgtttacccccctaccccgtttccccgttaccccgg

SEQ ID NO: 133604 - DNA, 685 bp, Homo sapiens
  misc_feature: GYAE6OF01BSE9U.17.33.C11.1.454.CMB.1.raw
  modified_base (172)..(172): a, c, t, g, unknown or other
  misc_feature (172)..(172): n is a, c, g, or t
tcagcgtagactagcacgaccggtgctcgatttagagtgagctcgttgggtttggggctggcgccagggtcccttccaatatcagcaccatggcctggactcctctctttctgttcctcctcacttgctgcccagggtccaattctcagactgtggtgactcaggagccctnactgactgtgtccccaggaggacagtcactctcacctgtcgcttaccaacactggacgcacgtcaccagtcgcttactactaccaaacgtcggttaccagtcaacgaaaccgtggaacaacgccacccgagggaccacgtcaactttagtaacgtaacaaacctaaacaaaccactccctacgaccccgtcgaccccgtattccgactacgcctccccgtcgttacggggactaaacgtccgtacgcccgtacgacaacgttggtccgtgggtacgtcgcgtaacggccgttaggacgggacggacggtcgtacgtaacgttaacttaccgtacgtcccttaccgttccttacgtttacgggtgttcgtccgttaggtaccgtcgtaacgttccgggacgggtaacggacccgtaagtcgtaccgtaccggttacttacgtccgtacgacccgacggccctacccggtccccgttccggtacctaccgttccgttcccgttccccgtcccccg

SEQ ID NO: 133605 - DNA, 901 bp, Homo sapiens
  misc_feature: GYAE6OF01CTJ7S.17.33.C11.1.454.CMB.1.raw
  modified_base (235)..(235): a, c, t, g, unknown or other
  misc_feature (235)..(235): n is a, c, g, or t
  modified_base (270)..(270): a, c, t, g, unknown or other
  misc_feature (270)..(270): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccagggagggacagtcactctcacctgtgccttaccaacacgtggancagtcaccagtcgcttacatccaaacgtgttccanacagaacctggacaacgcaccgaggcacgtactatttataagtaacaaacaaacctaaactacctccgtaccggacccctcgaccccgtattctccgaggtcccttaccccgtcggttacgggggaaccaaaggtccctacgtaccccgtcgtaaccgtaaccgttcggttccgttagggttcgttacgggccgtaaccggtacccggttacgggaaccgggtaacccggggtaacggccggttaacggtaaccgttttaaccgtttaaccggttcccgggttaaccccctttaacgttttaacccggttttacccggtttttacggggtttacggggtttcggtttcccgggtttacgggttaccgtttaaccgggtttaaccggggttttcccggggggaaccgggggtaaacccggggttaaacccgtaacggggttacccggttaaccgggttaaacccccgggttaacgttttaaacccgggtaccggttaaaccccgggaacccccggtaaacccgggtttccccccggtaccccgggtttaccccccccggttaccgggtttacccccgtaccccgttttcccgggtttaccccccgttaccccccgttttaaacccccccccg

SEQ ID NO: 133606 - DNA, 712 bp, Homo sapiens
  misc_feature: GYAE6OF01CCVLS.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgccgagggtccaattctcagactgtggtgactcgaggacgccctcactgactgtcgtcccgaggacgggacagtcactctctacctgtgtccttccaacacgtggacgactactaccaccgtagtcgtaccttactactaccaaacttcgggtaccaacgacgaaacgaaaccgtaggaaccgaacgtaccaacccggagggacctaactaccttaatttaataacgtaaaccaaaacaacaaaacctactaccgtcgacccctcgacctacgttcacgtacgtcctccgtcggttcggggaacaacgtcgcacccgtagaccgtacgttcgtcgtggtcgtgccgtacggtccgtagggacggacggacggtacttagtacttacttactcggtaccttacgttacttacgtttgggtagtcgtacgtgtacgttcgggtagttccggggagggaaccggtacgacggtcgtaccgtaccgtttacgtaccggcgtacccggacggtaccgggtcccttcccgggtaccccttccggttacgtacccctttcccggtttacccgtccccccgttacccccg

SEQ ID NO: 133607 - DNA, 633 bp, Homo sapiens
  misc_feature: GYAE6OF01D8GT1.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactaccaaactggttccagacaagaaacctggaacaagcacccgaggcactctatttatagtaacaaacaacaaacactccgtacgaccctgacccgattctcacggcctccctcgttaggggacaaacgctcgcctgacacgtgtcgtggtgtcgacgacgccgtaggaacgggacgacggtcgtagtaacttacgttactacgtacccttaacgttctttacgtttggtacggtcgtcgtgtgtacgttagttcgggacgggacgggtaaccaaggtcctacggtaccgttacgttaacgtaccgtaccgacccgaaggtcccgtccgcccccgttcgggtacctccgttaccgttacccgttccccctccccgtcccgttacccg

SEQ ID NO: 133608 - DNA, 614 bp, Homo sapiens
  misc_feature: GYAE6OF01CY0DB.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtccaccagtgcttacatccaaactggttccagcaagaaacctgaacagacaccgaggcactcattatagtaacaaacaacaaacactcctacgaccctgaccgatctcaggcctcccgtcgtcgggactaaagctcgccctgacacgtgtcgtggtgtcgcgagccgtaggacggacgaggctagacttatactcgtacctacttcttacgttggtgtgtctggtcgtacgttaggttccgggacggtaacgggaccgtaaggtccgttacggacccgtttacgttaacggtccgtacccggtaacccggaacggtcccgtacccgtcccccgttacgggttaccctaaccgttcccgttccgttccccccgttaaccccg

SEQ ID NO: 133609 - DNA, 758 bp, Homo sapiens
  misc_feature: GYAE6OF01DFWR1.17.33.C11.1.454.CMB.1.raw
  modified_base (170)..(170): a, c, t, g, unknown or other
  misc_feature (170)..(170): n is a, c, g, or t
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (414)..(414): a, c, t, g, unknown or other
  misc_feature (414)..(414): n is a, c, g, or t
  modified_base (484)..(484): a, c, t, g, unknown or other
  misc_feature (484)..(484): n is a, c, g, or t
tcagcgtagactagcacgaccggtgctcgatttagagtgagctcgttgggtttggggctggcgccaggggtcccttccaatatcagcaccatggcctggactctctctttctgttcctcctcacttgctgccgaggtccaattctcagactggtggtagactcgaggacnccctcactgactgtccgcccgagggaggacagtcactctcacgtgctcttaccaacncgtaggacncgtacgactaccgagtctacttacgtactaccctaagtcgtaccagaccaacgtaaccgagacgaacgacccgacgacggtacctctacttaatttaacgtaacgaaaccaaaactaacaaacctcctacgtaaccgcctccgactactcacgtaccgtccttacccgtggtacgganaacggtcctacggcctacgaacctggtcgtcgtcgggtcgacggctaggaccgtagggacggtaaccggngtactaaccggttaatttccggtaaccgttcggaacccttttacccgttgtttttcggggttgggttaccgtcggttcctacggttacccggttagggtttaacccgggcggggaaaccggaaccgggtttaccgacggtttacccggtacttcccggtttaaagaccccggacgttaacccgaacccggggtcgtaaccccccgttcccccggtaaccccgtttcccgacctttacccgtttccccttaaccccttccccccgggttaacccc

SEQ ID NO: 133610 - DNA, 788 bp, Homo sapiens
  misc_feature: GYAE6OF01CJG2O.17.33.C11.1.454.CMB.1.raw
  modified_base (227)..(227): a, c, t, g, unknown or other
  misc_feature (227)..(227): n is a, c, g, or t
tcagcgtagactagcacgaccggtgctcgatttagagtgagctcgttgggtttggggctggcgccaggggtcccttcaatatcagcaccatggcctggactcctctctttctgttcctcctcacttgctcgcccagggtccaattctcagactgtggtgactcaggacgccctcactgactgtcgtcccgaggaggacagtcactctcacctgtcgccttaccaacncgtggacgctacgtaccacctaggtcgtacctttaactaactaccgtaaaacgttccggttaccaacggtaaccgaaacggtaaacccgtacggaaccgaaccgacccgtaaccccgacggggtacctaaccgtaacttaaacgtttaaacttaaacgtaaaccaaaaacctaaaacctaaacctaaccttacccggacccgtaaacccctccggtaccctacttaccgtaaccgaccggttccctaccccgttacggggttaccggggaacgtaaccggtccgtacgtacccgtacgtacctaacgttcgttcgtacggtcgtacggtaccgaccgtccggaggtacggacggacggtactacgttaacgtactcgtactaccttacgttacgttcgtttcgggtacgtcgtacgtgtacgtcggttaggtccgggaacgggtacggtaacctacggtacgtaccggttacgtaccgtacgtccgtaacgacccggcggtaccggttccccgacccgttccggacccttacccggtccgttccccgtaccccttccccgg

SEQ ID NO: 133611 - DNA, 651 bp, Homo sapiens
  misc_feature: GYAE6OF01AI4DP.17.33.C11.1.454.CMB.1.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacnctggancagtcaccagtgcttactatccaaactggttccagcagaacctggacagcaccaggcactcatttanagtacaaacaacaacactcctcggacccctgcccgattcnctacggcctcccgtccgttcggggacaacgctcgccctgacctactgtccgtggtgtcgcgacgcctaggacggacggacggctacggtacttacttaacgtcgtacccttactacgtttacgtttgggtggttgtcgttggtcgtcgttaggttccgggacgggtacgggacctaacggtcgtaccggtaccgtcgttaacgtcgaaccggtacccgtaaggcccgttcccggtacccccccggttccgggttaccctacccggttaccttacccccggttttacccccctaacccccgttccccgtttaaccccgg

SEQ ID NO: 133612 - DNA, 636 bp, Homo sapiens
  misc_feature: GYAE6OF01E4LMA.17.33.C11.1.454.CMB.1.raw
  modified_base (354)..(354): a, c, t, g, unknown or other
  misc_feature (354)..(354): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactgggagcacgtcaccagtgcttactataccaaactggttccagcaacgaaaccgtgaacaacgccaccgaggcactcaatttatacgtaacaaacaaacaaacactccgtcggaccctcgacctattcncacggtcctccctcggtaggggacaacgctcgccctagactactgtctggtgtgcaggcctagggacggacggaaggcgtagtacttacttacgtcgtaccttaccttcgttacgttttgggtacggttcgtcttcggtgtcgttacggttcgggacgggtaacgggaccgaacgtcgtacggtaaccggttaccttaaacgtccgtaaccggacccgtaacgggccctcccggtcccccgttcggtaccctacccgtccgtttcccgtccccgttcccccg

SEQ ID NO: 133613 - DNA, 719 bp, Homo sapiens
  misc_feature: GYAE6OF01D9VEC.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggaggacagtcacctctccacctgtcgccttaccaacacgtggagcagtccaccagtgtacttactactaccaaacgttcggttaccagacaacgaaaccgtggaacaacgccaaccgaggacactactatttaatactaaacaaacaacaaacacctaccgtacgacccctcgtacctacttcgacgtacgtcccgtcccgtccggtcggggaccaacgtcctacgacctacgactacgtgtccgttggtcgcgacgacgtccgtaggacggacggacgtcgtacgtaaccttagttaccgtacgttccgtttacgttacgtttacgtttcggttggtcgttgtacggttcgtaccggttacggttaccgggtaccggggtaacgggtaacccgtaacggtccgttacggtaaccggttaccgttaaaccgtacggaaccgtacccggaacggtccgttccccggacccccggttcgtacccttacccgttcccgttacccgttacccccgtaccccgttccgttacccg

SEQ ID NO: 133614 - DNA, 660 bp, Homo sapiens
  misc_feature: GYAE6OF01EODI7.17.33.C11.1.454.CMB.1.raw
  modified_base (233)..(233): a, c, t, g, unknown or other
  misc_feature (233)..(233): n is a, c, g, or t
  modified_base (356)..(356): a, c, t, g, unknown or other
  misc_feature (356)..(356): n is a, c, g, or t
tcagcgtagactagcacgaccggtgctcgatttagagtgagctcgttgggtttgggggcgccaggggtcccttccaatatcagcaccatggccctggactcctctctttctgttcctcctcacttgctgcccagggtccaattctcagactgtggtgactcaggagccctcactgactgtcgtccccaggagggacagtcactctcaccgtgtcgcttaccaacacgtggacncagtccaccagtgcctttactaactaccaaaactcggttaccagacaacgaaaccgtgaacaacgaccaccgaggcactctattactaacgtaacaaacgaacaaactactcctacgtacccncgccgtacttcctcgacgccgttccgtccgttacgggggacaaacgtctcgaccgtacgactactgtcgtggtcgcgtacacgcgtaggacggacggacgtcgtagtaacgttactacgtcgtaccttaccttcgtttacgtttcggtggttacgtcgtggttcgtacgttacggttcgggacggtaacggaaccgaaggtcgttacgtaccgttacgttacgacgtacggtacccgaggtccgtcccgaccccgttcggtaccctacgttcccttaccgttaccccttaccgtcccgttaccg

SEQ ID NO: 133615 - DNA, 731 bp, Homo sapiens
  misc_feature: GYAE6OF01DCTK8.17.33.C11.1.454.CMB.1.raw
  modified_base (167)..(167): a, c, t, g, unknown or other
  misc_feature (167)..(167): n is a, c, g, or t
  modified_base (179)..(179): a, c, t, g, unknown or other
  misc_feature (179)..(179): n is a, c, g, or t
  modified_base (186)..(186): a, c, t, g, unknown or other
  misc_feature (186)..(186): n is a, c, g, or t
  modified_base (234)..(234): a, c, t, g, unknown or other
  misc_feature (234)..(234): n is a, c, g, or t
  modified_base (489)..(489): a, c, t, g, unknown or other
  misc_feature (489)..(489): n is a, c, g, or t
  modified_base (513)..(513): a, c, t, g, unknown or other
  misc_feature (513)..(513): n is a, c, g, or t
  modified_base (523)..(523): a, c, t, g, unknown or other
  misc_feature (523)..(523): n is a, c, g, or t
  modified_base (673)..(673): a, c, t, g, unknown or other
  misc_feature (673)..(673): n is a, c, g, or t
tcagcgtagactagcacgaccggtgctcgatttagagtgagctcggttggggtttggggctggcgccaggggtcccttcaatatcagcaccatggcctggactcctctctttctgttcctctctacttgctcgcccgagggtccaattcctacgagacgtggtggtnacctcgaggacncccctanacttgaccttcggtacgtccccgaaggggacgggacacgtacacctcncctaccgtgtcaccttaccaactacggtggacgacgtacgtaccaacggtcgtcgtaaccttaactactaaacctaacgttcggtaccgagacgaaacgttaaccgacgaacgacaccgtaccgacggtactacctataactttacgaaactaaacaaacaaacacgtaccctacgacccggtccctaccgaccgtacttacctacgaccgtcccgtcccggtacggtacggggaacacgtccgaccgtccgtanaaccgtgtccggttactgggtacncggacgtccncgggtacggacggacggtacgctacgtatcgtactccgtactaccttacgtttcggtggtcgttacgtgtacgttcggataccggggtagaccgggtagaccgttaccgaggttaaccgtcgttaactcggaccggtaccgacccggtcnccccggttacggccccgtacgttacggaccccctttcggtaccccgtccccgttcccc

SEQ ID NO: 133616 - DNA, 742 bp, Homo sapiens
  misc_feature: GYAE6OF01DW5YW.17.33.C11.1.454.CMB.1.raw
  modified_base (171)..(171): a, c, t, g, unknown or other
  misc_feature (171)..(171): n is a, c, g, or t
  modified_base (235)..(235): a, c, t, g, unknown or other
  misc_feature (235)..(235): n is a, c, g, or t
  modified_base (703)..(703): a, c, t, g, unknown or other
  misc_feature (703)..(703): n is a, c, g, or t
tcagcgtagactagcacgaccggtgctcgatttagagtgagctcgttgggttgggggcgccaggggtcccttccaatatcagcaccatggcctggactcctctctttctgttcctcctcacttgctgcccagggtccaattctcagactgtggtgactcgaggacgccctnactgactgtcgtcccagggagggacagtcactctcacctgtcgccttaccaacgtacgtggacnctaagtccacctagtgtacttaactataccaaagttcggttccagacaacgaaaccgtaggaacaagaccaacccgaaggacctacgttactaatttaactaacgtaaaccaaaacaaacaaaacctacctacccgtcggtaaccccctagaccctacgttaccgtcgtacgtccgtcccgttcggttacggggaacaaacgcgtcgtcccgtagaccgtacgtgttcggtacggtgtacgacgacgtaccgtacgggaacggtacgggaacggtccgttaacggtaactttaagttacccgttacggttaccttaacccgtttacgttttaccggtttgggttacggttcgttcgttggtacgtcgttaacggttccgggggacggtaacgggaacgtacggtcgtaccggtaccgttacgttaaccgtcgaaccgaccgacggtcctcccggtccccgtacggtcncccgtttaccgttccgttcccccgtccttccgtacccgg

SEQ ID NO: 133617 - DNA, 915 bp, Homo sapiens
  misc_feature: GYAE6OF01DC1RI.17.33.C11.1.454.CMB.1.raw
  modified_base (236)..(236): a, c, t, g, unknown or other
  misc_feature (236)..(236): n is a, c, g, or t
tcagcgtagactagcacgaccggtgctcgatttagagtgagctcggttgggtttggggggcgccaggggtcccttccaatatcagcaccatggcctggactcctcttctttctgttcctcctcacttgctgcccagggtccaattctcagactgtggtgactcgaggacgccctcactgactgtcgtcccgagggagggacagtcactctcacctgtcgccttaccaacactggancagtcaccagtcgtacttaactactaccaaacgttcggttaccaagaccaacgtaaaccgtacggaaccaacggccaaccccgagggcctaccttactaattttaacgtaagtaaaaccaaaaacctaaaaccaaaacctacccgttacccgtacccgggtaccccccgtacgtaccccgtacttcccggtaccgtaccgggtcccctttaccccggttacccggggtttacgggggggaaaccctaaaaccggtccgtttacccggtaccccgtacggtaaccctccgggtttacggttcgtttcggggttacgtaccgggtccgtaaccggtaccccgggttagggaaaccggggtaccggtaacggggttccgtttaacggtaaacccgttttaacggtttacccgtacccggttacccttttaacccgtttccgtttaccggtttttggggttacgggttccgtacgttgggtttcgtaccggtttacgggttacccgggggaggggtaacccggtaactacggggtccgttaccgggttaccgtttacggttaaaccgccgtaacccggtaccccggtaacgggttcccgtacccccggttccccccggtaacgttccccgtaccgttttccccgttccccggtttcccccctcccgtttccccttaccccggg

SEQ ID NO: 133618 - DNA, 836 bp, Homo sapiens
  misc_feature: GYAE6OF01D3WQA.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtcgcttaccaacacgtggagcgacgtcaacctagtcgtaccttactactaccaaacgttcggttaccagacaacgaaaacctggaaacaacgacgacccgaggccactactatttaacgtagtaacaaaacaaccaaaaccaccttccgtaccgaccccgtcgaccccgtacttccgtacgacgtccgttaccccgtccgttacggggacaaacgtcgtacgtccctacgacctacgtacggttcgttgggtcgttcgaccgtacggtacccgttacgggaacgggaaccggtacggggttaccgtagttaaccgttaacgttttacccgttaccgggttacccctttaaccgttttaccgtttacccgggtttttgggttacgggttcgttcgttcgtacggtttaccgttacgggtttaccggggacggggttaacgggtaaccgtaaaggttaccggtacgttaacccggtttaccgttaacggttacccggacccggtaaccccggtaacgggttaccccgttccccgggtacccccccgttacgggttaccccgttaaccccgtttcccggtttaccccggttcccccccgggttcccccctttcccccggtttaccccggg

SEQ ID NO: 133619 - DNA, 926 bp, Homo sapiens
  misc_feature: GYAE6OF01BXU22.17.33.C11.1.454.CMB.1.raw
tcagcgtagactagcacgaccggtgctcgatttagagtgagctcgttgggtttgggggctgggcgccaggggtcccttccaatatcagcaccatggcctggactcctctctttctgttcctcctcacttgctgcccagggtccaattctcagactgtggtgactcaggacgccctcactgactgtcgtccccgagggtagggacaggtcactcctcacctgtcgtccttaccaactactgggagcacggtcaaccgagtcgcttactaactacctaaacgttcggttaccaggacctaacggaaaccgtacggaaccgaacggacccgaacccccggtaacggggacctaaccgttacctaaattttaactaaacggttaaaccaaaacctaaaccgaaacgtaccttacccgtacgggaaccccccgttaggtacccccgtagtttacctaccgtacggtcccttccccggtcgggtttaccggggggactaaaaccgggccgttacggtaccccgtacgaaccgttaccgtcggttacggttacgggttcggtacggtacgaccggtaccggtagggaacgggtaccgggtacgggtccgttaaggtaaacccgtttacgtttaaccgttaccggttaccgttaaccgtttccgttttaacggttttcggggttacggttcggtaaccgttcggttacggttaccggttacgggttacccggggtacggggtaaccggggtaaccggtaaccgggttaccggttaccggggtaacccgggtttaacgtttaaccggtaccggtaccccggacccggtaacccgggttaccccgttaccccggtaccccccccgggttacgggtaaccccgtttaaccccggttcccggttttccccccggtttaaccccccttaacccccccgg

SEQ ID NO: 133620 - DNA, 707 bp, Homo sapiens
  misc_feature: GYAE6OF01CQQ5A.17.33.C11.1.454.CMB.1.raw
  modified_base (234)..(234): a, c, t, g, unknown or other
  misc_feature (234)..(234): n is a, c, g, or t
  modified_base (676)..(676): a, c, t, g, unknown or other
  misc_feature (676)..(676): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccaggaggacagtcactctcacctgtcgcttaccaactactgggancagtcaaccagtgcttaactataccaaaacgtggttccacgacaacgtaaacctaggaaccaacgaccaaccccgagggacaccgttctaactttataacgtaaaccaaaaccgaaaccaaaacctaccttccgtacggtaccccctccgtaccccgacttcctcgacggtccttcccgtccgttacgggggacaaacgtctcgtacccagtaccgacttgttccgtgggtcgtcgtacacgtccgtggaacgggacggaggtaccgttagaaccgttaattacctagtacccttacgttccgtttaacgtttgggttacgggttcgtcgtggttcgtaccgttagttccgggacgggtacgggacctaacggtctacggtaccgttagttaacggtccaccggtacccgaccggtccgtccccgaccccgtccggttaccnccgtttcccgtcccgttccccgttacccccg

SEQ ID NO: 133621 - DNA, 883 bp, Homo sapiens
  misc_feature: GYAE6OF01D45QZ.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtcccaggacggacagtcactctacacctgtcgtccttaccaacacgtggacgctacgtccaaccagtcgtctttaacgtactacctaaacgttcggttaccaagaccgtaaacggtaaacccgtacgggaaaccaacgacccgaaccccgtagggacctaaccgttaccttaattttaactaaacggttaaaacccaaaaaaccaaaacctaaaaaccctacccttacccgggttacccggtaaccccccgtttacggaccccgttaactttaccgttaccgaccggttaccccttacccccggtttaccggggtttacggggggaaaccctaaaacggtcccttaccggtaccccgttacgtaacccgtacgttacgtttccggttgggttacggttcgaccggtaacgccccggttaagggaacggggacgggtacggtcgttaacggttaacctttaacgttaacccgttaccgtacccgttttacctttaccggttttaaccggtttggggtttcggtttcgtccgttttaggtccgttaacgtttaccgggtaccgggggtaaccgggaccggtaaaccgtacgtacccggttacggtaccgttaacgttacggaccgtacggacccgtagtcccggtaccccgtcccgttacgtcctacgttcccttacccgtccccctccgttccttacccgg

SEQ ID NO: 133622 - DNA, 682 bp, Homo sapiens
  misc_feature: GYAE6OF01BAVQ7.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaacctggacaagcaccaggcactcattatagtacaaacaacaacactctcgaccctgccgattctcacgcctccctccgtggggacaaagctacgcctgacactcgtcgtgtgtcgtcgacgccgtagacgggacgacggtcgtacgtaacgtacttaacgtcgtacccttacctcgtttaacgtttgggttacggttcgtccgttggttccggtacgtttacggtttccggggtaccggggtaacggggaacccgtaaacgggtccgttacggtaacccggtttacgtttaaaccggtacgtaacccggtaccccggtaaagggtcccttcccgggacccccccgttcgggtaccccgtaccgtttacccgtttaccccgttaccccccttaccccccgtttcccgtttacccccgg

SEQ ID NO: 133623 - DNA, 654 bp, Homo sapiens
  misc_feature: GYAE6OF01B3Q4U.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactccaaactggttaccagcaagaaacctggaacaagccacccgagggcactctaatttatagtaaccaaacaaaccaaactacctccgtacggacccctcgaccccgtattcctccgacggcctcccgtccggttagggggaccaaacggctacgcccgtacgactactgtccgtggtcgtcgcacgccgtaggacggacggacggcgtagtaaccttattactcgtaccttacttcgttacgtttggtcgtggtcgtgttcgtcgttacgttccgggacgggtaacgggaccaacggtccgtacggtaccggttacttaacggtacgaccggaccccgtaaggcccgttcccggtccccccgtccggtacctacccggtcccgtttcccgttcccccgtcccccg

SEQ ID NO: 133624 - DNA, 780 bp, Homo sapiens
  misc_feature: GYAE6OF01CUMAL.17.33.C11.1.454.CMB.1.raw
  modified_base (174)..(174): a, c, t, g, unknown or other
  misc_feature (174)..(174): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctnactgactggtcgtccccgagggaggacagtcactctcacctgtgccttaccaaacacgtggacgcgtacgtaccgaccaaggttcgaccttttaacctaactacccgttaaaaaccgttcggggtttacccaacgggaccaaaccggtaaaaaccgttaggaacccgaaacgtaccgaacccgacggggacctaccgttaccgtaattttaactaacggtaaaccaaaaacgaaacctaaaacctaaccgttaccgttaccgggaaccccccgttacgacccccggttaacttaccgttaaccgtaccggttacccttcccccggtttacgggttacggggggaacctaaaacgggccgttcgaccccgttgaaacccgtcttacggttcgtgggtcgtacggtcacgtccgtacggacgggacgtacggctacgaacgttactaacgtcgtaccgtacttcgttacgtttcggtagtgttcgtcggttagtcgttacgtcgggacggtacggacaacggtcgtacgtacctacgttaacgcgaccgccgtaaacgtcccgtacccgtcccgtccgtacttacctccttcccgtccccgtaccccg

SEQ ID NO: 133625 - DNA, 583 bp, Homo sapiens
  misc_feature: GYAE6OF01ETGD2.17.33.C11.1.454.CMB.1.raw
  modified_base (230)..(230): a, c, t, g, unknown or other
  misc_feature (230)..(230): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaaactggttccagcagaacctgacaagcacccagggcacgtcatttatagtaacaaacaacaaacactcctacggacccctgcccgattcctcaacggcctccctccgttcgggggacaaagcctcgccctagacctactgtactggtagtcgcgagcctggacggacgaggctgactacttactcgtcctactcttaccgtttggtcggtgtctgtgtcttagttcgggacggaggaccgagctacggtaccgtacttacgtccgagcccgaaggccctccggccccccgtcggtcctaaccttccgttccgttcccccgtaacccccg

SEQ ID NO: 133626 - DNA, 934 bp, Homo sapiens
  misc_feature: GYAE6OF01CS158.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtcgtccttaccaaacacgtgggaacgccacgtccaaccgagtcgtacctttaactactacctaaaacgttcggttacccaaggaccaaacggtaaaacccgttagggaaaccaaacggcccgaaccccgaggggaccctaaccgttactaatttttaaacgtaaacgttaaaaccaaaaaacctaaaaccaaaaaccgtaccctttaacccgttaccgggtaaccccccttccggtacccccgtaactttcctaccggtaaccggttccccgtttcccccgtttaccgggtttacgggggggaacctaaacggtcccgttacggtaccccgttacgtaacccgtaccgttcggttccggtgggtttcggtcgaccgtacggtacccggttaggggaaccgggtaacgggacgggtaccgttacggttaacctttaacgttaccgttacgtaacccctttaccgtttaccgttttaccgggttttggggtttacggttcggttaccgttgttaccggtttacgtttacgggttacccgggggacgggtaacggggtaacccgtaacggtccgttaaccgggttacccgtttaacggttaaccggttccgaaccggtaccccggtaagggtccccggttccccggtaccccccggtttcccggtacccgttacccttccccggttaccccgtttccccccgtccccctttcccgttaaccccgg

SEQ ID NO: 133627 - DNA, 873 bp, Homo sapiens
  misc_feature: GYAE6OF01BU27T.17.33.C11.1.454.CMB.1.raw
tcagcgtagactagcacgaccggtgctcgatttagagtgagctcgttgggtttggggctggcgccaggggtcccttcaatatcagcaccatggcctggactcctctctttctgttcctctcacttgctcgcccgagggtccaattctcagactggtggttgactacgaggacgtccctcactgacgttcggtacgtaccccgaggggtacggacacgtcacctctccaaccgttggtctaccttaaccaacgtacgtggaacgacacgttacaaccgagtacgtacttaacttaacaccgtaaacgttcggtccaaggaccaaacgtaaaccgtcggaaacgtaacgaccgtaacccggaggtacctaactctaaagttttaacgaaacgttaaaccaaaaactaaaacggaaaccaccgtttaccgaacgggtaccccttacggaccgttaactccgtaaccgtaagggttccccttaaccggttcgggttaagggggaaccttaaacgtccggtacccggtaccttaacggtaacttacgttccggttacggtaggtccgtaaggaccgtaaacggtccgtaacgggacgggtaacggcgtacgttaacgtaacggttaacctttaggtacccgtaccgtttaacgtacggtttacggttttggggtcgttcgtcggtaacgggttctaaccggttttagtacccggggggaaccgtaacggggtaaccttaagggtacccggtttacgttaaacgggttaaaccctagggtaaccccgagggtaaccccggtaacggttcccgtcccgttaccccccgggttaagttcccgtaacgttccccgttacccgttacccggttaaaccccccg

SEQ ID NO: 133628 - DNA, 838 bp, Homo sapiens
  misc_feature: GYAE6OF01EJKRH.17.33.C11.1.454.CMB.1.raw
  modified_base (164)..(164): a, c, t, g, unknown or other
  misc_feature (164)..(164): n is a, c, g, or t
tcagcgtagactagcacgaccggtgctcgatttagagtgagctcgttgggtttggggctggcgccaggggtcccttcaatatcagcaccatggcctggactcctctctttctgttcctcctcacttgctcgcccgagggtccaattctacagtactggtggtanactcgaggacgccctacactgacgttcggtccgtacccgaggggacggactacgtcctacttctccgtaccgttggtcgtacctttacccaacgtacggtacggaacgtccgtacgtaccaccggtagttacctaccttaaccttactacccgtaaacgttcggtaccaacggaactaacgaaaccggtacgaacgaaccgaccgtaaccggacggaccttacgtaccttaattttaacggaaacttaaacaaaaccaaacgtaaaccctcccttaccggaaccccgtaccccgttacgaccccgtaacgttccgaaccggttccggtaccccgtttacccggttccggggttaaaccggggaacaaacccggttcctaccgtaaccgtacgtaaaccgttcgtacggtcggtcgggttactcggtaccgtacgggtaccggtagggaaccggtaggtaccggtaacttaccgttaaccgttaaacgttccgttaccggttacccgttaacgtttcccggtttaggtttcgggttacgttcgttaacgggttcgtacgttacgggttcggtacgggaaccggtacgtaccggtacggtacctacggttaccgtagtaccgacggtccgacggtccgtaccgtccgttcccgtcgtctaccttctcgtcctcccg

SEQ ID NO: 133629 - DNA, 744 bp, Homo sapiens
  misc_feature: GYAE6OF01DTU3B.17.33.C11.1.454.CMB.1.raw
tcagcgtagactagcacgaccggtgctcgatttagagtgagctcgttgggtttgggctggcgccaggggtcccttccaatatcagcaccatggcctggactcctctctttctgttcctcctcacttgctgcccgagggtccaattctcagactgtggtgactcgaggacgcctcactgactgtcgtcccgaggacgggactacgtccactcctccaccgtggtcgtccttaccgaactacgtggacgtacaacgtccgtaaccaggtactaccttaacctataaccctaaacgttggttaccaagtacgaaacgtaaaccgtgaacctaacgccgaacccgagggacctaactactaatttaacgtaacgtaaactaaaaccaaactaaacccgtacctaccccgtaccgacccgttcgacccgtacttcgtacgtaccgtccttacccgttccgggtacgggaacgtaaacgtccgtaccgtccgtacgacgttacgtggtacggttcggtagtacgaccgtaacggtaccgtagggtacgggaacggtacggttacgtacgttaacgttaccgttaacgtaccggtacttacgttacgtttacggtttgggtacgttacggtcgttaggtcgttaccgttacggttaccggacgggtacgaccgagttaccgtacgttaccgtagtacgtccgacgtacgacggccgtaccgcccgtacgctacgtccttccgtccctcccg

SEQ ID NO: 133630 - DNA, 751 bp, Homo sapiens
  misc_feature: GYAE6OF01DQAEE.17.33.C11.1.454.CMB.1.raw
  modified_base (236)..(236): a, c, t, g, unknown or other
  misc_feature (236)..(236): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgcccctcactgactgtcgtccccgagggagggacagtcacctctcacctgtcgcttaccaaacactggancagtaccacctagtcgtcttaactactaccaaacttcggttccaagcaacgaaaacctggaacaacgccacccgagggaccactctaatttataagtaacaaaacaaacaaaccactccgtacggacccctcgacccgtattcctcgacggtaccctccccgtccggttacgggggaccaaacggccttcgacccgtacgacctaaccgttcggttaccggtgggttgtcggacgacggtccgtaggaacgggacggacgggtacgttagtaacttacttaaccgtccgtacccttaaccgttccgtttaacggttttgggtcggttcggtcgttggtcgttcgttacggttcggggacgggacggtaaccgtaagtccgtacggtaacccgttacgttaacggtacgaccggtaacccggtaacggttcccgtacccggtccccccggttaccgtacccgttacccgtttaccgttccccgtttacccccctaccccgttcccgtttaccccgg

SEQ ID NO: 133631 - DNA, 778 bp, Homo sapiens
  misc_feature: GYAE6OF01APL7J.17.33.C11.1.454.CMB.1.raw
  modified_base (215)..(215): a, c, t, g, unknown or other
  misc_feature (215)..(215): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtcncttccaacactggagcagtccaccagtcgccttactactacctaaactcggttaccagaccaacgtaaacccgtggaacaacgcccaccgacgggcactctaatttataacgtaacaaacaacaaacctactcccgtacggtacccctcgacccgtacttccacgtacggtccctcccgttccggttacgggggactaaacgtcctcgccctcgaacctacgttgtcgttacgggtgtcgtaccgacggtcccgtaggacgggaccgaggtcctacgtacttacttacgtcgtaccttaccgttcttacggtttggtacggttcgttccgttaggttccgtacgttacggttaccggggtacgggtaacggtaacccgtacggtccggtaacggttcccggttaacggtttaaaccggtaccgtacccggtaacccccggtaaagggttcccccgtccccgggttacccccccggttaccggtttaccccgtacccgggttttaccccgtttaccccccgggtttacccccccgttcccccgtttacccccgtttacccccgg

SEQ ID NO: 133632 - DNA, 774 bp, Homo sapiens
  misc_feature: GYAE6OF01DDQ3Q.17.33.C11.1.454.CMB.1.raw
  modified_base (167)..(167): a, c, t, g, unknown or other
  misc_feature (167)..(167): n is a, c, g, or t
  modified_base (231)..(231): a, c, t, g, unknown or other
  misc_feature (231)..(231): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacnccctcactgactgtcgtcccaggaggacagtcactctcgactgtgccttaccaacacgtggacncacgtaccaccgtagtcgtacttaactatacctaaaacgttcggttaccaagacgaacggaaaaccctaggaaccaacgaccgaaccccgaggaccactacttaatttaactaacgtaacaaaacaaacaaactaccgtaccgtcggacccctcgtaccctactacgtacgacgtccttcccgttacggttacggggaaccaacggtccgttaccgcccgtacgtaaccctaccggtgttaccggttcgggtcgtacgtaccgtaccgacccggttaagggacgggaacggtacgtccgttacgtaaccttaacgtttaccgtcgttaccttaccgtttcgttacgttttcgggtacggttcgtagtttcggtaccgtagttacgggttaccggggaggtaacggaacggtaacgtcgtacggtacccgttagtaccgtaccgacggaccgaacggttcccgtccccggttccccgttacccggtacccgttacccgttaccctttccccgttaaccccctccccgtttacccgttaacccgg

SEQ ID NO: 133633 - DNA, 893 bp, Homo sapiens
  misc_feature: GYAE6OF01D6H6S.17.33.C11.1.454.CMB.1.raw
tcagcgtagactagcacgaccggtgctcgatttagagtgagctcgttgggtttggggctggcgccgaggggtcccttcaatatcagcaccatggcctggactcctctctttctgttcctcctcacttgctcgcccgagggtcctaacttctcgagtacgtggtggtcgactcgacggacgtccctctacgtgacgtcggtccgtacccggagggacgggactacgtcctacctctaccgtacgtgtccgtaccttaaccgaactacggtaggacacgacgtaccacgtagtctacgttacctactaccgtaacgttcgtacgacacgaacgaaccgtacgaacacgaccgaccggacggtacctactacttaacttaagtaaaccgaaaactaaaaccaaaacctaaaccgtaccgtaccccgtaccccgggtaaccccgtaccgtaacccgttacgttaccgaccggtaaccccgttcccgttaccccgggttacgggttcccgggggaaaaccttaaccggaccccggttaccgaccccggtactacccgtttaccggttcggttacgggttcgggtacgtaccggaccggttaccggacggtacggggtaaccgggtacggtaccggttaacgtacggttaaacctttaccgttacgtttacccgttaacccgtttaaccgttttacggggtttacggttttgggtaccggggtttcgtttaggtaccggtacgtttaccgggtaccgggttacgggggtaaccggacgggtaaccgtcgttacgggtaacccgtagtttaacgtaaccgtacccggaacggtacctccgggtaccccgtccgtacccggttccgtaccctacccgttcccgttcccgtccccgttcccg

SEQ ID NO: 133634 - DNA, 832 bp, Homo sapiens
  misc_feature: GYAE6OF01CZ77K.17.33.C11.1.454.CMB.1.raw
tcagcgtagactagcacgaccggtgctcgatttagagtgagctcggttggggtttgggggggcgccgaggggtcccttccaatatcagcaccatggcctggactcctctctttctgttcctcctcacttgctcgcccgagggtccaattctcagactggtggtgactcgaggacgccctacacgtgaccttggtccgtaccccgagggaacgggacagtccacctctaccgtaccgtgtcgccttaccaactacgtagggacgaccgacgtaccaaccgtagttacgtaccttaacctactaaccctaaacgttcggttaccaacgaaccgtaaacgtaaaccgtaggaaccaacgcccgaaccgacggactaccgtactaatttaacgtaacgtaaaaccaaaacaaaccaaacctaccgttacccgtaccggtaaccccttcggacccgttacttcccgtacgtaccggtacccttcccggttaccgggtacgggggtaacctaaacggtcccgtaccgtacccgtacgtaaccgtaccgtttaggttcggttagggttcgacggtacgaacggtaccggtacgggaacgggtacggacgggtacgttacgtaaccttaacgttaccgtacgtacccttacgtttaccgtttacggtttgggttcgtcgtacgttacgttcgttacgtacgggttcgggacgggtacggtaaccgacgtcgtacgttaaccgttcgtacgaccgtaaccggccgtacggtcccgtcccggtaccccgttacgttaccctccgttacccttacccgtaccccctccgttcccgtaacccgg

SEQ ID NO: 133635 - DNA, 954 bp, Homo sapiens
  misc_feature: GYAE6OF01B14VB.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcgaggcgccctcacgtgacttggtcgtccccgagggacgggacagtccactctccacctggtctccttaccaacgtacgtggacgcgtagtccaaccgtaggtctaccttaactactaccgtaaacgttcggtaccagacctaacgaaaccgtggaacacgaccgaccggaggacctactacttactttaacgtaacgtaaacaaaacaaacctaaacgaccctttaccgaccggtaacccccgtgtacccgttacgttccgaccgtacgtccttaccccggtcggttacgggggaacctaacgcctaccggtacccgtacgtaaccgtcgttcggttcgtcgggttacgtacggaccgtaacggttcccgggaaacgggtacgggggtaaccggtacggttacccggttaaccgttaacgtttaaaaccggttttacccggtaccggtttaaaccccgtttcccggttaaccggttttttacggtttttacgggggtccggttttacgggttaaccgggttttccgggttcgggtttaacccggtttaaccgggggttacccgggggttaccgggggaaaccgggttaaccccggtaacgggtttaccccggttaaccgggttaaaaccccgttttccggttaaaccggtaacccgggtaaccccgggttaaccccgggtacggttaacccccggttcccggttaacccccccggttcgggttaaccccctttaccggttaccccgttttacccccgttaccccccgttacccgtttccccgttaaaccccgg

SEQ ID NO: 133636 - DNA, 541 bp, Homo sapiens
  misc_feature: GYAE6OF01CL5ZL.17.33.C11.1.454.CMB.1.raw
  modified_base (424)..(424): a, c, t, g, unknown or other
  misc_feature (424)..(424): n is a, c, g, or t
  modified_base (442)..(442): a, c, t, g, unknown or other
  misc_feature (442)..(442): n is a, c, g, or t
  modified_base (528)..(528): a, c, t, g, unknown or other
  misc_feature (528)..(528): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaatggttccagcagaaacctggacaagcacccagggcactcatttatagtaacaaaacaaacaaaacactcctaggacccctgacccgattctacaggcctccctccgttgggggacaaagctgccctgacactgtactggtgtgcagcctgaggacgaggctgactattacngctactctactttggtgngtctgtgctatcggcggagggaacaagtctgaccgtacttaagtcacgaccaaggctcgtcccccgtcggtacactcttcgtcccncccgtcctacccg

SEQ ID NO: 133637 - DNA, 741 bp, Homo sapiens
  misc_feature: GYAE6OF01B3E5T.17.33.C11.1.454.CMB.1.raw
  modified_base (332)..(332): a, c, t, g, unknown or other
  misc_feature (332)..(332): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgtccagggtccaattctcagactgtggtgactcaggacgccctcactgactgtcgtccccaggaggacagtcactctcacctgtgcttaccaacacgtggacgcacgtccaccgtagtcgtaccttactactacctaaacgtcggttaccagacaacgaacctaggaacaacgccgaaccgaggacctacgtactatttaanaacgtaacaaaccaaacaaccacctccgtaccggtacccctcgtacccgtacttccgtacgaccggtccctacccggttcggttacggggaactaacggtccgtaccgacccgtacgacctaccgtacgttcccggtagggtcgtacgtaccgtacggtccgtacgggaacgggtacggacggtacgtaacgtaaccgtttaacttacgtaccgtacccttacgttaccgtttacggttcggttcggtcgtcgttgttcgtacgttacggtaccgggacggacggacgtaccggtcgtaccggtaccgttaaccgttacgtaccggaccggtacccgtcggtcccgttaccccggtaccccggttaccgtaccgtacccgttacccttccccggtcccccgttaccccg

SEQ ID NO: 133638 - DNA, 754 bp, Homo sapiens
  misc_feature: GYAE6OF01AN4LR.17.33.C11.1.454.CMB.1.raw
  modified_base (145)..(145): a, c, t, g, unknown or other
  misc_feature (145)..(145): n is a, c, g, or t
  modified_base (172)..(172): a, c, t, g, unknown or other
  misc_feature (172)..(172): n is a, c, g, or t
  modified_base (230)..(230): a, c, t, g, unknown or other
  misc_feature (230)..(230): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattcncagactgtggtgactcaggacgccctnactgactgtcgtccccgagggagggacagtcactctcaccgtgtcgtccttaccaacncgtggacgcacgtccaccgtagtcgacctttaacgtactacccgaaacgttcggttccaagacaacgaaaccgtggaaccaacgcctaacccgagggcctactactaatttacgtaacgtaaacaaaaccaaacctaaacctaccgtcccgtaccggtaacccccgtcggaccccgtaacttcctaccgtacggtcccttccccggttccgggttacgggggaacaaacggtcctaccgtccctacgactacgttcggttacgtcggtgtcgcgtacgtcgtacggacggacggacggtcgtacgtacttacgttacgtcgtccttacgttcgttacggtttgggtcgttacgtcgtcggttcgtaccggttaggtaccggggtacgggtaaccggtaccgtaacggtccgtaaccggtaccgttacgttaccggtacgaccggacccgtacggtcccgtcccgtccccggtacgtcctaccggttcccgttcccggttccccgtcccgttcccgttaacccgg

SEQ ID NO: 133639 - DNA, 944 bp, Homo sapiens
  misc_feature: GYAE6OF01D4TO3.17.33.C11.1.454.CMB.1.raw
tcagcgtagactagcacgaccggtgctcgatttagagtgagctcggttggggtttgggggcgccaggggtcccttccaatatcagcaccatggcctggactcctctctttctgttcctctcacttgctgcccgagggtccaattctcagactggtggtcgactcgaggacgccctcactgactcgtcgtacccgagggacgggacagtccacttctaccgtacgtgtcgtaccttaccaaacgtcgtggacgtaccgtacgtacccgaaccgtaggtcgttacctttaacgttaacctaaccgtaaaaccggtttccggttaccgaacggtaaccgaaacggtaaaccgtacgggaaacaaccggacccgaaccggacgggacctaaccgttacttaacgttttaacgaaaccgttaaaaccaaaaaccgaaacctaaacctacccgttacccggtaacccggtaccctaccggtacctttacttaccgacccggtaaccggttcccgttaccccggttaccgggggtaacggggtaaacctaaccggtccgtttacccggtacccgtacggtacccgttaacggttcgggttacggttacggggttcggtaccgacggtaccgggtaccggttaacggggaacgggtaacccgggtacgttacggttaaccggttaaacgtttacccgttaacggttacccgttaacccgtttaccgtttaacgggttttacgggtttgggtaccggtttctacggtttcggtacgttaccggtcgggtacggggacggtaaccggtaacgtcggtaccggttacgtaccggttcgttaacggacccgtaaccggtacccgtacgggttcccctccccgggttacccgtaccgttacccgttacccgtttaccccggttacccctaccccgtttcccgtaacccgtttcccgg

SEQ ID NO: 133640 - DNA, 681 bp, Homo sapiens
  misc_feature: GYAE6OF01DQFA8.17.33.C11.1.454.CMB.1.raw
  modified_base (174)..(174): a, c, t, g, unknown or other
  misc_feature (174)..(174): n is a, c, g, or t
  modified_base (216)..(216): a, c, t, g, unknown or other
  misc_feature (216)..(216): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccgagggtccaattctcagactgtggtgactcaggagccctnactgactgtcgtcccgaggagggacagtcactctcactgtcncttacaacagtggagcagtcaccaggtcacttactacacctaaacgttggtaccagacaaacgaaacctaggaacgaacgacccgaaccgagggactaactctaattttaagaactaacaaaacctaaacgaaaccactccgacggaccctacgaccgtatcctacgacgtcctcccgtaccggttggggaacaaacggtcgttcgacccgtacgaccgtacgtgtaccggtggtagtcgacgtacgccgtaggacgggacgacggtacgtacgtacgttaacgttacgtacgtaccttacgttacgttacgtttgggtacgtcgtctggtacgtacgtacggtacgggtacggacggtaccgacgtcgtacggtaccgtacgtttaaacgccgtaacggacccaacgggtccctacccggtaccccgtcggtacctaccgtccgttaccgtccccgttaccccg

SEQ ID NO: 133641 - DNA, 798 bp, Homo sapiens
  misc_feature: GYAE6OF01A8WJ7.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactggtggtgactcgaggacgccctcactgactggtcgtcccagggagggacagtcactctcaccgtgtcgtctttacaacctcgtggacgcacgtccaaccgtagtcgtacctttaacgtactacccgtaaaaccgttcggtttaccgacgtaccgtaaacggtaaacccgttaggaaccaaacggacccgaaccccggaacggggaccctaaccgttacttaaacgttttaacgtaaacggtaaaccaaaaacctaaaacctaaaacctaccgttaccccgtaaccgggtaccccccgttccggtaccccgttacgtttcccgtaccgtaacccgggtccttacccccggttcgggttacgggggaacccgtaaacggccgttaccggtaccccgtacgaaccgtacgttacgttcggttagggtacgtcggtcacggtccggtagggaacgggtacgacggtacctagttacgtacttacgtccgtccgttacgttccgtttaggtttcgggtagtcggtccgttgtcgtacgttaccggtcggggaccggacggtacgacgtcgttacggacgttaccgtacgtcgaccgaccggtcgcccgtccgtccccgtcgttccaccgtcgttcccgtccctaccccgg

SEQ ID NO: 133642 - DNA, 725 bp, Homo sapiens
  misc_feature: GYAE6OF01CYS6T.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctcgcccgagggtccaattctcagactggtggtgactcgaggacgccctcactgactgtcgtaccccgagggaggacagtcactcctcaccttgtcgtccttaccaacacgtgggaacgcaggtccaaccgtagtcgtacttactactacctaaacgtcgggttaccagacaacgaaaccgtacggaacaacgccaccgaggcctactactaattacgtaacgtaaacaaaacaaaccaaactcctaacccgtacggaaccccctgacccgtaacttccacgtacggtcccttacccgtccggtaacggggactaaaggtcctccggaccgtcgactacggtacgttcgtcgggtgtacgtcacggtcgacggaacgggtacgacggtactaacgtaccttacgttaccgccgttacccttactttaccgttacgttttgggcgttcggtccgtaggttcgtaccgtaggttccggggacggaacggtacgaacggtcgtaccgtaacgttacgtaacgccgaccgtaccggaacgtcccgtacccggtccccgtcggttacctttacccgttcccgtacccccttccgttacccgg

SEQ ID NO: 133643 - DNA, 803 bp, Homo sapiens
  misc_feature: GYAE6OF01CAFN6.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtaccccaggagggacagtcactctcacctgtctccttccaacacgtggaacgcacgtccacctagtcgtccttaactactaccaaacgttcggttccacgacaacgaaaccttcggaacaacgaccgacccgaaggggccaacctctaactttagtaaacgttaccaaaaactaaaccaaacctaccctacccgtacggacccccttacgaccccgtacttcctaccgaacgccgtttccccgtccggttacgggggaacctaacgcctccgtacccctacgtaaccgtcgtcgttccggtgggtcggtacgtacgtaacgtccgtaacggacgggaaccgggtacgtccgtacgtaccttaacgttacctccggtaacccttacgtttacctttacggttttcgggtttcggtgtcccgttgttacgttaccgtttaccggttaccggggtacggggacgggaaccgttaacggccgtttacccgggaaccggtttccgttaaacgtcccgtaaccggtaccccggacggttacccgtccccgggtccccgttaccggttacccttacccgttttcccgttaccccgtttaccccccgtcccgtttccccttaccccgg

SEQ ID NO: 133644 - DNA, 963 bp, Homo sapiens
  misc_feature: GYAE6OF01BO3P4.17.33.C11.1.454.CMB.1.raw
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (247)..(247): a, c, t, g, unknown or other
  misc_feature (247)..(247): n is a, c, g, or t
tcagcgtagactagcacgaccggtgctcgatttagagtgagctcgttggggtttggggggggcgtccgaggggtcccttccaatagtcagcaccatcggacctggactccctctctttctgttcctcctcacttgctgcccaggtccaattctcgagacgtgtggtcgactcaggcnccctnactgactgtactcccgaggaggacagtcacgtctacacctgtcgccttaccaacgcgtagggacnctacgtccaccgtaggtctactttactaactaccgtaaaacgttcggtaccgaacggtaccgaaacggtaaaccgtacggaaccgtaacggacccgtaacccggacgggtaccttaaccgttaaccgttaacgtttaaacgtaaaccgttaaaaccgaaaaaccgtaaaacccgtaaacccgtacccgtaccccggtaaccggtaacccccgttaccggtaccccggttaactttaccgtacccggtacccgggttaccccgttacccggttaccgggggttaccgggggaaacctaaccggttcccgtaccggtacccgtacggtacccgttaccggttcggttaccggttaccgggtacgtaccggtaccggtacggttacccgggtaacgggtaaccgggtacggtaccggtaccgttaacggttaaccgtttacgttaaccgttaccgttacccgttacggtttaccggtttacgggtttacgggttacgtcggttacggttacggttacggttccgggtttacggtacccgggggtaaccgggtaaccggttaacgtaccggtaccgtaaccggttaccggttacgttaaccggtacccgtaaccgggtacccgggttaccggtccccggtccccgggttccccgttaccggttacccgtttacccggtttccccggttacccgttccccgttaccgttaccggttacccg

SEQ ID NO: 133645 - DNA, 708 bp, Homo sapiens
  misc_feature: GYAE6OF01DZVWG.17.33.C11.1.454.CMB.1.raw
  modified_base (232)..(232): a, c, t, g, unknown or other
  misc_feature (232)..(232): n is a, c, g, or t
  modified_base (376)..(376): a, c, t, g, unknown or other
  misc_feature (376)..(376): n is a, c, g, or t
  modified_base (436)..(436): a, c, t, g, unknown or other
  misc_feature (436)..(436): n is a, c, g, or t
  modified_base (465)..(465): a, c, t, g, unknown or other
  misc_feature (465)..(465): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccgaggagggacagtcacgtctcacctgtgtccttccaactctggacncagtccacctagtcgtctttactatccaaacttcggttaccagcgaagaaacctggaacaacgccacccgagggaccacttctatttaataacgtaacaaaacaaaccaaacactccgtacggacccctcgaccgtacttaccncacggtccttcccgtcggttacgggggacaacgctcgccctgacacgtcgtcgtcgggtnacgcacgtcgtgacggtacgaggtcgtanacgttacttaccgtcgtaccttacttacgtttacggtttgggttcggtcgttcgttgtcggttaccgttacggttaccggggtcgggtaaccgggacctaacggtcccgttacggtaaccccgttagttaaccggccgtaaccggtaccccgaggttacccgttccccggtacccccgttacggtaccccttaccgttacccgttacccgtttacccccctacccgtttccccgttaaccccg

SEQ ID NO: 133646 - DNA, 700 bp, Homo sapiens
  misc_feature: GYAE6OF01CKJ6R.17.33.C11.1.454.CMB.1.raw
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (317)..(317): a, c, t, g, unknown or other
  misc_feature (317)..(317): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccgagggtccaattctcagactgtggtgactcgaggacgccctcacgtgactgtcgtcccgagggaggacagtccactcncactgtntctaccacgacgtgagcacgtccacgtagtcgtacttaacactaccgtaaacgtcggtacagactaacgaaccgtacggaacaacgacccgaaccggngggtacctaactactaatttaacaaacgtaaaaccaaaaccaaacctaaacctaccgtccgtaacccgaccccgtacgtacccgtacttcgtaccgtacggtccccttacccggtaccgggttacggggaacctaaaccgtccgtacccgacccgtacgtaccgtacgtcgtacggtggtagtccggacgtcgacggttacggacgggacgtacggtctaacgtactacgtccgtacgtccctaactttcggttagttgggtagtcgttcgtagtcgtacgtcggtaccgggaggaaccgtacgacgtacgtacgtacgtattaccgacgtaccggacctcggcctcccgtccgtcgtctacgtcccttcccgcccgtacccg

SEQ ID NO: 133647 - DNA, 626 bp, Homo sapiens
  misc_feature: GYAE6OF01BOD6Y.17.33.C11.1.454.CMB.1.raw
  modified_base (216)..(216): a, c, t, g, unknown or other
  misc_feature (216)..(216): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtgtccccaggagggacagtcactctcacctgtcncttccaacactggagcagtcaccagtgcttactataccaaactggttaccagcaagaaaccgtgaacaagccacccgaggcactctaatttataacgtaacaaacaaacaaaccactcctacgacccctgacccgtattctcgacgcctccctcgttggggacaaagctacgccctcgactactcgtcgtggtgtcgcacggcctaggacggacggacggtactaggtacttattacgtcgacctttacttactttacgtttgggttcgtgtcgttgtcgtcgttacgttacgggcgggacggaccgtagcgtacggtaccgttacgttaacgtccgtaccgacccgtacggcccgtacccggcccccgttcggtccctaccgtttccgtccccgttccccttacccccg

SEQ ID NO: 133648 - DNA, 675 bp, Homo sapiens
  misc_feature: GYAE6OF01C6X9W.17.33.C11.1.454.CMB.1.raw
tcagcgtagactagcacgaccggtgctcgatttagagtgagctcgttgggttggggggcgccaggggtcccttccaatatcagcaccatggcctggactcctctcttctgtcctctcacttgctgcccagggtccaattctcagactgtggtgactcgaggacgccctcactgactgtcgtcccgaggaggacagtcactctcacctgtcgccttaccaacacgtcggacgcacgtccactaggtacgtacttactactacctaacgtacgtacacgacgaacgaacgacgacacgaccgacgacgactactactatactaacgtaaacaaacaaacctaacctaccgtaccgtaccgtacccgtacgtaccgtactaccgtaccgtaccgtaccgtaccggttaccggtacgggactaaccgtccgtaccgtaccgtacgtaccgtacgtacgtacggtcgtacgtcgacgcggtacggtacggacggacggtacgtacgtacgtaacgtacttcgtactacgttacgttacgttacgtggtacgtcgtcgtcgtcgtacgtacggtcggtacggacgtactacgtccgtacgtaccgtacgtaccgtaccgaccgtaccgacgtcccgcccgtccgtacgtcctcctccgtacccgtccctccgtcccgtacg

SEQ ID NO: 133649 - DNA, 705 bp, Homo sapiens
  misc_feature: GYAE6OF01BB8X3.17.33.C11.1.454.CMB.1.raw
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccgagggagggacagtcactcgtcacctgtcgtccttaccaacacgtggacgcacgtccaaccagtcgtacttactactacctaaacgtcggttaccagacaacgaacctggaacacgccaccgaggcactactatttanaacgtaacaaacaacaacctacctccgtacgacccctcgacctacttcncgacgtcctcccgtcggtacgggacacgtctcgcctagacctcgtcgttcgtaggtcgtcgacgtacgccggtaggacgggtacggacggtcgtacgtacttacgttaccgttacgtaccttacgttaccgtttacggtttggggtacgttcgtacgttcggttacggtaccgttacgggttccggggacgggtaaccgggtacgtaacggtccggttaccggtaccgttacggttaacgtaccgaccggacccggtacggtacccggtccccgttaccccggtcgtacccttaaccgttcccgttacccgtcccccttaacccccgg

SEQ ID NO: 133650 - DNA, 743 bp, Homo sapiens
  misc_feature: GYAE6OF01BPX53.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacactggacgcacgtcaccagtgcttactactaccaaactcggttaccaagacaacgaaaccgtggaacaagaccaccgacgggacactctaattataacgtaacaaacaacaaacacctaccgtacgacccctcgacccgtacttcctacgacggtcctcccgtccggttacggggacctaaacggccttcggacccgttacgactacgttcggtacgttggtcggtcgaccgacggtacccgtgggtaacgggaacggtacggccgttaacggtaacctttaactttaccgtacgtacccgtttaacctttaccgtttaacggttttgggttacggttgtcgttcggttacgtccgttacgggttcggggtacggaacggggtaacccaggccgttaccggtaaccggtttacgttaaaccgccgtaaccggaccccgtaacggtccccgttacccggaccccccggttacgtaccccgttaaccgttcccggtttccccgtaccccccgttacccccg

SEQ ID NO: 133651 - DNA, 1078 bp, Homo sapiens
  misc_feature: GYAE6OF01AG236.17.33.C11.1.454.CMB.1.raw
  modified_base (149)..(149): a, c, t, g, unknown or other
  misc_feature (149)..(149): n is a, c, g, or t
tcagcgtagactagcacgaccggtgctcgatttagagtgagctcgttggggtttggggggcgccgaggggtcccttccaatatcagcaccatggcctggactcctctctttctgttcctcctcacttgctcgcccgagggtccaattcncagactggtggtgactcgaggacgccctcactgactcggtccgtacccgagggaggactagtccacctcctacctaccgttggtcgtacccttaaccaaccgtacggtagggacgtacctacgtaccaccgtaggttcgtaacctttacctactaacccgtaaacggttccggtaccgaagtaaccgaaaccggtaaccgtacggaaaccgaaccggacccgaacccggacggtacctaacttacgttaaacgttttaacgtaaaccgaaaacccaaaaacctaaaacccgaacccgttaccccgttacccgggtaaccccggtaacccccgttacccggtaacccgtttaccttacccggtacccggtaaccccggttccccgtttaaccccgggtttacccgggggttaacgggggaaaccctaaacccggggtcccgttaaccccggtccccgtaacggtaacccgttaccgggtttaccgggtttccgggtacggggtttacggtacccggtaacccggtaccgggtacccgggtaaacgggggtaaccggggttaaccgggtacccggttaacgttaaccggtttaacctttacccggttaacccgttcccgtttaacccccgttttaccggtttaccgggtttttacggggtttcgggtacggtttccggttaccggtttacggggtttacccggttacggggttacccgggggttaaccgggggtaccccgggtaaacggttacccggttaccggttaacccgggtaccggttttaacccggtacggttaacccggccgtaacccccgggtaccggtaaccccggttcccggttcccccggtaaccccgttcccggttaacccggtcccggtttacccccgttcccccgttcccccggtccccgtttaacccgttaccgggg

SEQ ID NO: 133652 - DNA, 781 bp, Homo sapiens
  misc_feature: GYAE6OF01ASSA4.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaatttctcagacttgtggtcgactcgaggacgcccctcacgtgacttggcgtccccgagggagggacacgtcactctcacctgtcgcttaccaacacgtggacgacaggtcacgagtctacttaactactaccaaacgttcggttaccacgacaacgaaaccgtggaacacgacctacccggaggaccacgtataacgtttatacgtaaaacaaacaaacaactacctaccgtaccggacccctacggacctcctaccgtcggacgccttccccgttcggtacggggacgtaaacgcctacccgcccggtactaccaccggttcgtcggtacgggttcgacgtccgtacggtaccgacgggtaacggggtaccgtaacgtcggttaacgtaccgtttaaccgttaaccgtacccgtaccctttacgttccgtttaaccggttttcgggttgggttaccgtcggttaggtccggttacggtttacgggttccggggacccggggtaacggtaccggtaagggtaccgttccggtaacggtttacgtaaaccgtccggacccgtacccggacgtcccgttaccccggttcccccgtaccggttacttacccttacccccgttcgttaccccccgttaccccc

SEQ ID NO: 133653 - DNA, 845 bp, Homo sapiens
  misc_feature: GYAE6OF01A20EO.17.33.C11.1.454.CMB.1.raw
  modified_base (226)..(226): a, c, t, g, unknown or other
  misc_feature (226)..(226): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgacctgtcgtccccgagggaggacagtcactctcacgtgtgccttccaacncgtggagctagtcaccgagtcgtcttactactaccaacgttcggttccagaccaacgaaccgtggaacaacgaccgaccgaagggcctacgtcttaagtttaagaacgttaaacaaaaaccaaaccgaaaaccctaccgttccgtaacccggtaccccgtacgtaacccccgtactttacctccggtaacgggtccccttaccccggttaccggggtaacgggggtaacctaaaccggtcccgttaccgtaccccggtaacggtaacccgtaccgttttcgggttcccgtttggggtttacggtacccggtaccggtaaccggtaccggtaccggggtaacgggtaaaccgggtcgggttaccgtaccgttaaccgtttaacgtttacccgttccgttaacccgtttaaccttacggtttaaccggtttgggttcggttacgtcgtttacgggtcgttccgtttacggggttacccggacgggggaaccgggttacaaaccgggcttaaccggttaccggttaactaaccggtctacccggtaccgacgttcccgtacccggttaccccgtccgtcgtacccgtttccgttcccgtaccccgttcccgcctttacccgg

SEQ ID NO: 133654 - DNA, 666 bp, Homo sapiens
  misc_feature: GYAE6OF01DC4D3.17.33.C11.1.454.CMB.1.raw
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (242)..(242): a, c, t, g, unknown or other
  misc_feature (242)..(242): n is a, c, g, or t
  modified_base (551)..(551): a, c, t, g, unknown or other
  misc_feature (551)..(551): n is a, c, g, or t
tcagcgtagactagcacgaccggtgctcgatttagagtgagctcgttgggttgggctggcgccgagggtcccttccaagtagtcagcaccatggcctggactcctctcttctgttccctcctcacttgctcgccgaggtccaattctcagactgtggtgactcgaggacncctnactgactgtccgtacccgagggtcggactagtccactctccacgtgtcgtacctaccagacgtggacncgaacgtcaaccgtgtactccttaacactaacctaactcggttaccacgaccaaacgtaaccgtacggaacaacgaccaaccgacggacacgtactagttactaacgaacaaaacgaactaaccaccgttccgtaccgaccgtcgacctacgtcacgtacgtcctcccgttcgggtacgggacctaaacgtccgtacgtacccacgggtacctaccgttggtccgttgggtgtcgtacggccgtacgtggacggacggtacgcgttagtacctattcgtaccgtctacgttacgttgttgtgtgtcgtntcgtactggtcggtcggtagacgtacgtccgtacgtacgttacgtacgtcgaccgtacgcggtaccgtcccggtacccgtacgtcctaccgttccgtacccttccccggtacccc

SEQ ID NO: 133655 - DNA, 881 bp, Homo sapiens
  misc_feature: GYAE6OF01EA7CE.17.33.C11.1.454.CMB.1.raw
  modified_base (820)..(820): a, c, t, g, unknown or other
  misc_feature (820)..(820): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccaggtccaattctcagactgtggtgactcaggacgccctcactgactgtcgtccccgagggaggacagtcactctcaccgtgtcgcttaccaacgacgtggaagcaacgtccacctagtcgtactttaactactaccaaacgttcggttaccgagaccaaacgaaaacccgttaggaaacctaacgacccgaaccccgaaggggtacctaaccttaccttaagttttaacgttaaacggttaaaacctaaaaaaccgaaaaccctaaaaccaacccgtttaccccggtaccgggaacccccgttaccggaccccgttaacgtttaccgtaccgaaccggttccccgttaccccgtttaccggggtttaccggggggaaactaaaaccggtccgtaccggtaccccgtacgtaaccgtaaccgtttcggttccgttgggtttccgtacggtcctaacggttacccgttcggggaaacggggtaaccggtaacgggttcctacggtaaccgtttaacgttaacccgtccgggtaaccttttaccgttacgtttaccgggtttttgggtcggttccttggtacggtcgttacgttacggtttaccggggacgggtaaccggtaccgtacggtaccgtcggttaacccttgttaaaaccggccaaccggtaccccgtaacgtcccgggtccccncccccgttaggtcccctacgttacccgttaccgttacccccctcccgttccttaaccccgg

SEQ ID NO: 133656 - DNA, 860 bp, Homo sapiens
  misc_feature: GYAE6OF01CP68L.17.33.C11.1.454.CMB.1.raw
  modified_base (253)..(253): a, c, t, g, unknown or other
  misc_feature (253)..(253): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagattgtggtcgactcgaggagccctacactgacgtgtcgtacccgagggtacgggactagtaccactcctacaccgttggtactccttaccaacgtactgggacnctagtccaaccgagtcgtacttaactactaccgtaaaccgttcggtaccacgacgaaacgtaaacccggtaggaaccaagacccgtaacccgagggtaccaacgtttactaaactttacgaaacgttaaaccaaaaaccgtaaaccaaaccgtaacctacccggttaccggaacccccttacggtaccccgttaactccgtaccgaccgtacccgttaccccgttacggggttacgggggtaaccctaaacggtcccgttaaccggacccgttaacggtaaccgttaaccgttcggttaaccggttcgggttacggttaccggaaccgtaaccgggtaccgttaagggaaaccggggtaccggtacgggttaacgtaagggtaaacccgtttagttaaccgttacccgtaaacccgttaccgttacggttttacggtttacgggtcggttacgtacggtcgtttacgtaccgttagggtaccggacgggtaaccggacgttaacgcggttacgtaccggttacgttaacggtccgaacccgacggtaacggcccgttcccggtacccgtgtaccctacccggttacctcccgttcccctaaccccgg

SEQ ID NO: 133657 - DNA, 764 bp, Homo sapiens
  misc_feature: GYAE6OF01ARFJI.17.33.C11.1.454.CMB.1.raw
  modified_base (172)..(172): a, c, t, g, unknown or other
  misc_feature (172)..(172): n is a, c, g, or t
tcagcgtagactagcacgaccggtgctcgatttagagtgagctcgttgggttgggggcgccaggggtcccttccaatatcagcaccatggcctggactcctctctttctgttcctcctcacttgctgcccagggtccaattctcgagactgtggtgactcgaggacgccctnacgtgactggtcgtccccgagggagggactagtcaccttctcaccttggtcgccttaccgaatacgtggacgctacgtccaaccgtgtcgtactttaactactacctaaacggtcgttaccgagtacaagtaaccgtgaaccacgaccaccgaggccatacttaagtttaactaacgtaaacaaaccaaacgtaaccaccgttaccgtaccggtacccctccggtaacccgtacttaccgtccgtaaccggtccgtttaccccgtccggggttacggggaccgtaaacggtccgtaccggacccgtacgtaaccgtaccgttaggttcggtagggttcgcggtacgtcggtaaccggttcggaacggggacggtacggtacgtaacggttaacgttacgtaaccgtcctaaccgttacttcgtttacgggttcggtagtcgtccggttagtcgtacgttcggtacgggtacgggacgtagaccggtgtaccgtagttaccgtaacgaccgtacgggtacccgaggttcccggtcccgtcccgtaccgtcgttaccctcggttcccccgtacttcccccgtacggttaccccg

SEQ ID NO: 133658 - DNA, 834 bp, Homo sapiens
  misc_feature: GYAE6OF01CJ5I1.17.33.C11.1.454.CMB.1.raw
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccgagggtccaattctcagactgtggtgactcgaggacgccctcactgactgtcgtaccccgagggagggacacgtcactcctccaccgtgtcgccttaccaacacgtggagcacgtccacgtagtcgtaccttaactatacccaacttcggtaccagacaacgaaacctggaacaacgccaccgaggaccactactaatttanaacgtaacaaacaacaaacnctaccgtacggaccctcgaccgatccacgtacgcctccgtcggtaggacaacgtctcgtccgacactacgtgtcgtggttacgcgtacgacggtccgtaaggtacggggaaccgtaggtcgttaacgtacctttaacgttccgttaaccggtaccctttaaccgtttaccggttttacgggttttaggggtacggttcggttacccgttttagggggtaccttaaccgggttttacgggggaccccgggggttaacgggtaacccgggggtaacccgtaaaccggttccccgggtttaaacccggtaacccgggttttaaacccttaaaccggggtaccccggtaaacccccggtccccgggttaaaccgggggtccccctttaaccccccggggtccccccccggttaaccggttacccccgtttaccgtacccccccggtttttccccgtttacccccccccggtttaaccccccg

SEQ ID NO: 133659 - DNA, 835 bp, Homo sapiens
  misc_feature: GYAE6OF01CFDYZ.17.33.C11.1.454.CMB.1.raw
  modified_base (235)..(235): a, c, t, g, unknown or other
  misc_feature (235)..(235): n is a, c, g, or t
tcagcgtagactagcacgaccggtgctcgatttagagtgagctcgttggggtttggggggcgccaggggtcccttccaatatcagcaccatggcctggactcctctctttctgttcctcctcacttgctcgcccagggtccaattctcagactgtggtgactcgaggacgccctcactgactgtcgtccccgaggagggacagtcactctcactgtgccttaccaacacgtgganactacgtaccaccgaggtctactaactactaccgtaaacgtcggttaccagtaccaacgtaaacgtggaaccacgacccaccggtaggcctactactaatttacgtaacgtaacctaaaacaaacgaacctaccttaccgtaccggaaccccctcggtacccgtataccgtacgacggtcccttccccggttacgggtacgggggaacctaaacggccgtaccgtacccgtagaacccgtacgtttcgttcggtacgggtcgtacggtaccgtacgggtccgtagggaacgggtaacgggtacgggtaccgttaaggtaccgttaacgtttaccgtaccggttaaccctttaaccggtttaccggttttaacggttttcgggtaggtttccggtaccgtttgggttaaccgtttacgggttacgggttacccggggtacgggggtaccgggtaaccgtaaccggttaccggttacccggttaacggttaccgttaacggtaccgaccggtacccgaacgggttccccgtaccccggttaccccggtcgttaccctacccgttcggttaccccttacccccgttcccgttccgttacccgg

SEQ ID NO: 133660 - DNA, 744 bp, Homo sapiens
  misc_feature: GYAE6OF01EDZ6H.17.33.C11.1.454.CMB.1.raw
tcagcgtagactagcacgaccggtgctcgatttagagtgagctcgttgggtttgggggcgccaggggtccttccaatatcagcaccatggcctggactcctctctttctgttcctcctcacttgctgcccagggtccaattctcagactgtggtgactcaggacgcctcactgactgtgtccccgaggagggacagtcactctcacctgtcgtctttaccaacgtacctaggacgctagtcaccagttcgactttactataccaaacgtcggttccagacaacgaacctaggaaccaacgcctacccgacgggaccacttactaattttacgtaacgtaaccaaaaaccaaacctaaacctaccgtacccgttaccggaacccccgttacgaccccgtactttaccgtaccgtaccggtccgttccccgttccgggttacgggggaaccgtaaaccgccgttaccgcccgtagaaccgtcttcggttcgttggtacgtcgcgaccgtacgaggacggtacggacgcgttacgtacttacttacctcgtaccttaacgttacgtttacgtttcgggtcgttactcgtgtctacgttacgttccggggacggtaaccgggtaccgtaagtccgtacggttaccgtacgtttaaccgacgtaccggaccctaaggtcccgttcccgacccccggttacggtcccttaccgttcccttaccgttcccccgtacccgttcccttacccg

SEQ ID NO: 133661 - DNA, 788 bp, Homo sapiens
  misc_feature: GYAE6OF01CLS7E.17.33.C11.1.454.CMB.1.raw
  modified_base (168)..(168): a, c, t, g, unknown or other
  misc_feature (168)..(168): n is a, c, g, or t
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (256)..(256): a, c, t, g, unknown or other
  misc_feature (256)..(256): n is a, c, g, or t
tcagcgtagactagcacgaccggtgctcgatttagagtgagctcgttggggtttggggggcgccaggggtcccttccaatatcagcaccatggcctggactcctctctttctcgttcctcctcacttgctcgcccaggtcctaatctcagactgtgtgctcgaggacnccctcactgactggtccgtacccgagggaacgggtacncgtaccnccttctaccacctggtctaccttaccaaacgtacgtggtaacnccgtacgtaccacgaggttcctacttaacctactaacctaaacgtcggtaccagtacgaacgaaactaggaacaaccgacaccgacggccagtactatttaacaataaacgaaaacaaccaaactaccgtaccgaccgaccgtcaccgtctaccgcgtaccgtcctccgtccggtacgggacaacggtcctaccggccgtaacacgtcgtttacggtcgttcgggtacggtactaccggtacggtccggtacgggtaacgggtaacggtacgtacgttacgttaacgttaactccgttacgtaccctttaccgtttacttccggtttagggtcgtacttgtacggtcgttacgtacggggtacgggtaccgggacggtaaacgtcccggtagtaaccggttacgttaacctaaccggtaaccgacccggtaccggtaacccggtccccgttccccggtaaccccggttccccgtacccgtttcccgttaacccgtttccccggttacccctccccgtttcccgttacccggg

SEQ ID NO: 133662 - DNA, 810 bp, Homo sapiens
  misc_feature: GYAE6OF01BW6JX.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactggtcgtccccgagggtagggacctagtcgactcctcaccttgtcgtccttaccaactacctgggagcagtccaccgtaggtcgtctttaactactacccgtaaactcgggtttcccagtaccgaacgaaaccgtggaacaacgtccacccgagggcactactatttatacgtacaaacaaacgtaactacctccgtaccggacccctcgtacccgtaacttcgtccacggccgttcccgttcccggttacgggggaacctaaggccttacggcccgtacggctactcggtcgttgggtacgtcgactacgtccgtacgggacggacggtaaggtccgtagttaaccttagttaaccgtccggttaccctttaaccctttccggttttaacggttttacggggtcggtttcggccggtttaaggttccgtaccgggtttacgggttcccgggttaaccggggaacccgggtacgaaacgttccgggtaaccgtacccggtttaaaccgtttacgggaaccctacccgggtaaccccggttacgggtcccccgtccccgggttacccccggttacgtaccccgttacccgtttcccgtttaacccccgggttccccccttaacccccccgg

SEQ ID NO: 133663 - DNA, 821 bp, Homo sapiens
  misc_feature: GYAE6OF01B7NOK.17.33.C11.1.454.CMB.1.raw
  modified_base (234)..(234): a, c, t, g, unknown or other
  misc_feature (234)..(234): n is a, c, g, or t
tcagcgtagactagcacgaccggtgctcgatttagagtgagctcggttgggtttggggctggcgccgaggggtcccttccaatatcagcaccatggcctggactcctctctttctgttcctcctctacttgctcgcccagggtccaattctcagactgtggtagactcgaggacgccctcactcgacgtcggttccggacccgagggagggacacgtcactctcctactggtcnccttaccaactacgtggacgctaacggtccacgtaggtactacttaactactaacctaaacgttcgttaccgacgacgaaacgtaacgtacgaacacgaccgaccgagggacctaacttcctaattactaagaaaccaaacaaacaaaccaaccgtacctaccgggtacccttaccgaccgtaccttacgtaccgtaccgtccgttaccccggttacgggtacggggtaaacgaaccgtacggtccgtaccggtccaaaccgtcggttacgtacggttagggttcgtaacggccgtaccgtacgggtacgggtacgggaaacgggtcggtacgtaacggttaacttaccgtttaacggtacggttaccctttacgtttaccggttacggttttaacgggttggttaccgttcggtttacggtaccgtttacgggtttaacccgggacggggttaacgggtaacccgggtaacgttacgggtacggttaaccggttaccgttacgttaacggtaccgaacggtacccgcggtcccgtccgtacccgttcccgtacgttacccgtcttaccccggttcccttaccccgg

SEQ ID NO: 133664 - DNA, 811 bp, Homo sapiens
  misc_feature: GYAE6OF01D7YM9.17.33.C11.1.454.CMB.1.raw
  modified_base (661)..(661): a, c, t, g, unknown or other
  misc_feature (661)..(661): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgtactcaggagccctcactgactgtcgtccccaggaggacagtcactctcacctgtcgtaccttccaaactaacctgggaacgccgaagttccgaacctaggttcgtacctttactaacttaccctaaaacgttcggtttacccaggaccgaacggtaaaacctcggggaaaccaacgaccgaaccccgaggggtaccctaacgttaccgtaattttaacgtaaacggttaaacctaaaaaccaaaccctaaaacctacccgttaaccccgttaccgggtaaacccccctcggtacccccgttaaatttacccgtaccgtaaccggtccccttacccccgttccgggtttacggggggaacctaaaacggtcccgttcggaccccttaggacctaaccggtgtccggttacggtcggttacgcctacggaccgtaggaacgggtaccggaggtactacgtaactacgtacctcggtcctacgttcttacggtttggtcggtanccgttgtcgtaccgttacggttacggaccgggacggacctacggtactaccggtaccgttactaaccggtccgtaacggaccccggtaaggtcccgtcccggtacccccgtcggtacctaccgttcccgtttcccgtccccgttaccccg

SEQ ID NO: 133665 - DNA, 805 bp, Homo sapiens
  misc_feature: GYAE6OF01A0H4K.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccgaggaggacagtcactcctcacctgtgccttaccaactacgtggagcacgtacaccgagtcgtacctactaactaccaaacgttcggttccagccaacgaaaccgtggaaccaacgccaaccgacggactactactaagttttaactaacgtaaaccaaaacaaacaaaccaccttccgtaccggtacccccgtgtaccccgtacttccgtacgtacggtcccttacccgtcgggttacggggactaaacgccgtacgcccgttacgacgtaccgtacgttccggtcggtcggtacgtacgaccggtcgtacggaacggacggacgtcctaggtaaccttacgttacgtccgttaccgttactttaccgttacggtttacgggttcggttcgtacgtttcgggtaccgttacggtttaccggttacccgggggaccgggttaaccgggtacccgttaacgggtccgttaaccggttaaccggtttaaccgttaaccggacccgttaacccggaccccgtaagggttcccccttaccccggtacccccggttaccggttacccgtaccgttacccgttacccccgtttaccccctaaccccgtttcccgttaaccccg

SEQ ID NO: 133666 - DNA, 608 bp, Homo sapiens
  misc_feature: GYAE6OF01BHR93.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactataccaaactgttccagcaagaaacctggacaagcaccgaggcactctatttaatagtaacaaaacaaacaaacacctccgtacggacccctgacccgatctcgacgcctccgtcgtaggggacaagctcgaccctgacactgtcgtggtgtgcacgcgtagacggacggagtctagacttacttactagtccttactctttacgtttggtggtagtcgtgtgtactacgttcgggacgggtacggaaccaaggtcgtacggtaccgttacgtaacgtacgaaccgaccgtaacggtccctccgtccccccgtacggttcctaccttcccgttaccgttccccctacccgtcccgttacccg

SEQ ID NO: 133667 - DNA, 1046 bp, Homo sapiens
  misc_feature: GYAE6OF01DXP9N.17.33.C11.1.454.CMB.1.raw
tcagcgtagactagcacgaccggtgctcgatttagagtgagctcggttgggtttggggctggcgccaggggtcccttcaatatcagcaccatggcctggactcctctcttctcgttcctcctcacttgctcgccgtagggtcctaattcgtcagtacgtggtggtcgactcgaggaccgccctactacgtcgtacgttcggtcccgtacccggaagggtacgggacctacggtaccaccgttcctaccgtaccgttcggttaccgtcccttaacccgaaacgtacggtacgggaacgtaccgtaccgtacccgtaccgttacgggttaccgttaaccttaaccttaacccgttaacccgttaaccgggtttaccggtaacccgtaaacggtaacccggtaaaacccggtaaaccggtaaccgggaaacccgtaacccggaaccccggtaaccccgggtaacggtaaccctttaaccgtttaaccgtttaaaacggtttaaaaccgtaaaaacccgaaaaaaccctaaaaacccgtaaaacccgttaaacccgttaccccggttaccccgggtacccccggtaccccgtacccggttaaccccgttaccgttacccggtacccggtaccccgggttacccccgtttacccggggttaccgggggtaaccggtaacccgtaccggtacccggttacccgtaccggtaccggtaccgttaccggttcgggttaccgggtacgggtacggtaccggtaccggtaccgggtaccggggtaacgggtaccgggtaaccgggtaccgtacgtaccgttaaccgttaccgttaccgtaccgtttaacccgtttacggtttaccgggtttcggtttcgggttcgtcggttcggttaccggttaccgggtacgggttaccgggtaaccgggtaacggggtaccgtacggtaccgttacgtaccggttaccgtacgtacgacccggtaccgtaccgtcccgtacccgtcccgtcccgttaccgtcccgttcccgttaccctccccgttccccgtccg

SEQ ID NO: 133668 - DNA, 858 bp, Homo sapiens
  misc_feature: GYAE6OF01BGT6H.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccgagggagggacagtcactcctcacctggtctcttaccaactacgtggacgacgtagtaccaccgtaggtactaccttaactactaccgtaaacgttcggttaccaagacgaacgaaaccgtggaacaacgaccgaaccccgagggaccacctctaagtttacgtaacgtaacaaaacaaaccaaactacctaccgtaccggacccctcgaccgtacttcctcgtaccgtccgttacccgtcgggttacggggacgaaacgtcgtccgtacccgtacgacctacgtcggttaccggttgggtacggtcggccgtacggtaccggtgggaacgggaccgggtacgtacgtacgttaaccgttaacgttacccgtaccgttaccccgtttaaccgtttaccggttttacgggttttcggggtttacgggttccgttcggttacggttaccgggttcgtttaccgggttacgggggtaaccgggggtaaccgggtaaccgtaacgggtacccggttaaccgttaccggttaacccgttacggtaacccggtaaccggtacccgggttaaccggtccccggttacccccggtccccccggttaccggtaccccgttacccgttccccggtttaccccggttccccccggttaccccgttccccgtttaaccccgg

SEQ ID NO: 133669 - DNA, 1045 bp, Homo sapiens
  misc_feature: GYAE6OF01CI7V2.17.33.C11.1.454.CMB.1.raw
tcagcgtagactagcacgaccggtgctcgatttagagtgagctcggttggggtttgggggctggcgccaggggtccttccaatagtcagcaccatggcctggactcctctctttctgttcctcctcacttgctcgccagggtccaacttctcagtactggttggtgactcgaggacgccctcactgactgtcgtcccgagggaggacagtcactctcacctgtcgtcttaccaactacgtggacgactacgtaccacctaggtacgtacttaacctacgtaccgtaaacgttcggttaccaaggactaacgtaaaccgtgggaaccaacggcccgaaccgtacgggtacctaaccgttacgtaaacgtttaacgtaaaccgtaaaaccgaaaacctaaaaccgtaaaaccgtacccgttacccgtaccccgggtaaccccgtaccggtaccccggttaacgtttcccgtaccggtaccggtaccccgttaccccgggttaccggggttacgggggtaacctaaaacgggtccttcccggtacccgttaaccggtaacgttacccggtttacggttccgggttacgggtttaccgggtacggttaacccggtaccgggttaaccgggtacggggtaaccggggttaacccggtacgggttaccgttaaacgggtttaacccgtttaacggttttaacccgtttaccgggttaaaccccgttttaacccggttttaaccggttttaacgggtttttcggggggttaccgggtttaacggtttcccgggtttacgggttttaccgggtaccccggttttaagggggttaccccgggggtaaacccgggggtttaacccgggggaaaccgttaaaccgggttacccgggttaaccgggtaaccccgggtttaaacgtttaacccgggttaccggaacccgggttacccggtaaaccgggtttccccgttaccccccgggttaccccgttaccgggtttacccctaccggttttacccccggtccccgggtttacccccgttacccccgg

SEQ ID NO: 133670 - DNA, 757 bp, Homo sapiens
  misc_feature: GYAE6OF01DPB6J.17.33.C11.1.454.CMB.1.raw
  modified_base (384)..(384): a, c, t, g, unknown or other
  misc_feature (384)..(384): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccgagggaggacagtcactcctccaccgtgtcgtccttaccaactacgtggacgctacgtaccaccgtagtacgacctttaaccgatacccgtaaacgttcggttaccaagaccaacgaaacccgtgggaacaacgccgaacccgtagggacctacgtactaagtttaactaacgaaacctaaaacaacctaaaccnccgtaccgtacgacccctcgcccgtatctcgacggtcctacccgttcggttacgggaactaaacgtcctccgtcccgtagacctacgtcgttcggttacggttgcgtacgcggtaccgtaggaacgggtacgagtacggtatacttaacttcgtacgtccttacgttacgtttaggtttgggtacgttacgtcgttggtcggttaccgttacgggttccggggacggtaaccgggaccgttaacggccgtttaccggtaccggttttaacgtaccggtaaccgtacccgggacccgtaaaccgggtcccgttccccggtacccccgttcggttacctaccgttttcccgtaccccggttcccccgttaccccg

SEQ ID NO: 133671 - DNA, 666 bp, Homo sapiens
  misc_feature: GYAE6OF01BZIYM.17.33.C11.1.454.CMB.1.raw
tcagcgtagactagcacgaccggtgctcgatttagagtgagctcgttggggtttgggggggcgccaggggtcccttccaatatcagcaccatggcctggactcctctctttctgttcctcctcacttgctgcccagggtccaattctcagactgtggtgactcagggagccctcactgactgtcgtccccaggagggacagtcactctcacctgtcgccttccaacacgtggagcagtccaccagtgtctttactactaccaaacgtcggttccagacaacgaaaccgtacggacaacgaccgaccgacgggcaacctctaatttataagtaacaaacaaacaaactactcctcgacccctcgccgtattctcacgctcctcgtcggggacaacgctcgcctcgacactgtcgtggtgtgcgacgtcgtaggacggacggaggtctacgacttacgttactcgtaccttacttacgtttacgtttgggtcggttgtcgttggttcgtacgttacggttcgggtacgggacgggtaaccgtacggccgttacgtaccggttaacgttaaccgtacgtaaccgacccggtaacgtcccggtcccggtccccggttcccgtacgtacccgttcccgttcccgttcccccggtccccttcccgttacccg

SEQ ID NO: 133672 - DNA, 755 bp, Homo sapiens
  misc_feature: GYAE6OF01CC1HS.17.33.C11.1.454.CMB.1.raw
  modified_base (206)..(206): a, c, t, g, unknown or other
  misc_feature (206)..(206): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccaggaggacagtcactcncacctgtgccttaccgaacactggagcagtaccaccaggtcacttaactaactacctaaactcggttaccagactaaagaaacctaggaacaacgaccgaaccgacgggacctaacgtacctaattttaacgtaaacgtaaaaccaaaaaccaaaacaaaactaaccttacccgtaccggacccctacgacccgtaacttcctaccgacggtcctacccgttccggtagggggaaccaaacggtcctaccggaccctacgtaacctacgttcggttcgtacgggttacgtacggaccgtacggtacccgtagggtaaacgggacggtaacggtacgtacgtaacttaaccttacgttactaccctttaacgttaccgtttacggtttagggtcggttacgtcgttacggttcgtacgttacggttccgggaccggaacgggtaccgaaacgtccgttaacgtaccgttaacgtaacgtaccgacgaacccgaacgtccgtcccgtacccccgttcgtacctacctttccgtcccgttccccgtaccccg

SEQ ID NO: 133673 - DNA, 910 bp, Homo sapiens
  misc_feature: GYAE6OF01CWXRF.17.33.C11.1.454.CMB.1.raw
  modified_base (184)..(184): a, c, t, g, unknown or other
  misc_feature (184)..(184): n is a, c, g, or t
tcagcgtagactagcacgaccggtgctcgatttagagtgagctcggttgggttggggctggcgccgaggggtcccttccaatatcagcaccatggcctggacctcctctcttctgttcctcctcacgtgctcgaccgaggtccaacttctcgacgacgtggtaggtacgacctcgacgggaccncccttcacgtacgaccgtcggtccggaccccgaaggggacggaacgtacgtcctaaccgtccgtaccgtccgttcggtcgtaccgttaacccgaaaccgtacggttacgggaccgaccgtaaccggtacctaaccggtacggttacgttaccgtttaaaacctaaccccgttaacccgttaaaccggttaccggttaccccgaaacggtaaacccggaaaaccggttaaacccggtaacggaaccgaaaccggaaccccgttaaccggaacgggtaccccttacggttaaccttaagtttaaccggaaaacctaaacccgaaaaacctaaaccgtaaaccctccgttaccccgtaacccgtacccgtaccgtaaccgtacgttaccgaccggaaccgtccccgtaccggttacggggtacggaacctacgtaccgtccgtaacctacgacgttcgtacgtcggtgaacccgtggaccgtaggtaccgtagggtacggaacggtacgtaccgttacgtaaccttacgttacccagttacccgtaacgttttcggtaaccgttggggtaccttacgggtcgttaacggttacggtaccgttacgggtacgggccggttaaaccgacgtaccggtacgttaccgaaccgttaagaccggtacgaaccggtaccgacgtccccgtaacgtcccgtacggaccttaccggccttacccgtcccgtaacccg

SEQ ID NO: 133674 - DNA, 754 bp, Homo sapiens
  misc_feature: GYAE6OF01CIVBX.17.33.C11.1.454.CMB.1.raw
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctcgcccagggtccaattctcagactgtggtgactcaggacgccctcactgactgtcgtcccgagggagggacagtcactcncacctgtcncttaccaacncgtggagcaggtaccaccagtcgtacttaacgtactaccaaacgttcggttaccagtacaacgtaaaccgtaggaaccaacgaccaacccggaggccacctactaagttttaacaacgtaaacaaaaccaacaaacctccgttaccgtaccggaccccttcggaccccttattaccgtaccgtaccgtcccgttcccggttaccggttagggggaacctaaacggtccgtcccgtacccgtagtaacctcgttacgtcggtaggttcgtacgacgtaccgaccgtacggacgggaccgtcggtacgttaccggtaattaaccgtacgttaccgtccctttacgttccgttttaggttcgggttcgtacgtcgttcgtacgtcggtttacggaccggggtacggtacgggtaacctaaggtccgtaaccggtagttaccgtagtccgaacgtacctcggaacccgttccgaccccgtccccgttctacccgttaccgttccttacccctaccccgtcccgttaacccg

SEQ ID NO: 133675 - DNA, 910 bp, Homo sapiens
  misc_feature: GYAE6OF01BHR77.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactggtggtgactcaggacgccctcactgactgtcgtcccgaggaggacagtcactctcacctgtcgtcttaccaacacgtggacgcacgtccaccgagtcgtacttactactacctaaacgttcggttccagacaacggtaaacctcggaacaacggaccgaaccccgacggggacctaaccgtacctaagttttaagtaaccggttaaaaccaaaaaccaaaaaccaaaacctacccttaccccgtaacccgggtaaccccccgttaccggtacccccgtaacccgttacccccgaaccggttccctacccccgttcccgggttacggggggaaccctaaacggtccgtaccggtccccgtacgacctacgttcgttccgtcgggttacggtcgtacgacggtcccggtacgggaacgggtaccggtacggtacgtacggtaacctttacgttaccgttaccgttacccttacccgtttaccgtttaccggttttacggggttcgggttccgtacggtttcggtacggttaccgtttaggggtttacccggggaacggggtaacgggtaacccgggtaacggtaccggtaccggttaacccgtttaacggtttaaaccgggtaccgtaaccgggtaaccccggttaaccggggttccccggttacccccggttaccccccggttacccgggttacccgttaccccggttttacccggttccccggtttccccccccggtaccccgttttaccccccgg

SEQ ID NO: 133676 - DNA, 886 bp, Homo sapiens
  misc_feature: GYAE6OF01APDLY.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcacgtgactcgtcgtccccgagggagggacagtcactctcacctgtcgtccttaccaacacgtggacgacgactccaccgtagtcgtacttaacctaaccttaccctaaaaccttcggttacccaacggaccgtaaaccggaaacccgtacggaaaccgaaacgaccccgaaccccgaacggggtaccctacctttacctaatttttaaacgtaaacgttaaaacccaaaaaaccctaaaaccaaaaaccctaacccgttaccccgtaacccggacccccgtcccgtaccccgtaccttcctaccgtaccggtcccttaccccgttcccgggttacgggggaacaaaccgtccgtccgtaccccgtacgtaccgtacgttcgttcggttgggttacgttacggccacgggtcccgtaggacggggtaacggtacggtctacggttaacttacttacccgtaccgtcccttacctttaccgtttacggttttcgggttaggttcgtcgttcgtcgttacggttacgggtaccggggacggggtaaccgggtaaccgacggtaccggtaccggttaaccccgttaccgttaacggtccccgaacccgggtaaccccggtaacggggtccccgttacccccgggtccccccggtttcccgggtttacccttacccgtcccccgttttcccccggtttccccccccgtttaccccccg

SEQ ID NO: 133677 - DNA, 863 bp, Homo sapiens
  misc_feature: GYAE6OF01E23FU.17.33.C11.1.454.CMB.1.raw
  modified_base (166)..(166): a, c, t, g, unknown or other
  misc_feature (166)..(166): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccaggtccaattctcagactgtggtgactcaggacnccctcaactgactgtcgtccccgagggaggacagtccaccttctccaccgtgtcgtacctttacccaaactacgtagggacgccacgtccaaccgtagtcgtacctttaactaactacctaaacgttcggttaccacgacgtaaacgaaacccgtggaaccaacgaccgaacccgaacgggcctaaccttaccttaagttttaagtaaaccgttaaaccaaaaacctaaaaccaaaaccctacccgttacccgtaccggtaccccctcgaccccggttaactttcctaccgaccggtccctccccgttccggggtacggggacaaacgtccgtaccggtccctacgacctacgttcggtcgtagggttcgtacgtccgacggtcggtacggacgggaacgggtacgtaccgttaacgtaccttacgttacctacccgtacctttactttaccgttcgggttttacggtcggtttactcgttacggtgttaacggtttccgggtaccggggtacggggaacggtaaccgtaacggtccgttaaggttacccggtttaaccgttaaccggacccgaacgggttacccccggaagggttcccccgtcccccgggtaacccccgtttcccggtaccctttaacccgtttccccggttaacccccttcccccccgtttaaccccgttccccgtttaccccgg

SEQ ID NO: 133678 - DNA, 775 bp, Homo sapiens
  misc_feature: GYAE6OF01B5K2A.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtcgcttaccaacacgtggagcacgtcaccagtgtcttactactacctaacgtcggttaccacgacaacgtaaccgtaggaaccacgaccgaccgacggctactacttaattaactaacgtaaaccaaaccgaaacaacctaccgtacccgtaccggacccctacgacccgtacgttccgtaccgtaccgtcccgttcccgttaccgggttcggggaaccgtaaccgtccgtccgaccctcggtactacgttggtcgtgggtcgtcgaccgacggtccgtaggacggaccggtcggtacttacgtacttacgttacgtccgttaccttacgttacgtttacgtttcgggtcgttcgtcgttcgtcgtacggttcgttaccggggaaccggtacgggaccgttacggtaccgttaccggtaaccggtttccgttaaacgtacccggtaccgacccggtaacgggtcccccgttccccgggttccccccggttacccgggttacccttaccccgttacccggtttcccccttaaccccccggttccccgttaacccccgttcccgg

SEQ ID NO: 133679 - DNA, 621 bp, Homo sapiens
  misc_feature: GYAE6OF01ETNB4.17.33.C11.1.454.CMB.1.raw
  modified_base (169)..(169): a, c, t, g, unknown or other
  misc_feature (169)..(169): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (308)..(308): a, c, t, g, unknown or other
  misc_feature (308)..(308): n is a, c, g, or t
  modified_base (464)..(464): a, c, t, g, unknown or other
  misc_feature (464)..(464): n is a, c, g, or t
  modified_base (519)..(519): a, c, t, g, unknown or other
  misc_feature (519)..(519): n is a, c, g, or t
tcagcgtagactagcacgaccggtgctcgatttagagtgagctcggttgggttggggctggcgccaggggtcccttcaatatcagcaccatggcctggacctcctctctttctgttcctcctcacttgctgcccagggtccaattctcagactgtggtgactcaggganccctgactgactgtcgtcccgagggagggacagttccactcctcacctggtcnccttaccaaacncgtggacgcctacggtcaccagtgtaccttaactaactccgaaaacgtcggttaccaggacaacggtaaaaccngggaacaagtccaacccgagggcactctatttagaacgtaacaaacaacaaccgtaactcctcgggacccctgcccgtattccacgcggcctcccgtcgttggggacaagcctcggaccttggacctcgtgttcctgggtacgtgaactcgtccgngacggacgaggctaggaaccttaagttcgccgttactcttcttacggtttggtgngtaactgatcgtaagtcgggcggaggaccaagctcgtaccttagtaaggctacggcccaagccgtaccgccccgtgtacctactcgttcccgtcccgtcccc

SEQ ID NO: 133680 - DNA, 852 bp, Homo sapiens
  misc_feature: GYAE6OF01EUWKN.17.33.C11.1.454.CMB.1.raw
tcagcgtagactagcacgaccggtgctcgatttagagtgagctcgttgggtttggggctggcgccagggggtcccttccaatatcagcaccatggcctggactcctctctttctgttcctcctcacttgctcgcccagggtccaattctcagactgtggtgactcaggagccctcactgactgcgtcccagggaggacagtcactctcacctgtgccttccaacgacgtggacgcagtccaccagtcgcttacactaccaactcggtcacgacaacgtaaacctggaacaacgccgtaaccgacgggtactactacgtaatttacgtaacgtaaaccaaaaccgaaacaaaaccaccttacccgtacggaacccctacggacccctattacccaggtcctacccgtacctacgggttacggggactaaacgcgtacgcccgttacgacctagtacgttaccggtgggttacggtacacggtacgtaccggttaggtaaaccggggtaaccggtaacggtaccgttacgtaaaacgttaagtttcccgtttaaccgtaccgtttaaccgttttaacccggtttaaggttttcggggttggtacgttccgggttaacgggttcgttaaccccggtttaggggttcccgggtaaaacggggggtaaacgggacccccgttaaagggtacccggttaaccggttaaccccggtttaaaccggtttaaaaccgcccggttaaaccgggaacccccggtaaacgtccccccggttaaacccccggttcccccggttaaccccggtaaccgttaacccgtttcccccggttaaaccggtaccccccctttaacccccgg

SEQ ID NO: 133681 - DNA, 824 bp, Homo sapiens
  misc_feature: GYAE6OF01B1A5I.17.33.C11.1.454.CMB.1.raw
  modified_base (705)..(705): a, c, t, g, unknown or other
  misc_feature (705)..(705): n is a, c, g, or t
tcagcgtagactagcacgaccggtgctcgatttagagtgagctcggttgggtttgggggcgccaggggtcccttccaatatcagcacagtggcctggactcctcttctttctgttcctctcacttgctgcccaggtcaattctcgagactgtggtgactcgaggagccctcgactcgtacgtcggttcgccccgagggaagggactacgtcacgtcctactacccgttggtacgtcctttaaccaaccgtacgtgggaacgcgtaaccgtaccgtaccgtaggtacgtacctttaacctacgtaacctaacgttcgttaccgagtacgaacgaaaccgtacggaactaacgaccgacccggaacgggactaaccttacttaattttaaacgtaaacgttaaaccaaaaactaaaaccctaaacgacccgtttacccgtaccgggtacccctacggaccccgttaacgttcctacggtacccggtcccgtaccgtttaccggggtacgggaaccaacggtcgtccgtacccctagacctacgtgttaccggttgggtcgtacggacgtacgtcgggtaacgacgggtaccggacgtagttacctaacgttacgttaaccgtcgttaacctttcgttaacgttttcggttcgggtcggtcgtacggtttgtacgtaccggttgggttacgggaacggtccggtaaancggtaccttacggtacccgttagttaccgacccgaaccgtcccgggaagttcccccgtaccggaccccgttccgtaaccgttacttccccttacccgttacccctcccttcgtacccgg

SEQ ID NO: 133682 - DNA, 735 bp, Homo sapiens
  misc_feature: GYAE6OF01E14ML.17.33.C11.1.454.CMB.1.raw
  modified_base (237)..(237): a, c, t, g, unknown or other
  misc_feature (237)..(237): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
tcagcgtagactagcacgaccggtgctcgatttagagtgagctcgttgggtttggggtctggcgccaggggtcccttccaatatcagcaccatggcctggactcctctcttctgttcctcctcacttgctgcccagggtccaattctcagactgtggtgactcaggacgccctcactgactgtcgtcccgaggaggacagtcactctcacctgtcgtcttaccaactacgtgggacncacgtacaccgtagtcgtaccttacctactaccctaaacgtcggttaccagacaacgaaaccgtggaacaacgccaccgacggcactctattatacgtaacaaacaacaacactaccgcgacccncgacctatcncgacgcctccgtcgtagggacaagctcnccgtacgactcgtgtcgtgggtacgtcgacgtacgtccgtaggaacgggtacggacggtcgtacgtaaccgttacgtaccgtccggttaacccttaccgttaccgttttacgggttttgggttcgggttacgttcgttacggttcgtaccggtttacggttccgggggaacccggtaacgggtaaccgacggtccgttaacggttacccgttaacggtttaaccgtccggaacccggttacccggtaaccgggtaccccgttacccccggtacccccgttaccgggttacccttacccgtttaccccgtttccccggttccccccgtttcccccg

SEQ ID NO: 133683 - DNA, 774 bp, Homo sapiens
  misc_feature: GYAE6OF01BRFNG.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctcgcccgagggtccaattctacagactgtggtagactcgaggacgccctcactgactgtcgtacccgagggacggacagtcactctacctactgtcgcttaccactacgtacggactacgacgtccaacgtacgtcgtaccttaactactaaccgtaaacgttcggttaccaacgaacgaaaccgaaccgtacggaacctaaccgacccgtaacccggacggtaacctaacgttacgtttaaactttaacgtaaacgtaaaacctaaaaaccctaaaccgtaaaaccttacccgttacccgtaacccggtacccccgtacggtacccgttaacttccgtaccggaccggttccccttaccccgttacggggtaccgggtaactaaccggtccgtccgtacccgtacgaccgttacgtacgtcgggttgtacgcgccacgtcgagacgggaacgcggtactacgtacttacgtacgtactctttacgtcgttacggttgtaggtctagttgtcgtacgtcgggtacgaacgggtactacggcgttacgtccgtacggttactacggttaccgaccgtaccggtccgccgttaccccgcccggtttacctacccgtacccgttcgttaccccgtccccgttacccgg

SEQ ID NO: 133684 - DNA, 717 bp, Homo sapiens
  misc_feature: GYAE6OF01DU4W7.17.33.C11.1.454.CMB.1.raw
tcagcgtagactagcacgaccggtgctcgatttagagtgagctcgttgggtttggggctggcgccaggggtcccttcaatatcagcaccatggcctggactcctctctttctgttcctcctcacttgctgcccagggtccaattctcagactgtggtgactcaggacgccctcactgactgtcgtcccagggagggacagtcactctcaccttgtcgtccttaccaacgtacgtaggacgtcacgtaccaccgtaggtcgtactttactactacctaaacgttcggttaccagacaacgtaaaccgtggaacaacgccaaccgaggaccactactaatttaacgtaacgtaacaaaaccgaacaaacctacctacccgtacggaacccctcggacccgtacttccacgtacggtcccttcccggttaccgggtacggggaacaacggtcgtccgtaccgtacgactacgtcggttcggtaggtcgacgacgaccggtccgtaggaaccgggtacggtcggtacgtacggtaacttaccgtttacgtaccgtacccttaaccgtttccgtttaacgggtttcgggttcggtgttcgtcggttacgtacggttcggtaccggggacgggaaccgtacgacgtccgtacggtaccgttagtaccggtcgaccgaccgtcgccgtcccgtccgtcgtactccttccgtccgtcccctcccg

SEQ ID NO: 133685 - DNA, 896 bp, Homo sapiens
  misc_feature: GYAE6OF01BV8U9.17.33.C11.1.454.CMB.1.raw
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactggtggtgactcaggacgccctcactgactgtcgtccccgagggagggacagtcactctcaccttgtcgtccttaccaactacgtgggacgacctacggttaccaacccgtaggttcgtacctttaacctaactaacccgtaaaacgtttcgggttacccaacggaccgtaaaacggtaaaaacccgtacgggaaaccgaaacgaccccgaaaccccggacggggtaccctaaccgttaacttaaacttttaaacgtaaacggtaaaaaccaaaaacccaaaaacctaaaaccgtacccgtacccggttaacccgggtaaccccctaccggtaccccggttactttacccgtaccggtaaccggtcccgttacccccggtttaccggggttaacggggggaacctaaaaccgccggtaacccgtacccgtaacggtaaccctacggtttacggtcggttcgggttcgtaccgtacggtaaccgtccggtagggaacgggtacggtaccgggttacgtacgtaaccgtttaacgtttaccgtaccgttacccgtttaaccgtttacggtttaacggttttcgggtcggttacgtcgtttcggtacttcggttacggtcggggaacgggtacgaccgtacgacgtcgtacgttacgtacgacctacggaccgtaccggtccctcccggtacccgtccgtccttacccggtcccgttacccgttccccgtcccgttccgtttacccgg

SEQ ID NO: 133686 - DNA, 665 bp, Homo sapiens
  misc_feature: GYAE6OF01A1B97.17.33.C11.1.454.CMB.1.raw
tcagcgtagactagcacgaccggtgctcgatttagagtgagctcgttgggttggggctggcgccaggggtcccttccaatatcagcaccatggcctggactcctctctttctgttcctcctcacttgctgcccagggtccaattctcagactgtggtgactcaggacgccctcactgactcgtcgtccccgaggacgggacagtcactctacacctgtgtccttaccaacacgtaggacgacacgtacacctagtcgtacttaactactacctaaacgttcggttaccagacaacgtaaaccgtgaactaacgaccgtacccgacggactactactaacgtttaacaacgtaacaaacaaacctaactacctccgtaccgacccgtcgtaccgtacttacctacgacgcctcccgtacgtacgggacaacgtctcgcctacgtactacgtcgtacgtggtacgtcgacgtacgtcggtacggacggtacggacgtacgtacggtaactacgttaccgtacgtacccttacttccgttacgtttgggtcgttacgtctcgttacggacgttacggtacggacgggaacgtacgacgtcgtacgtaccgtataacgcgtacacgtacgccctcgcccgtccgtctacccgtcttcccgtcccgtccg

SEQ ID NO: 133687 - DNA, 758 bp, Homo sapiens
  misc_feature: GYAE6OF01BJRAN.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttccctcctcacttgctgcccagggtccaattctcagactgtggtgactcgaggacgcccctcactgacctgtcggtccccgagggacgggacagtccactctcacctgtgccttaccaacactggagccagtaccaccagtgtccttaactactacctaaacgtcggtaccagacaacgaaccgtggaacaacgccaccgacggcactactattaagaacgtaaacaaaccaaaccaaacctacctaccccgtaccggtacccccgtacggaccccgttacttaccgtaccgtacggtcccttaccccgttccgggttacggggaccgtaaacggccgtcccgacccgtacgaaccgtccttggtacggttggtgtaccgccgtacggtccgtacgggaacgggacggtacgggtacgtacgtactttaaccgttccgtccgtaaccgtttaccttaccgtttcggtttgggtaccgtcgtcggttgtcgtacgttaccgggttccgggtacggggtaaccgggtacgaacggttcgtaccggttaccgttaaccgttacgtccgtaaccggtaccggaccggtcccgtcccggtacccccgtccggtaccgtacccgttcccgttccccgtcccctaccccg

SEQ ID NO: 133688 - DNA, 960 bp, Homo sapiens
  misc_feature: GYAE6OF01CUF81.17.33.C11.1.454.CMB.1.raw
tcagcgtagactagcacgaccggtgctcgatttagagtgagctcggttggggtttggggggcgccgaggggtcccttccaatatcagcaccagtggcctggactcctcttctttctgttcctcctcacttgctcgacccgagggtacctaattctcagacgtggtggtcgactcgaggacgccctcacgtgactgtccgtacccgagggacggactacgtacacctctaccaccgttcgtacgtccttaacccaaacgacgtagggacgaccgtacgtaccgaaccgtggtactacctttaacctactaacctaaacggttcggttaccaagtaccgaaaccgtaaaaccggaggaaccgaacgacccgtaaccggtaacgggacctaaccttacttaaacgttttaacgaaacgtaaaaaccaaaacgaaaacctaaaacccgtcccgtaccgtaccccgaaccccgttccggtaacccgttacttaccgaaccgtacccggtaccccgttcccggttaccggggttaaaccgggggaacctaaaccggtccgttacccgaccccgtacgtaaccctagtttaccgggtcgttggtaccggtacaccggtacgtcggtaaccgggacgggtaaccggtcgggtaacctttacgtaaactttaccgttaccgtttacttaaccccgtttacgtttaccccgttttgggtttcgggttcggtacgtttcccgttggttaccgttacgggttaccggtacgggggtaaccgggtaaaccggggtaacccttacgggtaccgggttaaccgttaacccggtttacgtaaccgtacgggtaacccgggaccgttacccgggttacccggtcccccggttaccccgttccggttacccccgttacccggttcccccgttttacccgggttacccccccctccgtttaccccggtttaaccccggg

SEQ ID NO: 133689 - DNA, 822 bp, Homo sapiens
  misc_feature: GYAE6OF01DKU21.17.33.C11.1.454.CMB.1.raw
  modified_base (802)..(802): a, c, t, g, unknown or other
  misc_feature (802)..(802): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcgaggagcccctcactggtactggtcgtccccagggagggactagtcactcctcacctgtcgccttccaaacacgtggagcacgtccaaccagtcgtacttaactactaccaaacgtcgttacccgagacaacggtaaaccgtacggaaccaacggcccaaccgacggaacctcctacttaatttaaataacgtaaccaaaaacaaaccgaaaactacccttaccggtacccggtaccccgtcgaaccccgttactccgtcaaccggtcccttcccggttaccgggtcggggtaacaaccggtcctcgtaccctaacgtacctagtcgttacgtcgggtcggtacgaccgaccgtcggtagggaaccggggtaccgtacggggacttaacgtaccttaagttaccgtccgttccgttaacgttaccggtttacggttttgggtaccggtttcggtacgtttcggtaacgttcggtttacccgggtacgggggtacgggaaccggtaacctccggtttacgtacggggtttaaaccccttacgtaaccggtccgaacccggtaaccggtaccggtcccggttacccccggtccccgtttcgaccccgtttacccggtttaccctccccggttttaaccccccnccccgtttacccgttacccg

SEQ ID NO: 133690 - DNA, 868 bp, Homo sapiens
  misc_feature: GYAE6OF01DRS34.17.33.C11.1.454.CMB.1.raw
  modified_base (238)..(238): a, c, t, g, unknown or other
  misc_feature (238)..(238): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggacgccctcactgactgtcgtccccgagggaggacagtcactcctcaccgtgtgccttaccaacacgtggancagtccacctagtcgtaccttactaactaccctaaacgtcggttaccaaggaccaaacgtaaaccgtggaaccaaacgaccgaacccgacggggtaccacttactaatttaataacgtaaaccaaaaccaaacctaaaccgacctaccgtacccggtaacccctcgaccccgtacttccgtaccgtacgtccccttcccgttaccggttacgggggaccaaacggtccgtaccgtccccgtagaccgtacgttcggttcgttgggttcgtcggtacgtccggtaccgtacgggaacgggtaccggagggtacctaggttaaccctttagttaaccgttccgtacccttacgttacccgttttacggtttcgggttcgggttcggttaccgttcggttaccggtttacggttttacggggttacccggggtacgggggtaaaccgggtacccggtaaacggtacccggttaaccgggttaccccggttttaaccggtttaaaccgttaccggaaaccccgggttacccggtaaccgggttaccccggttcccccggtaaccccccgtttcccgggttaaccccttacccggttttaccccttcccccgtttaaccccccgttaaccccccg

SEQ ID NO: 133691 - DNA, 897 bp, Homo sapiens
  misc_feature: GYAE6OF01DLQSI.17.33.C11.1.454.CMB.1.raw
  modified_base (239)..(239): a, c, t, g, unknown or other
  misc_feature (239)..(239): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactcgactgtcgtccccgagggaggacagtcacctctcacctgtcgtcttaccaactacgtgggacnccgtacgtaccacccgtaggtacgtacctttaaccttacgttacccgaaaacgtttccggggttaccaacggtaccgaaaacggtaaaacccgtacggaaaacccgaaaccggaccccgtaacccccggaaggggtaccttaaccgttaccgtttaaagttttttaaacggtaaaaccggttaaaaccctaaaaaacgaaaccctaaaaacccgtacccgttaaccccggttacccgggtaaaccccccgtccggtaaccccggttaacctttaccgtaccgtaacggtcccctttaccccggttaccgggtttccggggggaaacctaaacggtccctttaccgacccgtttacggaacctaccgttcggttacggttacgggttcgaccggtaccgtacggtacccggttagggaaccgggtacgggacggttctaacgggtaacctttaaagttcccgttacgtacccgtttaccttaaccgtttcggttttcgggtagtccgttcgtaaggttcgttacggttcggtacggggcgggtaagtaacctgtcggtacggtacccttagtacgtccgcgaacccggtagtcccgtacccgccccgttagtacccgtaccttcccggttaacccgtcccgttcccctcgttaacccgg

SEQ ID NO: 133692 - DNA, 777 bp, Homo sapiens
  misc_feature: GYAE6OF01EV6XI.17.33.C11.1.454.CMB.1.raw
  modified_base (242)..(242): a, c, t, g, unknown or other
  misc_feature (242)..(242): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctcgcccagggtccaattctcagactgtggtgactcgaggacgccctcactgactgtcgtcccgagggaggacacgtcactctcaccgtgtcgtccttaccgaactagtagganccgagtccacctaggttgtacttactactacctaaacgttcggttaccacgaccaaacgtaaaccaggaacaacgaccgacccgacggactacctactaattttaacgtaaacgtaaacgaaaaccaaaaccgaaacctaccttaccgtacccggacccgttcgaccccttagtacctacggaccgtcccgttcccgttaccgggttacggggacctaacgtccgtaccgtacccgtacggtaacctaacggttggtttaaccggttcgggttacgccgtaccgtaccgttccggaacgggacgggaccgagggtcttaaccgtattacgttacgtacgttccctttaacgttctttacgggtttcggtggttactcgtaggttacgtcgttaccggttcgggacgggtaacgtacgtacgtacgtaaccgttaccgtagttaaccggtcggtaccggaaccccgtacggtcccggtaccccggtacccggttccgtaccgttaccgtttcccgttccccgtcccccttaccccg

SEQ ID NO: 133693 - DNA, 714 bp, Homo sapiens
  misc_feature: GYAE6OF01D3IRO.17.33.C11.1.454.CMB.1.raw
  modified_base (218)..(218): a, c, t, g, unknown or other
  misc_feature (218)..(218): n is a, c, g, or t
tcagcgtagactagcacgaccggtgctcgatttagagtgagctcgttggggtttggggggcgccaggggtcccttcaatatcagcaccatggcctggactcctctctttctgttcctcctcacttgctgcccagggtccaattctcagactgtggtgactcaggacgccctcactgacttgtcgtccccagggagggacagtcactctcaccttgtanccttacaacacgtggagcacgtcaccagtcgacttactactaccgtaaactcggttaccagacaacgaaaccgtcgaacaagaccaccgaggcactctattaagtacgaacaaaacaacaaacaccgtccgacggtaccctacgacccgtacttcacgacggcctacccgtaccggtaggggaacaacggtctccgaccgtacgaacctctggtcgttggtacgtgacgacgtccgtaggtacggaacggtacgggtctacgtaacgttagttaccgtacgtaccttaccgtttaccgtttagtttcgggttcgtaccgttgtgttaccgtattacgggttccggggaacggtaacgggaccgaaaggtccgttaaccggtaccgtttaacgtaccgtaaccgaaccgtacccgggaaagttccccggtacccgtccccggttccggtacccgtacgttcccggttaccccgttccccgtaccccttccttcccgg

SEQ ID NO: 133694 - DNA, 786 bp, Homo sapiens
  misc_feature: GYAE6OF01AMBDZ.17.33.C11.1.454.CMB.1.raw
  modified_base (158)..(158): a, c, t, g, unknown or other
  misc_feature (158)..(158): n is a, c, g, or t
  modified_base (173)..(173): a, c, t, g, unknown or other
  misc_feature (173)..(173): n is a, c, g, or t
tcagcgtagactagcacgaccggtgctcgatttagagtgagctcggttggggtttggggggcgccaggggtcccttccaatatcagcaccatggcctggactcctctctttctgttcctctcacttgctgcccagggtccaattctcagctggtggtnactcgaggagccctnactgactgtccgtcccaggtacggcagtcacgtcctacaccgttgtcgtaccttaccaaactacggtggaacgtccgtaacgttaccgaccgtagttcgttacctttaactacgttaacccaaccggttcggttaccgaagaccgtaaacgtaaaccgtcggaacaaccgaccgaaccgacggtactaacttacgttaactttaacgtaacgttaacaaaaacctacgtaaaacctcctaccgtaccggtacccctcgtacccgtacttccgtaccgtccgtacgtccccgtacgggttacgggaacgtaaaccgtccgacgttacccgtagtcgtaccgtcgggttcgttcgggtaacttcggaccgtaccgtaccggtacggtaccgggaacgtcggtacgtacgttaactcgttaccggtacttaccgttacgtcgtttacgttggttcgttagtacgtcgttctacggttacgtacgggttacggaacgttacgacgttccgtacggttaccgttacgtaccgtacgtaccggtaccgacgggtctccccgggtacccgtcgtaacccgtccgttacccgtcccgttacccgttccctcccgttacccg

SEQ ID NO: 133695 - DNA, 788 bp, Homo sapiens
  misc_feature: GYAE6OF01AV7PG.17.33.C11.1.454.CMB.1.raw
  modified_base (145)..(145): a, c, t, g, unknown or other
  misc_feature (145)..(145): n is a, c, g, or t
  modified_base (248)..(248): a, c, t, g, unknown or other
  misc_feature (248)..(248): n is a, c, g, or t
  modified_base (669)..(669): a, c, t, g, unknown or other
  misc_feature (669)..(669): n is a, c, g, or t
tcagcgtagactagcacgaccggtgctcgatttagagtgagctcgttgggtttgggggcgccgaggggtcccttccaatatcagcaccatggcctggactcctctctttctgttcctcctcacttgctgcccaggtccaattctnagactgtggtgactcgaggacgccctcactgactgtcgtcccgaggagggacagtcacctctacaccttgtcgtccttaccaacactggacacacgtcaaccnggttactacttaacctactaccgtaaacttcggttacccaggtaccaaggaaaacccgttggaaacaaccggacccaaccggacgggtcctaaccttcgttaaacttttaagtaacgtaaaccaaaaacctaaaccggaaacctacctacccgtaacccgggtaccccctaccgggttacccctaagtttcccgtacgtaaccggttccccttaccccggtttaccggggtaacgggggtaacctaaacggtcccgtaacccggttcccgacgtaccgtacgttcggttacgtggtcgtccgacgtacgcgtacggacgacgtgacgtacgtaattacgttctccgacctttatccgttagttggttcgacgttcgtggttcgttacgtcggtaccgggtacggaacggtacaaccgggtntaaccggtgttaacctaaacggtccgtaaccggacccgtagggttccccgtacccgcccgttaccgcctttacccgttacggttacccccttaaccccgttcccgttcccggtttaccg

SEQ ID NO: 133696 - DNA, 699 bp, Homo sapiens
  misc_feature: GYAE6OF01BX8EL.17.33.C11.1.454.CMB.1.raw
  modified_base (250)..(250): a, c, t, g, unknown or other
  misc_feature (250)..(250): n is a, c, g, or t
tcagcgtagactagcacgaccggtgctcgatttagagtgagctcgttgggtttggggctggcgccaggggtcccttcaatatcagcgaccatggcctggactcctctctttctgttcctcctcactttgctcgtcccagggtccaattctcagactgtggtgactcgaggacgcccctcactcgactcgtcgtaccccgagggagggaccagtcactctccaccgtgtcgtccttaccaacacgtggacnctacgtcaccgtagtcgtacttactacgtacctaacgttcgttaccacgacgaacgaacgtacgacgaacgccaccgaggcactactatttaatacgtaacaaacaacaacctacctccgtaccgtacccctcgaccccgtactaccacgtaccgtccttcccggtacggtcggggacctaacgtccgtaccgtcccgtacgttacgacgttcggttccgtagggtcgtcgacgtacgtcgtacggacggtacggacggtcctagttaacgtacgttacctacgtccttacgttcgttacggtttggtcggtgtcgttcggtcgttaccgttcggccggggtacggacggaccgagtccggacgttacccgttaggtacgtccgtacccgacggtcgtcccgtcccgtcccgtcgtacctaccgtacccgttcccgtccccgttacccg

SEQ ID NO: 133697 - DNA, 804 bp, Homo sapiens
  misc_feature: GYAE6OF01E0HCG.17.33.C11.1.454.CMB.1.raw
tcagcgtagactagcacgaccggtgctcgatttagagtgagctcgttgggtttggggctggcgccagggggtcccttccaatatcagcaccatggcctggactcctctctttctgttcctcctcacttgctgcccagggtccaattctcagactgtggtgactcaggacgccctcactgtactgtcgtccccgaggagggacagtcactctcacctgtgcttacaacacgtggacgacacgtccacgtagtcgtcttaactaactacctaaacttcggttaccaacgacgtaacgtaaacccgtagggaaccaaacgacccgaaccccggtaagggacctaacttacgttaaacttttagtaaacgtaaaaccaaaaaccaaaacctaaacctaacccttacccgtaccgggtaacccccgtaccggtaccccgttaaccttccgtaccgtaccggttaccccttccccgttcccggggttaacgggggactaaaacggtccgtaccggtccctacggtaacctcgtttacggtcggttacgggtcgttacgacgacggtaccggtacggaacggggtacgacgggtaactcggttaaaccttacgttaccgtaccgttcctttaccgttcgtttacggtttcggtcggttacgtcgttagtcgtacggttcggtaccggggtacgggaacggtacacggtacgtcggtaaaccgttacggtaaccgtccgtacgggtacccgcggtcccgtacccggtccccgtcggttaccctaccgttccttccccggttaccctccccgg

SEQ ID NO: 133698 - DNA, 737 bp, Homo sapiens
  misc_feature: GYAE6OF01B3XKB.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccgaggaggacagtcactctcacctgtcgccttccaactacgtggagcagtccaccagtcgtacttaactacttaccaaaacgttcggttaccagaccaacggaaaaccgtaggaacaacggccaacccgacgggacctaactactaatttactaaacgtaaaccaaaacgaaacctaaaacctacctacccgtacgggtacccccgtacgacccgtacttaccgtaccgtacggtcctacccgtcccggttacgggggaccaaacggtcctccggccctacgaaccgtaccgttcgttcgtcgggttacgtcgacgtacgtcgtaggacggacggacggtctagtacgttacttacgtactaccgttacttacgttacggtttcggtcgggtcgtcgttcgttcggtcgttaacgttccgggacgggtaacggccgaaacggttcctaccggtaccggttattaaccggactaccggtacccgaacggtcccttcccggccccccgttacgtaccctacccgtttccgttccggttcccccggtacccg

SEQ ID NO: 133699 - DNA, 795 bp, Homo sapiens
  misc_feature: GYAE6OF01CBIVB.17.33.C11.1.454.CMB.1.raw
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (302)..(302): a, c, t, g, unknown or other
  misc_feature (302)..(302): n is a, c, g, or t
tcagcgtagactagcacgaccggtgctcgatttagagtgagctcgttgggttggggctggcgccaggggtcccttccaatatcagcaccatggcctggactcctctctttctgttcctcctcacttgctcgcccgagggtccaattctcagactgtggtgactcgaggacgccctacactgactgtacgtcccagggagggacncgtcactctcgactgtctcttacacacgtaggancngtcaccgaggtctcttaactctaacctaacgtcggttaccaacgacgtaaacgtaaacccgnggaaccaaacgcccgaaacccggagggaccttaaccgtcttaagttttaaactaaaccggtaaaaccaaaaaccctaaaacctaaacctacccggtaccgttaacccgggtaccccctacgggtaccccgttaacttccgaacccgtacggttccccttcccggtaccggggttacggggaaactaacgtcccgtaaccggtcccgtaggtaaaccttcttcgggtcgtagggttcggacgacctcggcgttacgggaacgggtgaacggtacgtcggttaatacttacggtctacccgttgttaacccgtttggttccggttaggttctcgttcggttactacgggtttacgtcccggggtaacgggtaccggtacgtacgggtcttaaccgggtaccgttaacggttacggaccgacccggtaccggtaccgtcccggtaccccgttcccgtacgttcccaccgtttaccccggtccctaccccgttcccg

SEQ ID NO: 133700 - DNA, 923 bp, Homo sapiens
  misc_feature: GYAE6OF01BA5NF.17.33.C11.1.454.CMB.1.raw
  modified_base (205)..(205): a, c, t, g, unknown or other
  misc_feature (205)..(205): n is a, c, g, or t
  modified_base (254)..(254): a, c, t, g, unknown or other
  misc_feature (254)..(254): n is a, c, g, or t
tcagcgtagactagcacgaccggtgctcgatttagagtgagctcgttgggtttggggctggcgccaggggtcccttccaatatcagcaccatggcctggactcctctctttctgttccctcctcacttgctcgtccagggtccaattctcagactgtcggtgactcgaggacgccctcactgactgtccgtcccgagggaggacngtccactcctaccgaccgttgtcgtcccttacccaacgtacgtgggacnctaacgtccaaccgtaggtcacctttaactaccgtaacccgtaaacgttcggttacccaagacccaacggtaaaccgtcggaaacctacgacccgacccggacggtacctaaccttacgtaactttaagtaaaccgtaaaccgaaaacctaaaccaaccgtaccgtacccgtaccggtacccccgtacggtaccccgtaacttccgtacgaacccggtccccttcccggttacccggggttaacggggaaccaaaccgtcgtccggtacccctacggtaactaccgttggttcggtagttaaccggcgacccgtaacggtcccggaagggttaaccgggacgtaacggggtctaacggttaccttaacgttcccgtaaccgtaccctttacgttaccgttttagggtttgggtaccgttaccgttggttacccggttaacccgtgggtttaaccccggggtaccgggggaaccggggttaaacccgggaacttaccggccccgggtttaaccgggttaccccgtttaaagggttaaaccgccccgggttaaaaccccgggacccccggttaacgtccccccggggtttttcccccgtaaacccccggttttcggggaccccttacccgttttcccgggttaccccccgggtttcccctttacccccccg

SEQ ID NO: 133701 - DNA, 898 bp, Homo sapiens
  misc_feature: GYAE6OF01B0R1E.17.33.C11.1.454.CMB.1.raw
  modified_base (219)..(219): a, c, t, g, unknown or other
  misc_feature (219)..(219): n is a, c, g, or t
tcagcgtagactagcacgaccggtgctcgatttagagtgagctcgttgggtttgggggggcgccaggggtcccttccaatattcagcaccgatggcctggactcctctctttcgtgttcctcctcacttgctgcccagggtccaattctcagactgtggtgactcgaggacgccctcactgactgtgtccccaggagggacagtcactctcacctgtcncttaccaacacgtggacgcacgtccaccgagtcgtacttactataccaaacgttcggttaccaacgaccaacgaaaacccgtacggaacaacgacccaacccgacgggcctaaccgttacctaattttaacgtaaacgttaaccaaaaacaaaccaaacctacctacccgtaccggacccccttacgaccccgtacttcctccgaaccggtcccttaccccggttcccggttacggggggaaccctaaacggtccgtacccggtaccccgtacggtaacccgtacggttccgttccggttcggggttacggtacgggtaccgtaaccggtcccggttaacgggaacggggtaaccggacggggtacccgttacggtaaccctttagtttaacccgttaccggtacccgtttaccgtttaccgttttaccggttttcggggtttacggttcggttcggtttcggttaccggttacggtttaccgggtttacgggggaacggggtaacgggaaccgtaaccggtacgttaaccggtacccggtttacgttaaccgggtacccgtaccggaccccggtaacggttccccggtaccccggttcccccggttcccggttaacccgttcccgttacccgtttacccccgttaccccccttacccccgtttccccttaaccccggg

SEQ ID NO: 133702 - DNA, 656 bp, Homo sapiens
  misc_feature: GYAE6OF01ES960.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtcgcttccaacactggagcagtcaccagtgcttactataccaaacgttcggttccagacaacgaaacctggaacaagccacccagggcactactaatttaatagtaacaaaacaaacaaaccactcctcggacccctgcccgattctcgacgtcctccctccggttcggggacgaaacgcgtacgccctcgacactcgtcgtggtgtcgctacgcgtacggacggacggacggacgtagtacttattacgtacgtaccttacttaccgttacgttttacggttggtcggtcgttggtacgtcgttaagttccgggtacgggtaacgggaccgaacggtcgtaccgtaccgttacgtttaacggtccgacggtaaccggacggtccgtcccggtaccccccgttcggtacccgtaccttccgttcccggttcccccgttcccccg

SEQ ID NO: 133703 - DNA, 989 bp, Homo sapiens
  misc_feature: GYAE6OF01E228T.17.33.C11.1.454.CMB.1.raw
tcagcgtagactagcacgaccggtgctcgatttagagtgagctcgttgggtttggggggcgccgaggggtcccttccaatatcagcaccatggcctggacttcctcttctttctgttccctcctctaccttgctcggcccgtagggtcctaattcctcagtaccgtggtcggtcgacctcgagggacctcccttcaactcgtaccgttcggtccgtaccccggaagggtaacgggaactacggtcctacccgttacctacctaccgttggttaccggtccttaaccgaaacgtaccggtaggtacgccgttaacgcccgtaaccgttaaggtccgttacctttaaccgtaaccgttaacccgtaaaccgtttcggttacccgaggtaaccgaaaccgtaaaccggtaacggtaacccaacggaacccgacccggtaacgggcctaaaccttacctaactttaacgttaaccgaaaccaaaactaaaccgaaacctacccgaccgtacccgtaccccgttaccgtacccgtacgtttccgaccgtccggtccccttacggttaccccgggttacgggtacgtaaccggtccgacccgtaccgacgtaccgttaccgtttcggtcggttaggtcgttacgccgtaccgtcgtacgacgggacggacggtctaacggtacgttaccttacgtaccgttaccgttcgtttacccggtttacggttttaccggttcggttcgtacccgggtttagtcggttttaacggttaccggggttacccggggtaaccgggttaaccggggtaaccgtaccgggttttacccggtaccggtttaaaccggtttacccgggtttaaaccgttcccgggtaaccgggtaacccccgtacggggtaacccccggtttccccggtccccgtttacccggtaacccgtcccggtttaccccggttacccccgtttcccccgtttacccgttcccgttaccccggg

SEQ ID NO: 133704 - DNA, 788 bp, Homo sapiens
  misc_feature: GYAE6OF01A3JC5.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactggtggtgactcgaggacgccctcactgactggtcgtccccgagggaggacagtcacctctaccaccgttgtccgtaccttaccaacgtacgtacgggagtccgacgtaccaccgtaggtctacttactacgtaccgtaaacgttcggttaccaagaccgtaaacggtaaccgtagggaaccaacgacccgaaccggacgggtacctaacttacttaagtttaactaacggtaaacaaaacctaaaactaaacctaccgttccgtaacccggacccctccgtaccgtacgttacctcggaccgtcccttacccgtccgggttacgggaacctacgcgtccgacctcgactacgtcgtcgtaggttcggacgtccgtacgtcgtacgggaacggtacggtcgtacgttacggtacttacgtttaccgccgttaaccgtttaactccggtttaacggttttcggtcggttacgtccgtttggtccgtttaggttaccggtcgggggaaccgggtacggtaactaccggtaccgttaccggtaccgttattaccgggtaccacggacccggttaacgcccgtacccggtcccgttcgacccttaccggttccctacccggttcccgtccctcggttacccg

SEQ ID NO: 133705 - DNA, 755 bp, Homo sapiens
  misc_feature: GYAE6OF01AHT86.17.33.C11.1.454.CMB.1.raw
tcagcgtagactagcacgaccggtgctcgatttagagtgagctcgttgggtttggggctggcgccaggggtcccttccaatatcagcaccatggcctggactcctctcttctgttccctctcacttgctcgccgaggtccaattctcagacgtgtggtcgactcgaggacgccctacacgtgacttgtccgtacccgagggagggacacgtccacctcctcgaccgttggactccttaccgaacctacggtggtaacggctacgacctaaccgtagtcgtacctttaaccgtacttaacccgtaaacgttccggttaccaagacgaaacgtaaccgtacggaacgtaccacctaccggaaggaccacttgtaattacgtaacaacaaactaacaacctacggtacctccgtaccctacgacgttctactcgacgtcccttacccgtgggtaaccgggacaaacgtccgtacacccggttacaaccgttcgtcgtttacggtcgggtaccgttacggaccctaaccgtccgttaacgggtaccgggaacgtaccgggacgttaccgtaacgtttaccgttacctaccggtaccctttacgtacggtttcgttaaccggggtcttaggtccgtgtacggtcgttcggtaccgggacacgggactaacgccgtagtaacccgtagtaccgcggtaaccaccgtcgtcccccgtcggtccccctcggtaacctcccgttccaccgtttccccgtaaccc

SEQ ID NO: 133706 - DNA, 820 bp, Homo sapiens
  misc_feature: GYAE6OF01EJAKS.17.33.C11.1.454.CMB.1.raw
  modified_base (171)..(171): a, c, t, g, unknown or other
  misc_feature (171)..(171): n is a, c, g, or t
  modified_base (176)..(176): a, c, t, g, unknown or other
  misc_feature (176)..(176): n is a, c, g, or t
  modified_base (233)..(233): a, c, t, g, unknown or other
  misc_feature (233)..(233): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggttccaattctcagactgtggtgactcagggacnccctnactgactgtcgtcccaggagggacagtcactctcacctgtgccttaccaacatgganctagtccaccaggttctacttaactactacctaaacgtcggttaccagcaaacgaaacctggaacaacgaccaacccgaggacactacgtaatttaagtaactaacaaaacaacgtaaaactacccgttaccgtaccgggaacccccttccgaccggtaactttacctacgtaaccggtcccgttaccccgtccgggtttaacggggggaaccctaaaacggcccgttaacggccccgttaacggaacccttacgttcggttaccggtgggtttaccggcgtaccgtaccggccggtacggaacgggacggtaaccgtcgttacgtaaaccgtttacgttaccgttaccggtaccctttaccgttaccgtttacgtttttaccggggagtttcgtccggtttacggtacggttccgttaacgggtttccggggaaaccgggttacggggaacctaaacgggtccgtaccggtaccgttaacgttaaccggtccgaaacccggtacccggaacggttaccccgttcccgggtccccccgttacgggtaccctacccgtttacccgtccccgtcccccttaacccccgg

SEQ ID NO: 133707 - DNA, 687 bp, Homo sapiens
  misc_feature: GYAE6OF01B0RCK.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtgtccccaggaggacacgtcactctcacctgtcgcttaccaacacgtggacgcacgtcaccgtagtcgccttaactactacctaaacgtcggttaccagccaacgaaaaccctggaaccaagccacccgagggcactcgtaatttataacgtaaccaaacaaacaacacctccgtcgacccctgcccgtatcctacgacggtcctcctacggtcgggactaacgctcgaccgtacacgtacgtgtacgtcggtcgtcgacgtacgtaccgtacggaacggacggacggtcgtaacgtaacttacgttacgtaccgtaccttaccgttacgtttacgtttgggtcggttcgtcgttagtcggtactttaggttccggggacggtacgggaacgtacgtcgtaccggtaccgttacgtaaacgtcccgaacgaccgtaacgtcccgtcgtacccccggttcgtcccgtaccttccgttccccgtacccccgtcccgttcccgttacccg

SEQ ID NO: 133708 - DNA, 678 bp, Homo sapiens
  misc_feature: GYAE6OF01AZZCS.17.33.C11.1.454.CMB.1.raw
  modified_base (596)..(596): a, c, t, g, unknown or other
  misc_feature (596)..(596): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtcgcttccaacacgtggagcagtcaccgagtgcttactactaccaaacgtcggttacagcaacgaaacctggaacaacgccaccgaggccactctatttataacgtaacaaaacaaacaaaccactccgaccggtacccctcgacccgtacttcctacgacgtccttcccgtaccggttacgggggaacaaacggtcgtccgtaccctagtaccgtacgtcgttacgtggtcgttcggacgtaccgtcgtacggacgggtacggacggtactacgtaacttacgttacgtccgtaccttaacgttcttacggtttggtagtcgtcgtggtcgtacgttcgtacggacgggtacgtacgacgtccgtacgtaccttacgttaancgtaccggtaccgacggtacctcccggccccgttcgtcccgtaccgttccgttcccgttccccgtcccgttcccgttacccg

SEQ ID NO: 133709 - DNA, 857 bp, Homo sapiens
  misc_feature: GYAE6OF01EDAVO.17.33.C11.1.454.CMB.1.raw
  modified_base (172)..(172): a, c, t, g, unknown or other
  misc_feature (172)..(172): n is a, c, g, or t
tcagcgtagactagcacgaccggtgctcgatttagagtgagctcgttggggtttgggggggcgccaggggtcccttccaatatcagcaccatggcctggactcctctctttctgttcctcctcacttgctgcccagggtccaattctcagactggtggtcgactcgaggacnccctcactgtactcgtcgtaccccgagggagggacacgtcactctaccaccgtgtcgtccttaccaaccgtacgtagggacgacctacgtaccaaccgtagtcgtacctttaactaactaacctaaacgttcgttaccagaccgaaacgtaaccgtaggaaccaacgacccaccggacggtacctaccttattaatttaataacgtaaaaccaaaaccaaacaaacctacctcccgtaccggtacccctcgtaccccgttaatccgtaccgaccggtcccttacccggttaccgggtaacgggggaaccaaccggtccttacccggtaccccgtagtacccgtacgttacggttcggtgggttacgtcggaccgtacggtaccggtagggaacgggtacggacggttacgtacgtaaccgtttacgttaccgtcccggttaacctttaccgtttaccggttttacggtttcgggtacggttcgttaccgttgttcggtaccggttacgggtacccgggggacgggtaaaccgggtacctaaggtcccggtaacggttaccctacgttaaccggacccgtacccggtaaccgttacccggtacccggtccccccgtaccccggttaccggtaccttcccggttaccccgttaccccgtttacccccgtccccgttccgttacccgg

SEQ ID NO: 133710 - DNA, 685 bp, Homo sapiens
  misc_feature: GYAE6OF01CGXGM.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctctcacttgctgcccagggtccaattctcagactgtggtgactcgaggacgccctcactgactgtcgtccccgaggagggacaggtccactctacaccgtgtcgccttaccaaccacgtggagacacgtaccaccgagtcgtcttactactacctaaacgttcggttaccagacctaacgaaaccgtgggaaccaacgccacccggaggcctactctaatttataacgaactaaaaccaaaaccaactaccctaccgttccggacccccgtcgaccctagttcctacgacgtcccgtcccgtcggtacggggaccaacggtcgtcgtaccgtacgtacctacgtacgtcggtaggttcgcggtacgtccgtaccgtgggaacgggtcgacggtcgtacgttaacgttacttaccgtcgtaccctttaacgtccgtttacggttttgggtagttcgtagttcgtcgtaccgttacgcggggtacggagtaccgagtcgtagtccgtatacgcgacgtaccgagccgtccgcccgtgtacctcgttccaccgttcccctcccttcgtaccg

SEQ ID NO: 133711 - DNA, 792 bp, Homo sapiens
  misc_feature: GYAE6OF01B7PGR.17.33.C11.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctcgcccagggtccaattctcagactgtggtgactcaggacgccctcactgactgtcgtcccgaggagggacagtcactctccacctgtnccttaccaacncgtgganccagccaccgngtcgtcttactactaccctaaacgtcgttaccacgacgaacgaaaccgtcgaacaacgacccgaaccccggtaagggcctaactacttaagtttaaactaaacgtaaaccaaaacctaaaaccaaaacctaccttacccgtaccggtacccccgtccgtacccgtacttccgtaccgaccggtcccttcccggtcgggtacggggtactaaacgtccgtaccgtacccgtagtaaccctacgttcggtcgttcgggtcgttacggaccaccggtaccgtagggaacgggaacccggtacgaccggttacgtaaccttacgttaccttaccgttccctttaaccgttacgttttacgggtttggttacgggttcgtcgttcggttacgtaccgtttacgggttaccgggaccgggtaacgggtacccgtacggtaccgtaccgtaaacccggttacgttaacgtccgacccggtaacccggtaccggtcccgtccccggtaccccgttctaccgtaccccttccggttccccttaccccctccccg

SEQ ID NO: 133712 - DNA, 740 bp, Homo sapiens
  misc_feature: GYAE6OF01BMPYB.17.33.C11.1.454.CMB.1.raw
  modified_base (383)..(383): a, c, t, g, unknown or other
  misc_feature (383)..(383): n is a, c, g, or t
  modified_base (451)..(451): a, c, t, g, unknown or other
  misc_feature (451)..(451): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacactggacgcagtccaccagtcgtcttactactacctaaaccttcggttaccagaccgaacggaaaacccgtggaacaacgccaaccccgaagggcactactaatttataacgtaacaaaaccaaacaaaccactccgtacgacccctcgacccgtattccncacgtccttcccgtccggttacggggacaaacggctacgcctagacctacgtcgtcgtggtgtcgacncgaccgtaggacggaccgaggactagtacttagttacctcgtacccttacgttaccgtttacgtttgggtacggtcggttacgtgttcggtaccgttaggttacccggggtagggaaccgggtaacccgtaacggttaccgtaacggttaacccggttacggttaaaccgtaccggaacccggtcccgtaaacgggtccctccccggtacccccggttaccgggtcccgtaacccgtttacccggttacccccgtttccccccgttcccccgtttcccgttaaccccgg

SEQ ID NO: 133713 - DNA, 768 bp, Homo sapiens
  misc_feature: GYAE6OF01CS5FT.17.33.C11.1.454.CMB.1.raw
  modified_base (449)..(449): a, c, t, g, unknown or other
  misc_feature (449)..(449): n is a, c, g, or t
  modified_base (530)..(530): a, c, t, g, unknown or other
  misc_feature (530)..(530): n is a, c, g, or t
  modified_base (545)..(545): a, c, t, g, unknown or other
  misc_feature (545)..(545): n is a, c, g, or t
tcagcgtagactagcacgaccggtgctcgatttagagtgagctcgttgggtttggggggcgccaggggtcccttccaatatcagcaccatggcctggactcctctcttctgttcctcctcacttgctcgcccacgggtctaattctacagactggtggtgactcgaggacgccctcactgtactcgtcgtaccccgagggagggacacgtacctactcctaccaccgtgtcgtaccttaccgaaactacgtggaacgtacacgtaccacagtcgtacttaactactaaccgtaacgttcggtaccaagtacgaacgtaaaccgacgaaccgaacgccgtaaccggacggtacctaactaccgttaaattaacgtaaactaaaccgaaaaacaaacctaaaccgtacgtaccctaccgggaccctacgaccgttactccgtacacgtccnccgtacgggtacggacgaacgcgtacacccgtagacttcgtagttctaggtacgcgtaccgcgttaggacggagtaaccgnggtactataacgttntacgaccgtccttaagtccttacgggtttggcgttagcggttacggtcttaaccgggttcggtaacggggtggaaaacggcctaacggcgttaccgggtaaccttagaaccggtacccgaaccgggtaaccgtacggccccgtttaccccgaccccggttagggttaccccttccggtcccccgttttaacccggcccccgtttacccgtacccgttaccggg

SEQ ID NO: 133714 - DNA, 840 bp, Homo sapiens
  misc_feature: GYAE6OF01BGUL3.17.33.C11.1.454.CMB.1.raw
  modified_base (222)..(222): a, c, t, g, unknown or other
  misc_feature (222)..(222): n is a, c, g, or t
tcagcgtagactagcacgaccggtgctcgatttagagtgagctcgttgggttgggctggcgccagggtccttcaatatcagcaccatggcctggactcctctctttctgttcctcctcacttgctgcccagggtccaattctcagactgtaggtgactcaggacgccctcactgactgtgtccccagggaggacagtcactctcacctgtcgacttccaacncgtggacgcacgtcaccgagtcgtacttactactaccaaaacgttcggttaccagaccgtaacgtaaacccgtcggaaccaaacggacccgaaccccggtacgggggacctaaccttaccgtaagttttacgtaaacggttaaaaccaaaaaccgaaaaccgtaaaacctaacccttaaccccgtttaccgggaaccccccgttacggtaaccccggttaactttcccgtaccgtaccgggttacccttccccggtaccgggtttaccggggggaaccaaacggtccgtaccgtacccgtacggacctaacgttcggttacgtcgggttacgtacggtaccgtaacggtccgttaaggggtacgggtaacggaaccgggttccgtaagtaacccgtttacgttacgttaccggtaccctttaacgttccgtttacggtttacggggtcgttacggtaccggttcgttacggtaccgtttacgggtaccgggtacgggtacgggaccttaggtacccgtaggttacccgttacgttaacggtccgtaacggtacccggtcgtaccgtacccgttaccccggtcggtacctacgttcccttaccggttccccttaccccg

SEQ ID NO: 133715 - DNA, 345 bp, Homo sapiens
  misc_feature: GYAE6OF01DA0T8.17.33.C11.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (321)..(345): a, c, t, g, unknown or other
  misc_feature (321)..(345): n is a, c, g, or t
tcagcgtagactagcacgaccggtgctcgatttagagtgagctcgttggggtttgggggctggcgccgacggggtcccttccaatatcagcaccatggcctggactcctctcttctcgttcctcctctacttgctcgccagggtccaattctcagactgtggtgactcaggagccctcactgactgtgtccccaggagggacngtcatctcacctgtncttccaacgactggagcagtcaacctagtcncttaactataccaaactggttccagcaaagtaaacctaggacaagacaccaggcacgtanattanacaaacnnnnnnnnnnnnnnnnnnnnnnnnn

SEQ ID NO: 133716 - DNA, 877 bp, Homo sapiens
  misc_feature: GYAE6OF01ES9J3.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactggtggtgactcaggacgccctcactgactggtcgtccccgagggacgggacagtcactctcaccgtgtcgccttaccaacgtacgtaggagcacgtccaccgtaggtcgtaccttaacgtactaccgtaaacgttcggttaccagaccaacgtaaaccgtaggaacaacgcccaaccggacgggacctactacgttaatttaacgtaacgtaaaccaaaaccaaacaaacctaccttacccgtaccgggtacccccttacgtaccccgtattaccgtaccgtaacggtccccttacccggttaccggggttaccggggggaacctaaaccggtcccggttaccggtaccccgtagggtaaccccgttaaccgttcgggtttacccggttcggggttacgggttaccgacccgggtaacccgggttaccgggttaacgggaaccggggggtaacggtacggggtaaccggtttaacggttaaacccgttttacgtttaacccggtaccgttaaccccgtttaacccgtttaccggttttaccggggttttacggggtcggttacggttccggtttagggttaccggtacgtttaccgggttaccggggaacgggtaccggaaccgtagtccggttacggtaccggttactacgggtaccaccggacccggtacgcccgtcccgacccgtcggtacctaccgttcccgttccgtccccttaccccg

SEQ ID NO: 133717 - DNA, 751 bp, Homo sapiens
  misc_feature: GYAE6OF01C56TV.17.33.C11.1.454.CMB.1.raw
  modified_base (172)..(172): a, c, t, g, unknown or other
  misc_feature (172)..(172): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgccgaggtccaattctcagactgtggtgactcaggagccctnactgactgtcgtacccgaggacggacagtcactctcaccgtgtcgccttaccgaactacgtgacgcacgtccacgagtctacttactatacctaacgtcggtaccaagacaacgtaaacgtacgaacgaacgaccaaccgacggacctaacgtacttaagttactaaacgtaaaccaaaacctaaacaaacctacctaccgtaccggaccccgtccgacctaacgttcacgacgtcccttacccgttaccgggttacggggaactaaacgtcgtaccgtacccgtacgtaccgtaccgttggttccgtagggttcggtacgtacgtacggtaccgacgggtaacgggtaacgtacgggtacgttacgttaaccgttacgtttacggttacccgttacccgttactttaccgtttacggtttcggtcggttcgtacgttcggtcggtttacgtacgggttaccgggaacgggttacggacgtacgtacgttaccgtaccgtagttaacggcgtaaccggaccgtacggtaccctcccgtcccgtacgtaccctcgttccccgtccgttccccgtaccccg

SEQ ID NO: 133718 - DNA, 906 bp, Homo sapiens
  misc_feature: GYAE6OF01EJL0L.17.33.C11.1.454.CMB.1.raw
  modified_base (157)..(157): a, c, t, g, unknown or other
  misc_feature (157)..(157): n is a, c, g, or t
tcagcgtagactagcacgaccggtgctcgatttagagtgagctcgttgggttgggctggcaccagggtcccttcaatatcagcaccatggcctggactcctctctttctgttcctcctcacttgctcgcccagggtccaattctcagactgtgggtnactcaggacgccctacactgacttcgtcgtccccgagggaggactacgtccaccttctacctaccgtgtcgtaccttaccgaacgtacgtggtacgccacgttaccaccgtagtcgtacttactaactacctaaacgtcggttaccagacctaaacggtaaccgtacgaactaacggacccaaccggtaccgggtacctaaccttaaccgttacgttttaaataaaccgggtaaaacctaaaaacctaaacccgttaaaacccgtacccgttaaccccgttacccggtaacccccgttaccgtaccccgttaacgttacccgtacgtacccggtaccccttaccccgggttacccgggtaccggggtaaactaaaccggtcccgttaccgtacccgtacgaccccttaacgggttcgttcgttacggtcggttaccgaccgtacgggtccgttagggaacgggtccggaacggttccgaacgttaaccctttaacgttaccggttcctttaacccttaccggttttccgtttaacgggttttggggtccgttaaccggtttgggtacgttaccggttaccggtttacgggtacccgggaccgggtaacgggtaaccgtccgtacggtaccgtttaccgaaccggttttacccgaccggtaacgtccccggtaacggttccccgtaccccggttccccgtaacggttcccctaaccggtttcccgttccccgtaccccgggttacccccc

SEQ ID NO: 133719 - DNA, 860 bp, Homo sapiens
  misc_feature: GYAE6OF01DYG9T.17.33.C11.1.454.CMB.1.raw
tcagcgtagactagcacgaccggtgctcgatttagagtgagctcggttgggtttggggggcgccaggggtcccttccaatatcagcaccatggcctggactcctctctttctgttcctcctcacttgctgcccagggtccaattctcagactggtggtcgactcaaggcgccctcactgactgtcgtccccgagggaggacagtccacttcctacaccgtgtcgtccttaaccaacacgtggacgcacgtccaaccgtgtacgtacttaactactacctaacgttcggttacagaccgaacgtaaaccgtacggaacaacgaccgaccccgaagggtaccactacttaatttaataaacgtaaaccaaaaccaaactaaacctacctccggtaccgaccccgtacgaccccgtacttacctacgaccggtcccttcccggtaccgggttacggggaaccgaaacggtcccgtccggtaaccctcggaaccgtacgttcggttacggttcggggtagtaccggtaccgtacgggtaccctaggggaaccgggaacgggtaaccgggttccttaacggttaaccgtttacgtttacccgttaccggttacccctttacggtttacccggtttcggttttacgggtaggttcggttaccggtttggtaccggttacggttacgggttaccgggggacggtaaaccgggtacctaggtacccgttaaccggttaccgttacgtaaccggtaccgaacccggtacccgtaccgggtacccgtcccgtaccccccgggtttactacccgttaacccgttcccccgtttacccggtttccccccctcccgttcccgtttaaccccgg

SEQ ID NO: 133720 - DNA, 795 bp, Homo sapiens
  misc_feature: GYAE6OF01C8ZKZ.17.33.C11.1.454.CMB.1.raw
  modified_base (162)..(162): a, c, t, g, unknown or other
  misc_feature (162)..(162): n is a, c, g, or t
  modified_base (172)..(172): a, c, t, g, unknown or other
  misc_feature (172)..(172): n is a, c, g, or t
tcagcgtagactagcacgaccggtgctcgatttagagtgagctcggttgggtttggggctggcgccagggggtcccttccaatatcagcaccatggcctggactcctctctttctgttcctcctcacttgctcgcccagggtccaattctcagactgtggtnactcaggacncctcactgactgtcgtacccgagggacggacagtccactcctcctacctgtctccttaccaacacgtggagacacgtccaccgtagtcgtactttactaactacctaacgttacggttaccagtacaaacgaaaccgtacggaacgaacgaccgaaccggacgggacctaacgtaccttaatttaacgtaaacgtaaaccaaaaccaaaacctaaaacctacccgttaccgtacccgggtaaccccctccgggtaaccccttacttacccgtaccgtaccggtccccgttcccggttccccgggttaacgggggacctaaaacggccgtccgtacccgtcgaacctacgttcggttacggtcgggtcgttacggaccacggtccgtacgggacgggacgtacggtacgtacgtacttacttaccgtccgttaccttacttaccgttacgtttgggtcgttacggtcgttcgtcgtacggttacggtaccgggacgggtaacggaccgtaacggttcgtacgtaccgttacgttaccggtaaccgaccgtaacccggcggtacccgtaccccggttaccccgtcggtacccttccggttcccgttcccgttcccccgtaccccg

SEQ ID NO: 133721 - DNA, 723 bp, Homo sapiens
  misc_feature: GYAE6OF01CA2JS.17.33.C11.1.454.CMB.1.raw
tcagcgtagactagcacgaccggtgctcgatttagagtgagctcgttggggtttggggctggcgccaggggtcccttccaatatcagcaccatggcctggactcctctcttctgttcctcctcacttgctcgcccagggtccaattctcagactggtggtgactacgaggacgccctcactgactgtcgtcccgagggagggacacgtcactctcaccgtgtcgccttaccaacgacgtgggacgcgtacgtaccgaccgaggtcgtaccttaactaactaacccgtaaacgttcggttaccgacgacgaacgaaaccgtacggaacaacgaccgaccggaggacctacgtactattaacgtaacgtaaaccaaacaaacaaacctacctaccgtaccggacccctcgacccgtactacctaccgacgtccgtcccgttcgggttacggggaacctaacggcgtccgtaccgtacgtaccgtacgtcggttcgttcgggtacgtcgaccggacgtccggtaagggacggacgggtacggtcgtaacgttaacttacgttacgtacgtaccttacgttccgtttaggttcggtcggtagtcgttacggtcgtacgttacggtccgggacgggaggaccgtacgcgtacgtacgttacgtacgtccggactccggacgtccgtcccgtcccgtcgaccttacccgtccgttcccgtcccgtcccg

SEQ ID NO: 133722 - DNA, 840 bp, Homo sapiens
  misc_feature: GYAE6OF01C81QO.17.33.C11.1.454.CMB.1.raw
tcagcgtagactagcacgaccggtgctcgatttagagtgagctcgttgggtttggggctggcgccaggggtcccttcaatatcagcaccatggcctggactcctctctttctgttcctcctcacttgctcgccagggtccaattctcagactgtggtcgactcgagggacgccctacactcgacgtcggtcgtccccgaagggagggacacgtcactctcacgtgtcgtaccttaccaacacgtggacgacgtacgtaccgaccctagttcgacttaactaactaccctaaacgttcggtaccacgaacgtaacgtaaacccgtcggaaccaacgccaacccggacgggtacctaaccttactaacgtttaaattaaaccgaaaaccaaaacaaaaactaaacccgtaacctacccggtaccgtaaccccgtacgtcccgtaaccttccgaccggtaaccgttccccgtacccggttacgggtacgggaacctaaaccgccgtccgtaccgtacgtacctaacgttcgtaccggtgggtcgtaccggaccgtagtacccgggtaggaacgggaaccggtacggtacttacggtaacttaacgtaccggttccgttaacccttaccgtttaccgtttacgggttttagggtccgggtttaggtcgttacgggttccgttccggtaacggggtttacccggggacgggttaaaccggtacccggtaacggtacgtaccccggttaaacgttaccggaacggttaacccgacggtaacccggaccggttcccgtcccgaaccccgtcggttaaccctcttcccggtacccgtccccgttcccg

SEQ ID NO: 133723 - DNA, 718 bp, Homo sapiens
  misc_feature: GYAE6OF01BFCOB.17.33.C11.1.454.CMB.1.raw
  modified_base (161)..(161): a, c, t, g, unknown or other
  misc_feature (161)..(161): n is a, c, g, or t
  modified_base (172)..(172): a, c, t, g, unknown or other
  misc_feature (172)..(172): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (643)..(643): a, c, t, g, unknown or other
  misc_feature (643)..(643): n is a, c, g, or t
tcagcgtagactagcacgaccggtgctcgatttagagtgagctcggttgggtttggggctggcgccaggggtcccttccaatatcagcaccatggcctggactcctctctttctgttcctcctcacttgctgcccagggtccaattctcagactggtggtnactcagggacnccctcactgactgtcgtcccagggaggacagtcactctcactgtcgccttaccaacncgtggacncagtccaacctaggtntcttaactactaccgtaaacttcggttaccaagaccaacgtaaccgtacggaacaacgccaacccgagggacctacctactatttaagtaacgtaaacaaaaccaaacaaacctacctccgaccgtaccccgtcgtacccgtatcctccgacgtccttacccgtcggtacgggacacggtcctcgccctacgactctcgtcgtggtcgtcgacgacgtacgtaggacggtacgacggacgtacgtactttagtcctacgtaccttacttcgttacgtttcggtcgtagtccgttgtctacgttaggtccgggacggacggtaccgtacggtcgttaccgtaccggttaacgtttaacggcccgtaacctacccgggaccgggttaccccnccccgggttcccccgtaccgggttacccctaacccgtttccccggtttaccccgttaaccccccttaccccccgg

SEQ ID NO: 133724 - DNA, 769 bp, Homo sapiens
  misc_feature: GYAE6OF01C79K8.17.33.C11.1.454.CMB.1.raw
  modified_base (171)..(171): a, c, t, g, unknown or other
  misc_feature (171)..(171): n is a, c, g, or t
  modified_base (176)..(176): a, c, t, g, unknown or other
  misc_feature (176)..(176): n is a, c, g, or t
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctcgcccagggtccaattctcagactgtggtgactcgaggacnccctnacgtgactcgtcgcccgaagggacggactagtcctactctctaccgtggtcnccttaccgaactacgaggacncgtagtaccaccgtaggtcacttacactaccgtaaactcggtacagtacgaacgaacgtaggaacaacgaccacggacggcacgttctaattaatactaaacaaaaccaaaacgaacctcctaaccgtacccggaccccgtacgtaccggtacttacgtcgtaaccggttccccgttacccgtacccgggttacgggggaacctaaacgggtcccttacggtacccttagaaccgttccgttcgttagtccgggtttaggacgaccgttacggaaccggtcgggaacggggtacgtaaccggtcgtaaacgttaccgttaacgtttaccgtacggttaaacccttcggtttaacgttcgggtttttacgggccgttagtcggtaaggttcgttacggtacggtaccgggcggaacgttacgaacgtccgttacgaaccgtttcgaacgccgtaagcccgtacgggtccctaccggttacccgtcctaaacctcggtacccctttacgcccgttaaccccg

SEQ ID NO: 133725 - DNA, 783 bp, Homo sapiens
  misc_feature: GYAE6OF01ERLPW.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctattcctcctcacttgctgcccagggtccaattctcagactgtggtgactcgaggacgccctcactgactgtcgtccccgagggaggacagtcactctccacctgtcgtccttaccaactaccgtggacgtccgacgtccaccgtagtcgtaccttaactactacctaaacgttcggttaccgagaccaacgaaccgtggaacaacgccacccgagggtcctactactatttaacgaacgtaaaccaaaccaaaacaaacctcctacccgtacggtacccctcgtacccgtacttccgtaccgaccggtccctccccggtttaccggttacgggggaccctaaacgtccgtaccggtccccgtaccggtaaccgttccgttcggtcccggttacgggtcgttcggaccgtaccggtcgtacgggaacgggtaccggtacggtaccgtacgttaacttacgttaccgtacgtacccgtttacgttccgtttacggttttcgggttcggttcgtcggttggtcgttacggttaccggtaccgggggtacgggtaaccggaaccgtacgtcggtacgtacccgttacgtacgtcgtaaccggcccgtaacggtcccgttacccccggcccggttactcccgtaccttcccgttcccggtccccccgttaccccg

SEQ ID NO: 133726 - DNA, 752 bp, Homo sapiens
  misc_feature: GYAE6OF01EOOG7.17.33.C11.1.454.CMB.1.raw
  modified_base (239)..(239): a, c, t, g, unknown or other
  misc_feature (239)..(239): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccaggtccaattctcagactggtggtgactcaggacgccctcactgactgtcgtccccgaggagggacagtcacttcctcaccgttgtcgtccttaccaacacgtggancgacgtccaacgtgtgtcttactactaccaaacgtcgtacagacaacgaaccgtagaacacgaccgaaccggacggactactactaattacgtaacgtaaacaaaaccaaacaacctaccgtacccgtaccgtaccccgtacgtaccgtacttaccgtaccgaccgtccgttacccgtacgggtacgggaacgtaacgtccgtaccgccctacgtaaccgtacgttcggttcggttcggtacgtacggacgtacgtccggtacggaacgggtacggtaacggtacgtaacgttaacgttaacgttaccgttacgtacccgtttacgtttaccgtttacggtttggtcgggttcgtcgttggttacgttacggttacgggtaccgggtacgggtaacggtaacgaacggtacgttacggtacgttacgttacgaccgtaccggaccgtacggtccgtcccggtcccgttacgtccgttaccgttccgttcccttacccgttcccgttccgtacg

SEQ ID NO: 133727 - DNA, 788 bp, Homo sapiens
  misc_feature: GYAE6OF01CENU9.17.33.C11.1.454.CMB.1.raw
tcagcgtagactagcacgaccggtgctcgatttagagtgagctcgttgggtttggggctggcgccagggtcccttccaatatcagcaccatggcctggactcctctctttctgttcctctcacttgctgcccagggtccaattctcagactgtaggtgactcgaggacgccctcacctgacttgtcgttacccgaggacgggacacgtcacgtcctcaccgttgtcgccttaccaaacgtcgtagggagcctacgtccaacctagtcggtacctttaactactaaccctaaacgtcggttacccaggacctaacgtaaaccgtcggaacgaaccgcccgaccggacggacctacgtcgttaaatttacaaccgttaaaccaaaaccgtaaaccaaaccgtacccttaccgtacccggtacccccgtacgaccccgttaattcccgtaccgtaccggtcccttcccgttaccgggtaacggggctaaaccgccgtaccgtccgtacgtaccgtacttcggtcggttcggtacgacgtccgacggtaccgtagggaacgggtaaccggtacggtccgttaacgtaaccgtttcctttaaccggtcgttaacctttccgttacgtttacggtttcgggtcgttacggtctggttcgtacgttaacgggtccgggtacgggaacgggtacacgggtaccgttacgaccgtttacgcggtaccgacccggaaccgtcggtaccctcccggtaccccgtcgttactccgtttccgttcccgtcccgtaaccccg

SEQ ID NO: 133728 - DNA, 859 bp, Homo sapiens
  misc_feature: GYAE6OF01B7FA5.17.33.C11.1.454.CMB.1.raw
  modified_base (234)..(234): a, c, t, g, unknown or other
  misc_feature (234)..(234): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactggtggtgactcaggacgccctcactgactgtcgtcccagggaggacagtcacctctcacctgtgccttccaacactggacncgagtccaccgagtgtaccttactactacctaaacgttcggttacagaccaagaacctcgaacaacgaccaccgacggacctacgtactatttaataacgtaacaaacctaaaccaaactacctaccgtaccgtacccgtaccgaccgtacttcctacgacggtcccttacccgtccggtacggggaactaaacgtccgtaccgtacccgtagtaacccgtcgtcggttacgttcggtagtacggtaccgtacgtaccggttagggaacggtaaccgggtacggttaccgttaaggtaaccgtttaaccgtttaccggtaacccggtttacccgtttaccgttaccgtttttaccgggtttacgggttaccgggttcgttaaccggttcggtttacccggttaccggtttaccgggttaccgggggtaaccggggtaaaccggggtaacccgtaaccggtaccggttacccgggtaacccggttttaaacccggttaacgggttaccccgtaacccggtaacccggtacggtacccccggtccccggttaaccccccggttacccgggttaccgttacccccgggttttcccgttccccgggtttcccccccgttaccccccggg

SEQ ID NO: 133729 - DNA, 814 bp, Homo sapiens
  misc_feature: GYAE6OF01AOI3V.17.33.C11.1.454.CMB.1.raw
tcagcgtagactagcacgaccggtgctcgatttagagtgagctcgttgggtttggggctggcgccaggggtcccttcaatatcagcaccatggcctggactcctctctttctgttcctctcacttgctgcccgaggtccaattctcgagtactgtggtgactcgaggacgccctcacgtgtacgttggtccgtccccgaagggacgggtaacagtcctacttcctccaccgttggtctccttaccaaccgtacgtgggactccgactaccaacctaggtctacttactactaacctaacgttcggttacacgtacgtaaacgaaaccgtcggaaactaacgacccgaaccggtcggaactccgtaacgttaattacgtaaaacgtaaccaaaccaaacgtaacctaccgtacccgttaccggaccccgtacgtacccgttcgtacctaccggtaccgtccccgttccgttaccggggtcgggaaacctaacggtccgtacccgtccgtaaaccgtaccgttacgtcggttccggtaggttaccgtcgtactacggtacgggtacggtaaccgggacgtaccgggtcgtaaccgttacgttcgttaaccgtaccggtaccctttaaccggtttccgtttaacgggtttggttacggttcccgtgtttacggtccgttacgggtacggttacgggaccgggttaacggaaccgtcggtacggtacgttaccggttactaaccgtccgtaccgtacgtccgggtccctcccgttacccgtacgttccaacccgtttccgtaccccgttcccgttccc

SEQ ID NO: 133730 - DNA, 574 bp, Homo sapiens
  misc_feature: GYAE6OF01BNH3V.17.33.C11.1.454.CMB.1.raw
  modified_base (337)..(337): a, c, t, g, unknown or other
  misc_feature (337)..(337): n is a, c, g, or t
  modified_base (430)..(430): a, c, t, g, unknown or other
  misc_feature (430)..(430): n is a, c, g, or t
  modified_base (461)..(461): a, c, t, g, unknown or other
  misc_feature (461)..(461): n is a, c, g, or t
tcagcgtagactagcacgaccggtgctcgatttagagtgagctcgttgggtttgggggcgccaggggtccttccaatatcagcaccatggcctggactcctctctttctgttcctcctcacttgctgcccagggtccaattctcagactgtggtgactcaggagccctcactgactgtcgtccccaggaggacagtcactctcacctgtgcttccaacactggagcacgtcaccagtgctttactatccaaacgtggttcagcaacgaaacctggaacaagcacccaggcactcattatagtacaaacaacaaacactctacgaccctgccgattcncacggctccctccgttggggacaaacgctacgcctacgacactcgtctgggtctgcacgcgtacggacggacgacgcgtagacttattacgtntcctacttcgttacgtttggtgttgcttgtncgttagtcgggacggtaacggaccgaagcgtcgaccgttactaacgtccgacgccgaaggccgtccgccccgtcgtacctaccgtcgttccgtcccctcccgttccctacccg

SEQ ID NO: 133731 - DNA, 680 bp, Homo sapiens
  misc_feature: GYAE6OF01B1Y70.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactggtggtgactcgaggacgccctcactgactgtcgtcccgagggaggacacgtcacctctcctaccgtgtcgccttaccgaactacgtggacgtcacgtaccaaccgtaggttctcttaactacaccgtaaacgttcgttaccagcgaacgaacctggaacacgccaaccgaggccactcttagttaacgtactaacaaacaaacaactaccgtccacgaccctcgccgtattcacgacgtcctaccgtcggtacgggaacaacgtcgtcgacccgtagaccgttctgtaccgtgggtactcggacgtacggtcgtagggacggacggtacggtacgtacgtaacttacgttacgtccgtaccttacttcgtttcgttcggtacggttcgtacgtgtcggtacgttaccggtacgggacgggtacgacgtacgtcgtacgtaccgttagtacgtacgacggtaccgacggtaccgtcccgtcccgtccgtaccgtaccgttcgtacccgtcccgttcccgtccgttacccg

SEQ ID NO: 133732 - DNA, 903 bp, Homo sapiens
  misc_feature: GYAE6OF01E00O1.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctcgcccagggtcccaattctcagactgtggtgactcgaggacgccctgaccgtgaactgtacgtcccgaaggagggacaggtccaactccgtcaccgtgtcgaccttaccaaacgtaccgtggacgacgacgttcaacctaaggtcgtaaccgttaactactaccgtaaacgttcggttacccgaacgtaccgtaaacggaaacccgttaggaaaccgtaacgacccgtaaaccccgtaaggggtacctaaccggttaccttaaacgtttaaagtaaaccgtaaaccgtaaaaaccgtaaacccgtaaaacccgtaacccgttacccggtaacccgggtacccttacccgggtaacccgtacgttcccgtaccgaaccggttcccgttcccgtaccgggttagggggtaacctaaaccggtcctccggttacgtaccgtaaccgtaacggttcgttacggtacgggttcgtacgaccgtaacggtcgtacgggtaaacggtcggtagttaccggttagtaaccgttaaccgtaacggtacccgttaccttaccgtttaccgtttcggttttaacgggacgggttaccgttcggttagtaccggttacgttaacggggtttccggaacgggttaccggaacttccggtacggttagtaacccgtttaaggtttaaccgccgttacggaacccccggtaagttcccgggtaccccgttaccccggtacccggttaacgtacccgtttcccctttacgggtaccccccttaaccccg

SEQ ID NO: 133733 - DNA, 1021 bp, Homo sapiens
  misc_feature: GYAE6OF01BM16Z.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctcgcccagggtccaattctcagactgtggtgactcgaggacgccctcactgactgtcgtccccgagggaggacagtcactctcacctgtcgtccttaccaacacgtggacgcacgtccaccagtcgtccttactactacctaaacgttcggttaccagaccgaaacgtaaaccgtaggaaccaacgacccgaaccccggacggggacctaaccttacttaacgttttaacgttaaaacgtaaaaccctaaaaacctaaaaccctaaaaacctaaccccgttaccccgttaacccgggtaaccccccgttaccggtaacccccggttaacttttacccgtaccggtaacccggttaccccgtttacccccggtttaccccggggtttacgggggggtaaccctaaaaccgggttcccgttaccgggtacccccgttaacggtaacccgttaaccggttcggtttaccggttcggggttcgggttaccgtacccggtacggtacccgggtaggggtaaaccggggaaccgggtacgggttaccgttaaccggttaaccgtttaaccgtttaccgttaccgttacccgtttacccgtttaaccggttttacgggtttttacggggttcgggtttcggtaccggtttcgggttacggttaccggttttacggggttcccgggggtaacccgggggtaaccgggtaaccggtaaccgggtaccggtttaaccggttaaaccccggtttaacggtttaacccggtaaccggtaaccccggtaacccgggttaacccgggttaccccggtacccccgggttcccccccggttaccgggttaccccgttaccccggtttccccgggtttaccccccggtttccccccggttaccccccgg

SEQ ID NO: 133734 - DNA, 830 bp, Homo sapiens
  misc_feature: GYAE6OF01BHUR9.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactggtggtgactcgaggacgccctacacgtgactgtcgtccccgagggacggactagtccactcctacctaccgttggtcgtaccctttaccaaacgtacggtaggacgccgtacgtaccaaccgtagttcgtacctttactaactacctaaacgttcggttaccagacaaacggaaccgtggaaaccacgtacccaaccggtacggactactacttaagtttaagtaaccgtaaaccaaaaccaaacgtaacctacccgtccgtaaccggtacccctcgaacccgttacttcctacgaccgtccctcccggttggtacgggacaacggtctccgacctagacctacggttacgtcggttacggtgtccgtacgtaacgccgttaagggacgggtaccgaggtcccgttaagtacgtttactaccgtacgttcccttacggttacgtttacgggttcgggtgttcgtccgttaagggtcttaccgggtttacggaccggggaccgggtaacggaacccgtacggttaccggtaccggttaacgttaccgttaaaccgacccgggttaaccgaacccgggttaacccggttcccgtcccccggtttaccccgtacggtaacccctttcccggttaccccgttacccccgtttcccccggaccctttccccggtttaaaccccg

SEQ ID NO: 133735 - DNA, 827 bp, Homo sapiens
  misc_feature: GYAE6OF01B04XF.17.33.C11.1.454.CMB.1.raw
  modified_base (232)..(232): a, c, t, g, unknown or other
  misc_feature (232)..(232): n is a, c, g, or t
  modified_base (381)..(381): a, c, t, g, unknown or other
  misc_feature (381)..(381): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtcccaattctcagactgtggtgactcaggagccctcactgacctgtcgtccccagggaggacagtcactctcacctgtcgccttccaacactggancagtcacctagtgcttactataccaaacgttggttccagtccaagaaaccctggaacaacgccaaccccgaggggaccactctaatttataacgtaacaaaaccaacaaaccaccttaccgtacggaccccctcgaccccgtattaccncgaccggtcctccccgttccggttagggggacccaaacggtcctaccgtcccctaggaccctacgttcgttccgtagggtcggttacgaccgtacggtcccgttagggaaccgggtaccggtaacgggtccgttacggtaaccgtttaactttacccggtacgtaaccccgtttaaccgttccgtttaaccggttttcgggttacggtttccgtccggtttggttaccggtaccgtttacgggtttacccgggggaccggggtaaccggggtaaccccgtaacgggtcccgttacgggtaaccccggtttacgttaaaccggtacccgtaaccggtacccccgtaagggtccccgttcccccggtaccccccggttaccgggtacccttacccgttacccgttacccccgtttacccccctcccccgtttccccgtttaaccccgg

SEQ ID NO: 133736 - DNA, 845 bp, Homo sapiens
  misc_feature: GYAE6OF01D4BN4.17.33.C11.1.454.CMB.1.raw
  modified_base (159)..(159): a, c, t, g, unknown or other
  misc_feature (159)..(159): n is a, c, g, or t
tcagcgtagactagcacgaccggtgctcgatttagagtgagctcgttgggtttggggctggcgccagggtcccttcaatatcagcaccatggcctggactcctctctttctgttccctcctcacttgctgcccgagggtccaattctcagactgtggtnactcgaggacgccctcactcgacgtgtcgtcccgaagggacgggactagtccactcgtaccacctgtcgtaccttaccaactacgtaggacgacaacgtaccaccgtagtcgttacttaactaactacctaaacgtcgtaccacgacaaacgaaccgtacggacaacgaccaaccggacggacctactacgttaattaaacgtaacgtaaacctaaaaccaaaactaaaccctaaccgtacccgtaccgtaacccctccggtaccgttacgttaccgtaccggtaaccggtcccgttaccgttacccggggttaacgggaacgtaaacggtccgtaccgtaccctacgaaccgtacgttcgtcggttacggtgtacgacgtaccggcggttaaggacgggtaacggacggtacgtacggttaacttaacgttacctacgttaacccgttacgttttaaccgtttcgggtttagggttcgggttcgttacggtttacggtacggttaaccggtttaccgggttacggggtaccgggaaacgggtacccgtaacggtccgttaacccgggttaaccggtttaacgttaaccggtccggtaaccggttaccggtaacccggttccccttacccgggtccccgtccgttaaccccgttcttccccgggttccccttccccggttaccccg

SEQ ID NO: 133737 - DNA, 862 bp, Homo sapiens
  misc_feature: GYAE6OF01CJPQ4.17.33.C11.1.454.CMB.1.raw
  modified_base (215)..(215): a, c, t, g, unknown or other
  misc_feature (215)..(215): n is a, c, g, or t
tcagcgtagactagcacgaccggtgctcgatttagagtgagctcgttgggtttggggctggcgccaggggtcccttcaatatcagcaccatggcctggactcctctctttctgttcctcctcacttgctcgcccgacgggtccaattctcgagacgtggtggtgacctcgaggacgccctcactcgactcgtactacccgagggaggacacgtcnctctcgtaccgtgtgtcctaccaacgtcgtacggcgacacgtccgtaaccgtagttactcctttaactacgtaacctaaacgtttcggtaccagaccgtaacgtaaacccgtaggaaccgaaccggaccctaacccgggacggtcctaacttacgttaacgttaacgtaaaacgtaaaacccaaaaccgaaaccgtaaaaccgtccgttacccgtacccgtaaaccccgtccgtacccgtacttaccgtaccggtaccgtacccgtttacccggttaccggggtacggggtaacctaaccggtccgtccgtaaccgaccgaaaccgtcggtttacgttcggttaggtcgggttaccggactaccggtccgggtacggtaacgggtaacggtaccggtacttacggtaacccgtttacggttaccgttacccgttacccgtttaaacggtttccgttttaacggggtttcggttcgggttccggtcgtttacgggttccgtaacggtttccgggtacggggaacccgggacccgtgaacccgttcgggaacccgttccgttaagttaccggaccggtaccgaccggtacgttccccgtaccccgttcccggtacgttccaccgttcccgttacccttcccgtaccccg

SEQ ID NO: 133738 - DNA, 975 bp, Homo sapiens
  misc_feature: GYAE6OF01C3KEQ.17.33.C11.1.454.CMB.1.raw
tcagcgtagactagcacgaccggtgctcgatttagagtgagctcgttgggttgggctggcgccaggggtcccttcaatatcagcaccatggcctggactcctctctttctgttcctcctcacttgctcgcccagggtccaattctcagactggtggtgacctcgaggacgccctcactaggacttggtccgtcccgaagggaggacagtccactctcaccgtgtcgccttaccaactacgtaggacgcgtacgtacaaccgtaggtcgtaccttaacgtaacctaaccgtaacgttcggtacccgaagaccctaaaaggtaaaccgtacggaacaaccgacccgaaccccggtaggaccctacttacttaaagttaacgtaaacgtaaaccaaaaacctaaacctaaaccgtaccctaccgtacccggaccccctacgtaccccgttacttcgacccgtacggtccccttcccggtaccggggttacggggaaccaaacggttcccgtaccggtaccctacggtactaccggtttcggtacggttcgggtacgtccgaaccggaccgttccggtaaggggaccggtaaccgggtcgtaacggttaaccttaacgtttaaccgttaccgttacccttacccgttaacgttttacccggttttagggtttcccgggttacggtccggttcgtttaggggttacccgttaccggggttttaacggggttccccgggggaaacggttaaacccgggggtaaccctaaccggggttttacccggtaccccgggttaaaccgttttaaaacccgtaacccggggtaacccggtaaccccggggttaacccggtaaccccggtttcccccccggggttaccccggtttaacccccccggtttcccggttaaaacccccccggttttacccgttcccccccggttttcccccccggtttaaaccccccggtttaacccccccg

SEQ ID NO: 133739 - DNA, 781 bp, Homo sapiens
  misc_feature: GYAE6OF01BDBDD.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactggtggtgactcgaggagccctcactgactgtcgtcccgagggaggacacgtcactctcactgtcgcttaccaactacgtggacgcacgtccaacctagtcgtacctttaactactaaccgtaaacgttcggttaccaagacgaaacgtaaccgtacggaacaacgccaaccggacggactacctacttaatttagtaacgtaaacaaaaccaaaacaaacctaccgttaccgtaccgtaccccgtaccggacccgtacttccgtacgaccgtcctacccgttaccggttacgggggacaaacggtctccggtaccctacggaccttacgtcgttcggtgggttcggtcggacgtacggtacccgttaggggaacggtacgggtaacgggttcgtaacgtaacgttacttacccgtacgttacccttaccgtttcgttacggttttagggtcggttcgtcgttcggtacgttaccgttacgggttcggggaccggggtaacggtaaccgtacggtccgtacggtacccgttaagttaccgaccggaacccgtaacggaccggtcccgtacccgccccggtcgtacccgtactttcccgtaccccggttcccttccccgttccgttacccgg

SEQ ID NO: 133740 - DNA, 695 bp, Homo sapiens
  misc_feature: GYAE6OF01BDV27.17.33.C11.1.454.CMB.1.raw
  modified_base (230)..(230): a, c, t, g, unknown or other
  misc_feature (230)..(230): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtgttaccaacactggancagtcaccagtgtcttactactacctaaaacgttcggttaccagacaacgaaaccgtacggaacaacgacaacccgagggccactctaattactaagtaacaaacaacaaacactaccacgaaccctcgaccgtactccgtacacggtcctcccgtacggttacggggacaacgtcgtcgtccctagaccacgtcgtcgtaggtgtcgcgtacgcgtagggacggaacggtacgacgtacgtactaacttacgtcgtacccttacttccgttacggtttgggttacggtcgtcgttcgtagttaccgttacggtaccgggtaccgggtaacggaacccgtaggtaccgtaccggtaccgttaccgttaacgtaaccgtaaccgtacccggacggtcccgtacccggtcccccgtacgttacccgtacccgttacccgttccccgttccccgtccccgttaccccg

SEQ ID NO: 133741 - DNA, 702 bp, Homo sapiens
  misc_feature: GYAE6OF01BMYEG.17.33.C11.1.454.CMB.1.raw
  modified_base (171)..(171): a, c, t, g, unknown or other
  misc_feature (171)..(171): n is a, c, g, or t
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
  modified_base (439)..(439): a, c, t, g, unknown or other
  misc_feature (439)..(439): n is a, c, g, or t
tcagcgtagactagcacgaccggtgctcgatttagagtgagctcgttgggtttgggctggcgccaggggtcccttcaatatcagcaccatggcctggactcctctctttctgttcctcctcacttgctgcccagggtccaattctcagctgtggtgactcaggactccctnactgactgttcgtacccagggaggacagtcactcncacctgtcgcttaccaacacgtggacncgtacgtcaccaggttcacttactacgtacctaaacgttcggttaccagacaacgtaaaccgtgaacaacgccaaccgacgggacacctacgtatttaactaacgtaacaaaacgaaacaaacctacctaccgtacggtaacccctcggtacccctagttccctacgacgtccctacccgtccggttacggggactaaacggtccncggtacccgttagaacccgttcgttcggtcgtacgggtgtacgcgtaacgtccgtagacgggacgtacggtactaggtacctaagtttaccgtctaccgttacttacgtttacgtttacggtcgtcgtcgttacggttacgtcgttacggttaccggcgggtaacggacaagtccgtagtccgttaacgtacgttccgacgacccgtacggacccgtcccctcccgttaccggtacctcgttaccttcccgtccccttacccg

SEQ ID NO: 133742 - DNA, 802 bp, Homo sapiens
  misc_feature: GYAE6OF01EKOWM.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccgaggagggacagtcactctcacctgtcgccttaccaacacgtggacgcagtccacgagtcgaccttacactacctaaacgtcggttaccacgaccgaacgtaaccgtaggaaccaacgacccgacccgacgggacctacctactaacgttttaacgtaacggtaaaccaaaaccaaaacaaaccctaccgttacccctaccgggtacccccgtccggtaccccgtaactttccgaccgacgggtcccttaccccggttccgggttacggggacctaaacggtcctccgaccccgttagaacccgtacgttccggtacgttgggtcgtcgaccgtaccgcggtagggacggacggtacgacgtacgtaacttacgttaccgtcgtaccttacgttacttacggtttcgggtgtcgtaccggttggtccgtacggttacggttaccggggtaccgggacgggtaaccgtaacgtcggtaaccggttacccgttaacggttaaccggtaccgtaccgggaccccgttaacgggccccgttacccccggtacccccggttccggttacccgttacccggtttaccccgtttccccgttcccccgtttaaccccccgg

SEQ ID NO: 133743 - DNA, 866 bp, Homo sapiens
  misc_feature: GYAE6OF01AG6MB.17.33.C11.1.454.CMB.1.raw
  modified_base (174)..(174): a, c, t, g, unknown or other
  misc_feature (174)..(174): n is a, c, g, or t
  modified_base (201)..(201): a, c, t, g, unknown or other
  misc_feature (201)..(201): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagacctgtggtgactcaggacgccctnactgactgtcgtccccagggagggacngtcactctcacctgtcgtcttccaaactactggagcctacgtccacctaggtgactttactaataccaaacgtcggttccagctaaacgaaacgtcggaacaacgaccgaaccgtacgggcctactactaatttaagtaacgtaaaccaaaacaaaccaaactacctaccgtacggtaaccccgtcgacccgtacttccgtacgacggtccctccgttccggtcgggggtaacaacggtccgtcgtacccgtcgtacctacgttcgtcgtacggtcgtgacctacggtacccgtaggaccggtaacggtacgggtacgtaacgtaaccgttaacgttaaccgtcgtaccccgtttactttaccgtttagggttttacggggttcgggttacgttccgggttacggtttcgttaccgggttaacgggtttcccgggggtaacccggggttaacggggtaacccgtaacgggttaccggttaacccgggttaacccggtttaaccggtttaaaccggtaacccggtaacccggtaacccccggaacggggttccccgttacccccgggttccccccggtttacccggttaccccgtttaaccccgtttacccgggtttaacccccgtttaccccccttaacccccggttttcccccgttaaccccgg

SEQ ID NO: 133744 - DNA, 836 bp, Homo sapiens
  misc_feature: GYAE6OF01BKHDL.17.33.C11.1.454.CMB.1.raw
  modified_base (160)..(160): a, c, t, g, unknown or other
  misc_feature (160)..(160): n is a, c, g, or t
  modified_base (204)..(204): a, c, t, g, unknown or other
  misc_feature (204)..(204): n is a, c, g, or t
tcagcgtagactagcacgaccggtgctcgatttagagtgagctcgttgggtttggggggcgccaggggtcccttccaatatcagcaccatggcctggactcctctctttctgttcctcctcactttgctcgcccagggtccaattctcagactgtcggtnactcgaggacgccctcactgtactcgtcgtacccgaggaggacngtcactctctacgtgtcgtcttaccaacgacgtcggagcgtacgtacaccgagtcgtactttaactactaacctaacgttcggttaccagacctaacggaaaccgtcggaacaacgccgaaccggacgggtacacgttcttaatttaacgtaacgtaaaccaaaacaacctaaacctaccgtaccggtaccgtacccgtacgtacccgtacttcctacggtcggtacccttacccggttacggtaccgggggtaaccaaacggtcctaccggacctacgtaccgtcgttacggttcgtacggtcgtacgtacgtacggtacggtaacggacggggtacggtacgttacgtacgttaacgttaacttaccgttacctacccgttaacgtttccgttttacggttcggttacggttcgtcgtttacgggtaccgttaacgggtttaccgggaccggggtaaccggggtaaccgggtaaaccgtcgggttaaccgggtacccggttaccggttaacggtttacggacccgtaaccggtacccggtaaccgggtcctacccccggtccccgttaccggtaccttacccggtttccctaccccgggtttaacccctccccgtttcccgttaacccgg

SEQ ID NO: 133745 - DNA, 614 bp, Homo sapiens
  misc_feature: GYAE6OF01EZVN7.17.33.C11.1.454.CMB.1.raw
  modified_base (355)..(355): a, c, t, g, unknown or other
  misc_feature (355)..(355): n is a, c, g, or t
  modified_base (452)..(452): a, c, t, g, unknown or other
  misc_feature (452)..(452): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttccaacactggagcagtcaccagtgcttactataccaaactggttccagacaagaaacctggaacaagccaccgaggactactcgtatttataagtaacaaacaactaaacacctccacggacccctgcccgtattcncgaggcctcccgtaccgttggggacaaacgctacgccctacgacactgtcgtgggtgtacgcacgccgtagacgggacgagctgaactagttactcncgttactcgttacgtttcggtggtgtcgtgtcgtcgttacgttacgggcgacgggacctaaggacgtcgtaccgttcgttaaacggcgtaacggaccgtaaccgggtcctaccggccccccgttcgggttccctacgttccgtccgttcccccgtacccccg

SEQ ID NO: 133746 - DNA, 729 bp, Homo sapiens
  misc_feature: GYAE6OF01CYH15.17.33.C11.1.454.CMB.1.raw
  modified_base (168)..(168): a, c, t, g, unknown or other
  misc_feature (168)..(168): n is a, c, g, or t
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (479)..(479): a, c, t, g, unknown or other
  misc_feature (479)..(479): n is a, c, g, or t
tcagcgtagactagcacgaccggtgctcgatttagagtgagctcgttgggttgggctggcgccaggggtcccttccaatatcagcaccatggcctggactcctctctttctgttcctcctcacttgctgcccagggtccaattctcagactgtggtgactcgaggacnccctcactgacgtgtcgtcccgagggtaggacngtcactcncaccgtgtcgtccttaccaacgacgtggacgctacgtccacgtagtcgtacttacactaacctaacgttcgtaccgagtaaccgaacgtaaaccctggaaccaacgcccgaacccgagggtccctaacgttacctaatttaccgaaacgtaaaccaaaaaccgaaccgtaaaacctccgttacccgtaccggtaacccccctggtaccccgtaacttcccgaccggtacggtccccttcccggtacggggttccggggaactacggtccnccggtaccctagtaacctcgttggtcgttcgggtgtaccgcgacggtcgaggacggacggctacgttcacgttataccgtctaccttcgtactttcggttaggtgtcgtacgttagtccgtacgttacggtcgggacggtacgacgacgtccgtacgttaccgttcgtaacgtcccgacgtacccggaccgtccgccccgttaccccggtctacccgtaccttcccggttcccccgttccccgtcccccg

SEQ ID NO: 133747 - DNA, 746 bp, Homo sapiens
  misc_feature: GYAE6OF01DDTX2.17.33.C11.1.454.CMB.1.raw
  modified_base (714)..(714): a, c, t, g, unknown or other
  misc_feature (714)..(714): n is a, c, g, or t
tcagcgtagactagcacgaccggtgctcgatttagagtgagctcgttgggtttggggctggcgccaggggtcccttcaatatcagcaccatggcctggactcctctctttctgttcctcctcacttgctgcccagggtccaattctcagactgtggtgactcaggagccctcactgactcgtcgtacccagggaggacagtcactctcactgtcgccttaccaactacgtggacgcacgtccaccgtagtcgtactttactaactacccgtaaacgttcgttaccagacaaacgtaaacctaggaacaacgaccgaccggacggactactactaatttaacgtaacgtaacaaaacaaacaaactacctaccgtaccggaaccctcgaccgtacttcctacgccggtcctcccgttcggtacggggactaaacgcgtaccgcccgtagtacctacgttcgtcggtggttcgtacgtcgacgtaccggtacggacgggaacgtcggtacgtaacggtaccttacgtttactaccggtacccttacgttacgttttacgggttagggtgttcggtaccgttggtaccggttcgttacggggtaccgggtacgggtaaccggtaccgtacggtaccggttacggtacccggtttagttaaccggtaccgaccggtaacccggtacggtcccgttcccgtaccccggttcgttacccnccgtttcccgttcccggttccccttaccccgg

SEQ ID NO: 133748 - DNA, 817 bp, Homo sapiens
  misc_feature: GYAE6OF01CMJZN.17.33.C11.1.454.CMB.1.raw
  modified_base (172)..(172): a, c, t, g, unknown or other
  misc_feature (172)..(172): n is a, c, g, or t
  modified_base (666)..(666): a, c, t, g, unknown or other
  misc_feature (666)..(666): n is a, c, g, or t
tcagcgtagactagcacgaccggtgctcgatttagagtgagctcgttgggtttggggctggcgccgaggggtcccttccaatatcagcaccatggcctggactcctcttctttctgttcctcctcacttgctcgcccaggtccaattctcagactgtggtgacctcaggacnccctacactgacgtgtaccgtacccggagggacgggtacacgtccaccgtctacctaccgtgtacgtccttaacccgaaaccgcgtacgggactacgacgtacccgtaaccgtagtccgttaccttaacctactaacctaaacgttcgtaccgacgtacgtaacgtaaccgtacgtaacgaaccgaccgaacccggacggtactaccgtacgtaaactttacgtaaaaccgtaaaccaaaacccgaaactaaaccctaaccgtacccggtaccaacccccggttacgtaccccgtaaacttccgtacgaccggttaccccgttccccggttaccggtaacgggggtacctaaacgccgtaccgtacccgtacgaaccgtacggttccgttacggtggttacgcgacggtcgtaccgtacgggtacggacggacgttctaacgttaccgttactaccgtccttaccgtacgtttccgttaagtttcggtacggtntcgttacgtacgtacgttcgggtacgacgggtaacgacgaacgtccgtacgttaacccgtgtaacggtaccgacggtaacgccggttacccgtccccgttacccggttccgtaccgtccgtttacccccggtcccttcccccggttccccg

SEQ ID NO: 133749 - DNA, 672 bp, Homo sapiens
  misc_feature: GYAE6OF01CRVRE.17.33.C11.1.454.CMB.1.raw
  modified_base (308)..(308): a, c, t, g, unknown or other
  misc_feature (308)..(308): n is a, c, g, or t
  modified_base (408)..(408): a, c, t, g, unknown or other
  misc_feature (408)..(408): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgacctgtgtccccagggagggacagtcactctcacctgtgcttccaacactggagcagtcaccagtcgcttactatccaaactggttcagtcagtaaacctggacaagccacccgaggccacgtacatttanagtaacaaactaaacaaacacttaccgtacgacccctcgaccccgtactctcacggtcctcccttcccggtacggggcctaaacgctccgtcctcgaccncgttacgtcgtggtcgtcgtacgacgtccgtagtaacgggacggtagggaccgttacggacttacgttacgttcgtacccgttactttaccgttacgttttagggttcgttggtaccgttgttacgtaccgttacggttccgggacgggtaccgggaccgtaacggtcgtacggtaccttacggttaacgttaccgtaggacccgtaacgcgtccgtcccccgttaccgttacgcccttacgttcccgttccccggttaccccg

SEQ ID NO: 133750 - DNA, 790 bp, Homo sapiens
  misc_feature: GYAE6OF01C1NBV.17.33.C11.1.454.CMB.1.raw
  modified_base (777)..(777): a, c, t, g, unknown or other
  misc_feature (777)..(777): n is a, c, g, or t
tcagcgtagactagcacgaccggtgctcgatttagagtgagctcgttgggtttggggggcgccaggggtcccttccaatatcagcaccatggcctggactcctctctttctgtcctcctcacttgctgcccagggtcctaattctcagacctggtggtgactcaggtacgccctcactgactgtcgtccccgaggagggactagtcactctctacctgtcgtacttaccaacaaccgtggagcctaaggtaccaaccgtacggttgtccttaactacgttaccaaagttcggttaccagtacaacgaacctggaaccaacgaccgaacccgagggactacgtactattttaacgtaaagaacctaaaacctaaacaaaaccgtaccttacccgtaccggtaaaccccctccgtccccgtaacgttcctacccggtacggtcccctttccggtaccccgggtttacggggaacgtaaaaccgtcgttaccggtcccttacggaccgttacgtttccggttcggttcggtccgtaacgccggtcgtaccccggtaggaaccgggtacgacgggtacctcgggttaaacttaccgttaccgttccggtacccgttaccgtttaccgtttacgggtttcgggttcgggtactccgggttcggttccgttacgttaacggttcggggacggtacggtaacgtacgtaccgtcgtacgttacgtacggacaccgaccgtacgccgtccgtaccccgtcgctacccttcttacccggtaccccncccttacgtcccg

SEQ ID NO: 133751 - DNA, 776 bp, Homo sapiens
  misc_feature: GYAE6OF01ADEB5.17.33.C11.1.454.CMB.1.raw
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
  modified_base (440)..(440): a, c, t, g, unknown or other
  misc_feature (440)..(440): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagacgtgtggtgactacgaggacgtcccctcactcgacgttggtccgtaccccgagggacgggacctacgtccgtaccttctaccgacccgttcggttaccggtaccttacccgtaaacctacgtacggtacgaccgtacgttacccgaccgtacgttcgtacctttacgtacctaacctaacggtcgttaccacgcaaacgaaccgtgacgacaccgaccgnggaccactctatttaanaactaaccgaaacaaacctacctaccgtcccgtacgacccgtccgacccgtnttacctacgtacgtcccgtcccgtcgggtaacgggacaaccgtcgtccaccgtactaccgtaccgttgtccgtgtacgcgcgtaccgtcgtacggacggtacggtacgacgttagaactttacgtcctacgtaccctgttaccggtttcgtgggttacgtagttccgtaggttccgtacggttaaccggtcgggtaaccggggtaccgacctagggtaccccgttacggtaccgttaccggtacgttacccggacccggtacggaccggtcccccggtaacccgtccgttaccccgaccgtttaccgttacccctaccccgtttccctccccccgg

SEQ ID NO: 133752 - DNA, 729 bp, Homo sapiens
  misc_feature: GYAE6OF01AVVCV.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccgaacacgtggagcagtccaccagtgacttactactaccaaacgtcgttaccagcagaaacctggacaaggccaccgaggccactctatttactaagtaaaacaaaaacaaacgacctaccgtacgaccccttgacccgtacttccaccgtacggcccttaccccgttccggttacggggggaacctaaaacggccgttaccggtaccccgtcggaacctaaccgtttcggtcggttgggttcggtacggtaccgtaacggtcccggttacgggaacgggtacggtacggtaccgttacgtaaccgtttaacttaccgttcgtacccgttacttccgttaagtttcggttggtcgtacgtgtacgtacgttacgttcgggacgggaacggtacccgaagtcgtacggtaccgttacttaacggtccaccggtacaccgggtccttaccccggtcccccgttacggtaccctaccgttcccgtttaccgttcccccgtaacccttccccg

SEQ ID NO: 133753 - DNA, 693 bp, Homo sapiens
  misc_feature: GYAE6OF01DV04R.17.33.C11.1.454.CMB.1.raw
  modified_base (209)..(209): a, c, t, g, unknown or other
  misc_feature (209)..(209): n is a, c, g, or t
tcagcgtagactagcacgaccggtgctcgatttagagtgagctcggttgggttggggctggcgccaggggtccctcaatatcagcaccatggcctggactcctctctttctgttccctcctcacttgctgcccgagggtacctaattctacagactggttgggtgactcgaggactccctcacttgactgtcgtacccgagggaggacngtcactctcactgtcgcttaccaacgtcgtgacgcacgtcaacgtagtgtaccttactactaccaagttcggtaccagtacaacgtaaacctaggaacaacgaccgaacccgagggtacaacgttacgtaaattaacgtaacgtaaacaaaacaaacctaaactacctaccgtaccgtaacccgtccgtaaccgtacttaccgtacgacggttccctacccggttacggtacgggggaactaaaccgtcggtcccgtacccggtacgtacgtaacgttcgtcggtaggttacggtaccgacggtacgtaccgtagggtaacggacggtacgacgtataaccgttatacgtccgtaccttacgttacttacgtttggtcgtgtacgtgtgtacggtagtcgggacgagacgacgcgtacgtaccgtacgtagacgaccacgtacgccgtccgtaccccgtgtaccacttccgtcctcccgtaccc

SEQ ID NO: 133754 - DNA, 860 bp, Homo sapiens
  misc_feature: GYAE6OF01AK416.17.33.C11.1.454.CMB.1.raw
tcagcgtagactagcacgaccggtgctcgatttagagtgagctcgttgggtttgggctggcgccagggtcccttcaatatcagcaccatggcctggactcctctctttctgttcctcctcactgctgcccagggtcaattctcagactgtggtgactcgaggacgccctcactgactgtcgtcccgagggaggacaggtcactctcacctgtcgaccttaccaactacgtggactccgagtccaccgagttcgtaccttaactactacccgtaaaacgttcggttaccacgtactaacgaaaccgtaggaaccaacgcccgaaccccggacggggacctaaccttacgtaactttaacgtaaccggtaaaccaaaacctaaaccaaacccgtacctaccccgttaaccgggtaccccctacgtaccccgtaactttaccctccggaacccgtcccgttacccccgtttaccgggttacgggggaacctaaacccggtcgttacccggttaccccgtaacgtacccgtacttaccggttcggttacggttcggtacgacgtaccgtccggtaacgacggtacggacgtaccgttacgttaaccgttagttcgtacctaccgttaacttccggtttacggttggtaccgttggtcgttacggttacgtccggttaacgggttccggggacggtaacccgggtaagtaaccgggtcttaacccgggttccgtttaaacggttaaccggtaccgtaaccggtaccccggtaaccggttcccccggtaccggttaaccccccgtcggttaaccccttaccgggtttcccccgttaaccccgggttttccccccgtaaacccccgg

SEQ ID NO: 133755 - DNA, 649 bp, Homo sapiens
  misc_feature: GYAE6OF01EV9A9.17.33.C11.1.454.CMB.1.raw
tcagcgtagactagcacgaccggtgctcgatttagagtgagctcggttgggtttggggggggcgccagggggtcccttccaatatcagcaccatggcctggactcctctctttctgttcctcctcacttgctgcccagggtccaattctcagactgtggtgactcgaggacgccctcactgactggtcgtccccgagggaggacagtcactctcacctgtcgccttaccaacacgtggacgcacgtcaaccagtcgtcttactactacctaaacgtcggtccaagacaacggaaaccgtggaacaacgccaaccgacgggactactactaatttaactaacgtaaacaaaaccaaaccaaacctacctaccgaccggtacccctcggacccgtacttaccacgtaccggtccctacccggttccggtacggggacctaaaccgtcgtccgcccgtacgtactacgttcgtcgtggtcgtgcgacgtccgtaggacggacgacgtctacgtaacttactacgtcgtccttacgttcgttacggttggtgtctcgtgtcgtacgtggtcggacggacgacgacgcgtcgtacgtactacgcgacgccgagccgtcccgccgtctactactccgtacctccctcctcctacg

SEQ ID NO: 133756 - DNA, 809 bp, Homo sapiens
  misc_feature: GYAE6OF01CYA9E.17.33.C11.1.454.CMB.1.raw
tcagcgtagactagcacgaccggtgctcgatttagagtgagctcgttgggtttgggctggcgccaggggtcccttcaatatcagcacatggcctggactctctctttctgttcctcctctacttgctcgcccgtagggtccaattctcgaagctggtggtgacctcgaggacgccctcactgactgtcgtcccgaggagggacagtcactcctcaccgtgtacgtccttaccaacgtacgtggacgccacggttaccaccgtagttcgtacctttaacctaactacccttaaaacgttcggttaacccaaggaccaaacggaaaacccgttaggaaacccgaacggacccgaacccccggtacgggacctaaaccgtttcctaaaacgttttaacgtaacgtaaaaaccgaaaaaccctaaaacgaaaaaccctacccgttaccccgaaccgggtaacccccttcggtaccccgtaacttccgtaccgtaacggtccccgttacccggtaccggttacggggaaccgtaaacggtccgttcgaaccccgtggtacctacggtgttactgggtcgtcgacgtacgtcgtacggacggacgtgcgtacgtacgttacttacgtcttacctacgttacgtttcgtttagggtcgttcggtcgttggtcgttacggttacggtcgggtaacgggtacgggtactaacgggtccgtacggtaaccgttacgtaaccggtaccgtacgacccggtaacgtcccgtccggtacccccgtcggtacctccgttacccgttcccgtccccgttcccgg

SEQ ID NO: 133757 - DNA, 829 bp, Homo sapiens
  misc_feature: GYAE6OF01EE5WB.17.33.C11.1.454.CMB.1.raw
  modified_base (172)..(172): a, c, t, g, unknown or other
  misc_feature (172)..(172): n is a, c, g, or t
  modified_base (197)..(197): a, c, t, g, unknown or other
  misc_feature (197)..(197): n is a, c, g, or t
tcagcgtagactagcacgaccggtgctcgatttagagtgagctcgttgggtttggggggcgccaggggtcccttccaatatcagcaccatggcctggactcctctctttctgttcctctcacttgctgcccagggtccaattctcaggactgtggtgactcaggacgccctnacgtgactgtcgtcccgaggagganagtcactctcacctgtgcctacaactacgtggacgcagtccacctagtcgtacttacttactccctaaacgttcggttaccagaccgaaagtaacccgtacggaacaacgacctaaccccgaagggtcctaaccgtctaagttttaagtaaacgttaaaccaaaaaccaacctaaaaccgtaacctcccgtccggtaacccctcgtacccgtacttcctaccgacggtcccgttaccccgttccgggtacggggggtaacctaaacggccgttaaccggtcccccgtaggtaaccctaaccgggtttcggttaccggtttagggttccgttacggaccggtaccggtacggttacgggaacgggtaacggtaacggtccggttacgtaccgtttaactttacccgtaccgttacccggtttacctttacgggtttacgttttcggggttggttacggttcgttgttccggttacgttaccggttaccggggtcggtaacggggaacctaacggtccgtacggtaccgttacgttacgtacgtaccgtaccggaaccgtccgtccccgttacccccgtccgtacccgtaccgttccccttcccggttacccccgtccccgttacccgttcccg

SEQ ID NO: 133758 - DNA, 742 bp, Homo sapiens
  misc_feature: GYAE6OF01BZ154.17.33.C11.1.454.CMB.1.raw
  modified_base (239)..(239): a, c, t, g, unknown or other
  misc_feature (239)..(239): n is a, c, g, or t
  modified_base (502)..(502): a, c, t, g, unknown or other
  misc_feature (502)..(502): n is a, c, g, or t
  modified_base (580)..(580): a, c, t, g, unknown or other
  misc_feature (580)..(580): n is a, c, g, or t
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactggtggtgactcaggacgccctcactgactgtcgtccccgagggagggacagtccactctcaccgtgtcgacttaccaacactggacncagtaccaccagtgacttactactaccaaacgttcggttaccagccgaaacgtaacctcggaacaacgaccacccgagggcctactacttaagtttaacgtaacgtaaaccaaaaccaaaccaaactaaccgttcccggtaccggtaccccctacggaccccgttacttccctacggtacccggtccgttaccccgttccgggtacggggaactaaacgtccgtacgtaccctacgacttacgtgttccgtgggtgtcggacncgtacgtagggacgcggacgtgtaacgtacttacgtacgtctaccttacgttacgttaggttggttgtcgtgttcggntaccggttacggtccgggtacgggaacggtaccgacgtaccgtcggtaaccgttaacggttcgaacgacccggtaacctaccggggttcctaccccgggtcccgtaccgttacccgtactttccccgttacccgttcccccttacccgttccccgttaacgg

SEQ ID NO: 133759 - DNA, 773 bp, Homo sapiens
  misc_feature: GYAE6OF01DGQFS.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcgaggacgccctcactgactgtcgtccccgaggacgggacagtccactcgtcacctgtcgccttaccaactaccgtggacgctacgtaccacctaagtcgtacttaacgtactacccgtaaaagttcggttacccaaggtaccaaacgtaaaacccgtacggaaacctaaacggacccgaaccccggaaggggtacctacccgttacgttaatttttaacgtaaaacggtaaacctaaaaacctaaaccaaaaccctaccgttacccgtaccggtaacccccttacggtaccccgtacttacccgtaccgaacggtccttcccggttaccgggttacggggggaaccctaaacggccttaaccggtccccgtacggtaaccctcgtttacggttcggttggttgtacggcgtaacgtccgtagggaagtcggacgtcgtagtaacttagtaccttcgtacctttaccgttcgttacgttttggtcgtgtcgttcgtcgtcgttacggtcgggacgggaacgtaccgaggtccgtacgtaaccgttactacgttacacggtaccgacgtccgtcccgtaccgtcgacctcgtcctccgtccctccgttcgtaccg

SEQ ID NO: 133760 - DNA, 1040 bp, Homo sapiens
  misc_feature: GYAE6OF01BFY8M.17.33.C11.1.454.CMB.1.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (521)..(521): a, c, t, g, unknown or other
  misc_feature (521)..(521): n is a, c, g, or t
tcagcgtagactagcacgaccggtgctcgatttagagtgagctcgttggggttgggggcgccaggggtcccttccaatatcagcaccatggcctggactcctctctttctgttcctctcacttgctgcccagggtccaattctcagactgtggtgactcgaggacgccctcgactgactggtcgtccccgagggaggtacngtcacctctacacctggtntccttaccaactacgtggagccaagtccgaccagtcgactttacgtactaccgtaaaacgtggttacccagaccgtaacgtaaaccggtacgaaccgaacgacccgaacccccggagggtacctaacgttaacttacgttttaaacggtaactaaaaccgtaaaaacctaaaccaaaaccgttaacccttaccccggttaccggaaccccccgttaggtacccccgttaacgtttccgtaacccgaaccggttccccttccccggtttacccgggttaacggggggaaaccctttaaaccncccgggttccggtaaccccttacgggtaaccccgtacgtttccgggttcgttacggggtttgtaacccgtacccggtcgggtaacccgttacggggaacggggttaccgggaacggtttcccgttaaaggtaaccctttaaccggttacttacccgggttaccctttaaccgggtttccgtttaacgggtttggggttccggtttagtccggggttttacggtaccgggtttaaccgtttacggtaacccgggggggttaccgggaaaccggttaaaccggaccggggtttacccggtaaacccgggtttcccgggttttaaaaccgttaacccggggttaaacccgtaaccgggggttaaccccccccgttaagggggttaaccccccccgggtttccccggtcccccccgggggttttaaacccggttaccccggttaaccccggttttttccccggtttaaaacccccgggtttcccccccctttaaaccccgggttcccctttttaaccccgggg

SEQ ID NO: 133761 - DNA, 844 bp, Homo sapiens
  misc_feature: GYAE6OF01B39ZO.17.33.C11.1.454.CMB.1.raw
  modified_base (158)..(158): a, c, t, g, unknown or other
  misc_feature (158)..(158): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtnactcaggacgccctcactgactgtcgtcccgagggacgggacagtctacttctccacctggtctcttaccaacgacgtgggatcacgtacaaccgtgtcgtacttaactactaccgtaaacgttcggttaccaacggtaccgaacggtaaaccgtacggaacaaaccgcctaacccggaagggtacctaacttacctaattttaacgtaaacgtaaaccaaaaaccaaacctaaaccgtacccgttacccgtaccggtacccccgtacggtaccccgttaaccgttaccgacccgtacggtcccccgttcccggttaccgggttacggggggaactaaaccgtcgtcccggtaccgtacgtacgtacgtttccgtggttacggttcggtcgacgtacgtcgggtaggtacggacggtacggtacctacggtaactttacggtacctccggttacccttactttccggtttacggtttcgggtcgttacggtcgttacgtccggtttaacgttaccgggtacggggtaccggggtaacgaccgtaacggtaccgttaccggttaacgttacgttaccgaccggtaacccgaccgggtacccgtcccggttcccgttccccggtccggttacccttcccgttaccccgggttacccgttcccccgttcccgtttcccgttaacccggg

SEQ ID NO: 133762 - DNA, 615 bp, Homo sapiens
  misc_feature: GYAE6OF01A21R5.17.33.C11.1.454.CMB.1.raw
  modified_base (160)..(160): a, c, t, g, unknown or other
  misc_feature (160)..(160): n is a, c, g, or t
  modified_base (438)..(438): a, c, t, g, unknown or other
  misc_feature (438)..(438): n is a, c, g, or t
tcagcgtagactagcacgaccggtgctcgatttagagtgagctcggttgggttgggggcgccaggggtcccttccaatatcagcaccatggcctggactcctctctttctgttcctcctcacttgctgcccagggtccaattctcagactgtggtgactnaggagccctcactgactgtgtccccagggagggacagtcactctcacctgtgcttccaacactggagcagtcaccagtcgtcttaactactaccaaaacgttggttaccagaccgaacgaaaaccgtggaacaacgacccaccgaggccactctatttataacgtaacaaacaacaaacactcctcggacccctgccgtatctacgcgtcctcctcggtgggactaagctcgcctgactcgtgtctcgaggtcacgtgaccgtgacggacggtgactntacgtacttcgtacgtccttacgtcgtttcggttggtggttcgtctggtacgtcttacgggtggtacgggaacggtacaagggtccgtaacgtccggtattaacgcctaccggtacacggtccgttccgaccccgttcggacctccggtttctcgttccccctacgtcccgtacccg

SEQ ID NO: 133763 - DNA, 829 bp, Homo sapiens
  misc_feature: GYAE6OF01B24HI.17.33.C11.1.454.CMB.1.raw
  modified_base (161)..(161): a, c, t, g, unknown or other
  misc_feature (161)..(161): n is a, c, g, or t
tcagcgtagactagcacgaccggtgctcgatttagagtgagctcgttgggtttggggctggcgccaggggtcccttccaatatcagcaccatggcctggactcctctcttttctgttccctcctcacttgctgcccagggtccaattctcagactgtggtnactcgaggacgccctcactgactgtcgtccccgagggacggacgagtcactctaccgacctgtcgtccttacccaactacgtaggacgactacgtcaccgtagtcgtacttaactactaacctaaacgtcggttaccacgacgaaactaaaccggtacggaaccaaccgaccgtaccccggaagggacctaaccttagttaaactttaataaaccggtaaacccaaaacgaaaacctaaaaccgtaccgtaaccccgttaccggaacccccgttaccggtacccctaactttcccgtaaccggtacccggtacccttacccccgggtttaccggggtaccggggtaaaaccgtaaccgtacccgttaccggtacccgtacgtaaccgtaccgttacgggtttaccgtcgggttcgtacgtaccgtacgtaccgggtacgggaaccgggtacgacggtaccgtaacgtaacgttacctacgttacgtcccttaccgttacgttacggtttgggttaccggtggtcttcggtacgttacggttacggtccggggtacgggaacggtaccgtacgtaccggtacggttaccttaaccggttaacgtccgaacggaccgtacgtccgtacccgtcccgtacttcctaccgttccgtcccgttccccgtcccg

SEQ ID NO: 133764 - DNA, 732 bp, Homo sapiens
  misc_feature: GYAE6OF01ASLWY.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccgaggagggacagtcactctcacctgtcgcttaccaactacgtggagcacgtcaccgtagtcgtacctttactactacctaaacgtcggttaccagacaacgaaacctgggaacaacgacccaacccggacgggacctaacctacttaactttacgtaacgtaaaccaaaacctaaacaaacctactacccgtaccggtaccccctacgacccgtacttccgtacgacggtcccttcccgttacgggttaccggggaacaaacggtccgtaccgacccgtacgacctacgttcgtcgtacgggtcgtcgtaccgtcgaccgtagggacgggacgtacggacttagtacgttattaccgtcgtaccttacttccgtttacggttcggttcggtcgtcgttcgtcgtacgttaccgggtcgggacgggaacggaccgtaacgtcgtacggtaccgttacgttaacgtccgaccggaccgtacggtcccgtaccccgtccccggttacggtacctacccgttccggttccccgtccccgttaccccg

SEQ ID NO: 133765 - DNA, 732 bp, Homo sapiens
  misc_feature: GYAE6OF01CVC2Y.17.33.C11.1.454.CMB.1.raw
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (324)..(324): a, c, t, g, unknown or other
  misc_feature (324)..(324): n is a, c, g, or t
tcagcgtagactagcacgaccggtgctcgatttagagtgagctcggttgggtttgggctggcgccagggtcccttcaatatcagcaccatggcctggactcctctctttctgttcctcctcacttgctgccaggtccaatctcagctgtgtgactcgaggacncctnactgactgtcgaccgaggaggactgtcactctcacgttgcncttccaaacncgtagggacacgacgtacaccgaaggttcaccttactactacctaaacgtcggttaccagacaaacgaacctaggaacaacgccaccgaggacaactataagttanaacgaaacaaacgaaaccaactacctaccgacgaccccagtaccgtattccgacgacgccttaccgtacggtggggaaccaacgctccggtccacgaacgtccgtagtccgtgtcgtacggacaacggtccgaggaacgggacgtaacgggtacctaggtaaccttaacgtttaccggactaaccccggtttatttacccgttaagggtttttacgggtaccgggtttgtaaccgtttaggggttccttaacgggttaccgggttacggggaacgggtaaccggttaccgaaaggtccgtttaaccggaccggttttaacctaacgggactaacccggtacggaaccgtccggtaccgttacccccgtcgtaaaccttcccgtaccgttacccgtccccttaaacccg

SEQ ID NO: 133766 - DNA, 683 bp, Homo sapiens
  misc_feature: GYAE6OF01AYPOA.17.33.C11.1.454.CMB.1.raw
  modified_base (174)..(174): a, c, t, g, unknown or other
  misc_feature (174)..(174): n is a, c, g, or t
  modified_base (181)..(181): a, c, t, g, unknown or other
  misc_feature (181)..(181): n is a, c, g, or t
  modified_base (255)..(255): a, c, t, g, unknown or other
  misc_feature (255)..(255): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (534)..(534): a, c, t, g, unknown or other
  misc_feature (534)..(534): n is a, c, g, or t
  modified_base (572)..(572): a, c, t, g, unknown or other
  misc_feature (572)..(572): n is a, c, g, or t
  modified_base (586)..(586): a, c, t, g, unknown or other
  misc_feature (586)..(586): n is a, c, g, or t
  modified_base (594)..(594): a, c, t, g, unknown or other
  misc_feature (594)..(594): n is a, c, g, or t
  modified_base (616)..(616): a, c, t, g, unknown or other
  misc_feature (616)..(616): n is a, c, g, or t
tcagcgtagactagcacgaccggtgctcgatttagagtgagctcgttgggtttggggctggcgccaggggtcccttcaatatcagcaccatggcctggactcctctctttctgttcctcctcacttgctgcccgtagggtccaattctcagtactggtggtgactcgagggacncccttanacgtgacttgtcgtcccgagggaggacagtcactctcaccgtgtctcctacacagtggacgacagtccaaccgnggtctacttaactacgtaacctaagtcgtaccgaanacgaacgtaacncggaacacgtaccgacggtacggactaccgtnttaacgtttaacaaanaaaccaaaacctaaacaacccgtcctacccggtacgtaccccgtacggtacctacgtttaccgccgtaacgttccccgtttaaccgggtcggtacgggaacctacggtccgttaccgcccttacgaccgttccgttggttccggtggttacgacgtcgaaccggttggaccgggaagggtacncgtaacggtacttacgtctaacgtcgtccttacgtttntcggttgagttctntgtacgtntacgggcggacgagtctgtacncgtacgattcgcaccgtagctccggcccttcccgtagtcccgtactttaccctcccgtcccttaccg

SEQ ID NO: 133767 - DNA, 825 bp, Homo sapiens
  misc_feature: GYAE6OF01AIEY8.17.33.C11.1.454.CMB.1.raw
tcagcgtagactagcacgaccggtgctcgatttagagtgagctcggtttggggtttgggggctggccgccgacggggtcccttccaactatcagcaccagtggcctggactcctctctttctgttcctctcacttgctcgcccgagggtccaattcctcgtagacttggtggtacgacgtcgaagggacgccctcgactgactgtccgtcccgagggagggacacgttcgactcctaccgtaccgtcggtcgtacctttaccaacgtaccgttagggacgcgtacgtaccgtaccgtaggtcgtacctttaacgtaacgtaccctaaaacgttcggttacccacgacgtaacggaaaccgtggaaccgaacgaccgaccggacgggaccaaccggttacttaacgtttaacgtaaacggtaaaccaaaaccgtaaaaccaaaacctaccttaccccggtaccggaacccccgtacggtacccggtacttactaccgacggtccccttcccggtacccggttaacgggggaccaaacggtcctacggcccgtactccggtaccgttggtcgtacgggttcgtccggtacgaccgtcggtacggtacgggacggtacggtccgtaattaccgtacgttaacgttccggacccttacgttaacggttcggtttaggtcgtacggttcgtcgtagtcgttacgtccggggtagggaacgacgtacgtcggtaccgtacttacggtacgccgtaaccggtacccgtacggtcccgtacccggcccggttaccgtcgttaccctccgtttaccccgccccgtttaaccccg

SEQ ID NO: 133768 - DNA, 670 bp, Homo sapiens
  misc_feature: GYAE6OF01EIZN2.17.33.C11.1.454.CMB.1.raw
tcagcgtagactagcacgaccggtgctcgatttagagtgagctcgttggggtttgggggggcgccaggggtcccttccaatatcagcaccatggcctggactcctctctttctgttcctcctcacttgctgcccagggtccaattctcagactggtggtgactcgaggacgccctcactgacttgtcgtccccgagggagggacagtcactctcacgtgtcgcttaccaacacgtggagcagtccaccagtcgtcttactactaccaaacgtcgtacacgacaacgaaccgagaacaacgaccgaccgacggactactactaatttaacgtaacgaaacaaaaccaaacaacctaccgtaccgtaccgtaccctcgtaccgtacttacctacgacgtcctccgtacggtacgggaactacgtctaccgtccgtacgactacgtcggtcgtggtcgcgacgtacgtcgaggacgggacgagtacgtactaacttacgtacgtacgtaccgttacgttcgttacggttggtcgtcgtcgtggtacgtacgttacggtcgggacgggtaacgtacgtacgtaccgttacgtacgtacgttaacgaccgtaccgaccgcgtccgtcccgtcccgttacgtcctccgttaccgttccctccccgtccctcgtccg

SEQ ID NO: 133769 - DNA, 814 bp, Homo sapiens
  misc_feature: GYAE6OF01C6DRK.17.33.C11.1.454.CMB.1.raw
  modified_base (178)..(178): a, c, t, g, unknown or other
  misc_feature (178)..(178): n is a, c, g, or t
  modified_base (237)..(237): a, c, t, g, unknown or other
  misc_feature (237)..(237): n is a, c, g, or t
tcagcgtagactagcacgaccggtgctcgatttagagtgagctcggttgggtttgggctggcgccaggggtcccttcaatatcagcaccatggcctggactcctctctttctgttcctcctcacttgctcgcccgagggtccaattctcgagtactggtgggtacgactcgaggaccnccctcactagactgtccgtacccgagggaggacagtcactcctcacctgtctctccaancgtaggagctacgcaccgtagtacgtacttaccagtaaccaacgttcggtaccaagtaccaacgtaaacgtgaacaacgccaaccgcggactactactaattagaacgtaaccaaaacgaacaaactccttccgtaccgaaccctcggtaccctaactcgaaccgtccggtccctccggttacggggtaacgggactaacgcgtaccgtaccgacgaaacgttcccgttggtaaccgttgggttaccgacggtaccaccgggttccggtaacggtaacggggtaacccgtcggggttaaacctacggttaacgtttaccggttaacccgttaaccgggttccctaaccgttttacccggtttaaggtttcgggtcgggttacgtcggttcggttaccgttagttaccgggtacggggacggttaaccgggacctaacggtaccgggttaccaaccgggtttcgtaacgaacccggttaccggaacccggtacccgggttccctcccccggggttaacccttccgggttaccctttaaccccgggtttccctacccccgttacccccgtttaaccccg

SEQ ID NO: 133770 - DNA, 740 bp, Homo sapiens
  misc_feature: GYAE6OF01BQH1C.17.33.C11.1.454.CMB.1.raw
  modified_base (241)..(241): a, c, t, g, unknown or other
  misc_feature (241)..(241): n is a, c, g, or t
tcagcgtagactagcacgaccggtgctcgatttagagtgagctcgttggggtttggggggcgccaggggtcccttccaatatcagcaccatggcctggactcctctcttctgttcctcctcacttgctgcccagggtccaattctcagactgtggtgactcaggacgccctcactgacttgtcgtcccagggacgggactagtccactccgtctaccgtgtcgtcttaccaacacgtgganacgcgtaccaccgtgtacgtcttaactactaccgtaacgttcgtaccacgaccgaacgaacgacgaacacgaccgacgacgtactactactattacgacaaacaaacaacctaacctacctaccgtaccgtacccacgtaccgtactaccgtaccgccggttcccgtacccggtaccggtacgggaacctaccgtccgtacccgaccgtacgtaccgtcgtcgttacgtggtacgacgacgtacggtacggtacggaacggtacgtacgtactaacgtacgtacgttactaccgtaccttacggttacgttcggttggtggttcgtagttacggtacgtacggttaccgggtacggggtacggtacggtaacggtcgtaccggttaccggtaccgttacgtaccggaccgtcccggtacccggtaccgtcccgtccccggtacccgtcgtacccgtcccgttacccgttaccccgttccccgtcccgttcccggtaccg

SEQ ID NO: 133771 - DNA, 173 bp, Homo sapiens
  misc_feature: GYAE6OF01C29R6.17.33.C11.1.454.CMB.1.raw
  modified_base (120)..(120): a, c, t, g, unknown or other
  misc_feature (120)..(120): n is a, c, g, or t
  modified_base (124)..(124): a, c, t, g, unknown or other
  misc_feature (124)..(124): n is a, c, g, or t
  modified_base (143)..(143): a, c, t, g, unknown or other
  misc_feature (143)..(143): n is a, c, g, or t
  modified_base (145)..(173): a, c, t, g, unknown or other
  misc_feature (145)..(173): n is a, c, g, or t
tcagcgtagactagcacgaccggtgctcgatttagagtgagctcgttgggtttggggctggcgccgaggggtcccttccaatatcagcaccatggcctggactcctctctttctgttccnctcncttgctgcccaggtcattngnnnnnnnnnnnnnnnnnnnnnnnnnnnnn

SEQ ID NO: 133772 - DNA, 816 bp, Homo sapiens
  misc_feature: GYAE6OF01AYG8H.17.33.C11.1.454.CMB.1.raw
  modified_base (675)..(675): a, c, t, g, unknown or other
  misc_feature (675)..(675): n is a, c, g, or t
  modified_base (684)..(684): a, c, t, g, unknown or other
  misc_feature (684)..(684): n is a, c, g, or t
  modified_base (752)..(752): a, c, t, g, unknown or other
  misc_feature (752)..(752): n is a, c, g, or t
  modified_base (786)..(786): a, c, t, g, unknown or other
  misc_feature (786)..(786): n is a, c, g, or t
tcagcgtagactagcacgaccggtgctcgatttagagtgagctcggttgggtttggggctggcgccgaggggtcccttcaatatcagcaccatggcctgactcctctctttctgttcctcctcacttgctcgccagggtaccaattctcgagactggtcggtgactcgaggacgtcccttagacgtcgacttggtcgtacccgagggacgggtactacgtacgtacgtcttacgtaccttggtcgtaccttacccgaaacgtacgtggaacgaccgtaacgtcctaaccgtaggttacgtaccgtttaacgttacctaaccgtaaacgttccggttaacgaacgtaaccgtaaacgtaaaccgtacggtaaccaaacggacccgaaccccggtaagggtcctaaccgttacgtaatttaaccgaacgtaaaaccgaaactaaaaccggtaacctaccgttacgacccggtaccttaccggtacccgtaattccggtacgaccggtaccctacccgggttacggtacgggtaataacgccgttcgacccgtagaccgttacgtaggtccggtagtaccggtcgaccttacggacgttaggaacggtacggtaagaccttagtaaaccttgttaaccgcgttacttaaacgttcgttaacggtttcgtacgtacgtntaacgggtntacgttacggtacgacggtacgtaccaggtcctacggtaaaccgttaggttacgaccgaccgggtacncccggttacgtaccccgtaccgtcggtttacccnccgttacccggtttccgcccgttaccccgg

SEQ ID NO: 133773 - DNA, 785 bp, Homo sapiens
  misc_feature: GYAE6OF01DG6HQ.17.33.C11.1.454.CMB.1.raw
  modified_base (181)..(181): a, c, t, g, unknown or other
  misc_feature (181)..(181): n is a, c, g, or t
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
tcagcgtagactagcacgaccggtgctcgatttagagtgagctcgttggggtttggggctggcgccgaggggttcccttccaatatcagcaccatggcctggactcctctctttctgttcctcctcacttgctgcccagggtccaattctcagtactggtggtgactcgaggtacgccctnactgactggtccgtcccgagggaggacngtcacgtccncaccgttgtcctccttaccanacggtaggacgcaacgtccaaccgttgtctaccttactacgaaccgtaacgtttccggtaccaagaccgaacgtaaccgtaggaaccacgtacgaccggaggtaccacgttactatttaacaaacgtaaccaaacgtaacaaaccgtcctaccggtacccgacccgtccgaccgttattccgacgtaccgtccttccggttaccgggtaggggaactacggtcctcgtacccgtagtaaccgtggtttcgttacggtggtacgggtagccggtacgtaccgggtagaaccgggtacggttacgcttaacggtcctttacttacccgtaccgtttacctacggtttctttacgggttacgggttcgggtacttcggttcgttaccggtacggtttagggcccgggttaagggaccggtacttaacgggtactaccgggttaccgttagttaccgacccggtacggtaacccgtcccgggaccccgttcccgttccccggtacggtaccccttcccggtaaccctttccccggtacccccttacccg

SEQ ID NO: 133774 - DNA, 874 bp, Homo sapiens
  misc_feature: GYAE6OF01CO2Q0.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccgagggagggacacgtcactctcacctgtcgccttaccaacacgtggacgcagtccaccagtcgtacttacctataccctaaacgtggttccagacaagaaaccgtaggaacaacgaccacccgagggaccacgtctaatttactaacgtaaccaaaaccaaacaaacaaccttcctaccggaccccctcgaccccgtacttcctacgcggtcccttcccgtcccggtacgggggactaaaacggtcctccggtaccccgtgtacctaaccgtcggttcgtacgggttggtcggaccgtacggtccgtagggtacgggaaacgggtacgggtcgttaacggtaccgtttacgttaaccttccggtaacccgtttccgtttaaccgttttcgggttttacgggttcgggttcgtaccgtttcggtacgtttaccgggtttggtttaacccgggggacggggttaaacccggggtaaccgtaaccggggtccgtttaacccggggttaacccccgggttttaacgtttaaaacccggggtacccgtaaccccgggttaccccggggttaaacccggaccccgggtttaccccccggttacccccccgggttacccggggtttacccccttaacccggtttcccccggtttacccccggttaccccccccgtttttaacccccccccgg

SEQ ID NO: 133775 - DNA, 670 bp, Homo sapiens
  misc_feature: GYAE6OF01E3JBY.17.33.C11.1.454.CMB.1.raw
  modified_base (169)..(169): a, c, t, g, unknown or other
  misc_feature (169)..(169): n is a, c, g, or t
  modified_base (229)..(229): a, c, t, g, unknown or other
  misc_feature (229)..(229): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
  modified_base (530)..(530): a, c, t, g, unknown or other
  misc_feature (530)..(530): n is a, c, g, or t
  modified_base (606)..(606): a, c, t, g, unknown or other
  misc_feature (606)..(606): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcgaggacnccctcacgtgactgtcgtcccagggaggacacgtcactctcacctgtcgtcttaccaacncgtggacgcactcacctagtcgtacttaactactaccaaattcggttaccacgacgaacgaaaccgtcggaacaaacgcccgaaccgagggtacctactacgttaatttaataacgtaaacctaaaaaccgaaacaaaaccgtaccttacccgtaccgggtaacccctacgtaccccggtattaccgcgtacgtccccttcccggttaacggttacggggaactaaacgtccgtacgtccttacggactacgtcggtacgtggngtcganacgacggtagnggacgtgctacgtagtactntccgttactacgttactaggttggtacgagtcttgtacgtgtacgtcgggcgacggtacctagcctgtaaccggtntacgtgtaccgaacccggtgtcctcccgggtccctgtccacccgttcgtccccgtccgtacccg

SEQ ID NO: 133776 - DNA, 883 bp, Homo sapiens
  misc_feature: GYAE6OF01CLX2Y.17.33.C11.1.454.CMB.1.raw
  modified_base (176)..(176): a, c, t, g, unknown or other
  misc_feature (176)..(176): n is a, c, g, or t
  modified_base (866)..(866): a, c, t, g, unknown or other
  misc_feature (866)..(866): n is a, c, g, or t
tcagcgtagactagcacgaccggtgctcgatttagagtgagctcggttggggtttgggggggcgccaggggtcccttccaatatcagcaccatggcctggactcctctctttctgttcctcctcacttgctgcccagggtccaattctcagctgtggtgactcgaggacgccctanacgtcgatcggtccgtccccgagggacgggtactagtcctacgtcctacacctggtcgtaccgttacccaacacgttgggacacgtacgtaccaccgtagttcgtaccttactactaaccgtaagttcggtaccagtacgaaacgtaacgtcggaacaacgcccgacgacggtcctactaaattagttactaaacgtaaccaaaacctaaaccaaccttccggaccctaacccggaccctaccgtacccgttattacccggccgtaccggttccccttacccgggttaccggggacgggtaactaaccggccgtaaccgcccgtaaggtaccctaccggtttgttaccggttcggtgacccggtacggtaaccggtccgggtaacgggtaccggaagggtaccgggtaaccgttaacgtaccggtttaacttaccggttacccgttacccgttttaccggtttaaccggtttccgggttttacgggttacggttccggtaacgggttttcgtttaaccggttaccggggtttcgggttaacccggggtaccgggaccggggttaaaccgaccgggttccggtaaaccggtttacccgttacgtaccgggtaccgtacccgggtacccggtacgttacccccggtcccgtacccgtccggttacctcccgttcccgttacccgttaccccncccgtttcggttacccg

SEQ ID NO: 133777 - DNA, 717 bp, Homo sapiens
  misc_feature: GYAE6OF01C7OJA.17.33.C11.1.454.CMB.1.raw
  modified_base (173)..(173): a, c, t, g, unknown or other
  misc_feature (173)..(173): n is a, c, g, or t
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (285)..(285): a, c, t, g, unknown or other
  misc_feature (285)..(285): n is a, c, g, or t
  modified_base (445)..(445): a, c, t, g, unknown or other
  misc_feature (445)..(445): n is a, c, g, or t
tcagcgtagactagcacgaccggtgctcgatttagagtgagctcgttgggtttggggctggcgccgagggtcccttccaatatcagcaccatggcctggactcctctctttctgttcctcctcacttgctgccgaggtcaattctcagactggtggtgacgtcgggactcccncactgtctcgtcggtacccgaggacggacacgtcactctaccaccgtgttcnccttaccaacgtacgtcggacncgacgtccacngtctacttactacactaacgtcgtacncgacgaacgaacgagaacgaccgccgaaccgcggacctactacgtaacttaagtaacgaaactaaaaccaaaccgtaacctacccgtaccgtaccgtacccgcgtacctactctaccgtaccgtccttacccggtacgggtacgggactacgtccgtccnccgtacgctacgtcgtcgtgtcgcgacgtcgtcggtacggagtacgctacggtactaccttaacgtcgttacgtaccgttacttttacgttggttccgggttattgggtcttccgggtacttcggttaccggggtacgggaaccggtaccggtacggacgttcggtaacccggttacgtccgttaactccggaacccgtacgggtacccgtcccgtaccccgggtcccgtacgtccttaccccgttccgtacccttccccgtctaaccccgg

SEQ ID NO: 133778 - DNA, 516 bp, Homo sapiens
  misc_feature: GYAE6OF02F99VA.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctcctccttggggcaaagctgccctgacactgtctggtgtgcagcctgaggacgaggctgactattactgcctactctactttggtgtgctgtgctattcggcggagggaccaagctgaccgtcttagcagcccaaggcctcgcccctggtcactctcgttcccaccctcctcccg

SEQ ID NO: 133779 - DNA, 514 bp, Homo sapiens
  misc_feature: GYAE6OF02IEO9U.17.33.C11.1.454.CMB.1.raw
tcagcgtagactagcacgaccggtgctcgatttagagtgagctcgttgggtttggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgattctcaggctcctccttgggggcaaagctgccctgacactgtctggtgtgcagcctgaggacgagggctgactattactgcctactctactttggtgtgctgtgctattcggcggagggaccaagctgaccgtcttagtcagcccaaggctgcccctggtcactctcgttcccaccctctcc

SEQ ID NO: 133780 - DNA, 797 bp, Homo sapiens
  misc_feature: GYAE6OF02HVOS0.17.33.C11.1.454.CMB.1.raw
tcagcgtagactagcacgaccggtgctcgatttagagtgagctcgttgggtttgggctggcgccagggtccttcaatatcagcgaccatggcctggactctctctttctgttcctctcacttgctgccagggttcaattctcagactgtggtgactcgaggagcctcacgtgactgtgtccccaggagggacagtcactactcactgtgcttccaacacgtggacgctacgtccaccagtcgcttaactactaccaaactggttaccagaccaacgaaaccgtggaacaacgccaacccgagggaccaccttactaattttaacgtaacggtaaaccaaaaccaaaccaaaacctaccttaccgtacggtaacccccttcggaccccggtaattcctacgaaccggtccttccccgttaccggttacggggggaccaaaacggtccgtacggtaccccgtacgaaccttacgttcgttacgttcggggttcgttacgggaccgtaggtccccgttacgggaacgggtaccggtacgggtcctacggtaaccgttaactttaaccggtccgtacccgtttaaccgttcctttaaccgttttcgggtcggttcgttccgttaggttacggtaccgtttaacgttccgggacggggtaacggggaaccaaacggtaccgtaccgggtacccgtttacgtttaacggtccgtacccggtacccggtaaacgggtaccgttacccggtcccccgttaccgggtacctaccggtttcccgttcccggttaccccgttcccccg

SEQ ID NO: 133781 - DNA, 508 bp, Homo sapiens
  misc_feature: GYAE6OF02GWUCH.17.33.C11.1.454.CMB.1.raw
  modified_base (505)..(505): a, c, t, g, unknown or other
  misc_feature (505)..(505): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgatctcagctcctctggggcaaagctgccctgacactgtctggtgtgcagcctgaggacgaggctgactattactgcctactctactttggtggtgctgtgctattcggcgagggaccaagctgaccgtcttaagtcagcccaaggctgcccctggtccactctcgtcccnccc

SEQ ID NO: 133782 - DNA, 507 bp, Homo sapiens
  misc_feature: GYAE6OF02GWMCY.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactctgacccctgcccgatctcagctccctcttggggcaaagctgccctgacactgtctggtgtgcagcctgaggacgaggctgactattactgcctactctactttggtgtgctgtgctattcggcgagggaccaagctgaccgtcttaagtcagcccaaggcctgcccctggtcactctcgtcccgtccc

SEQ ID NO: 133783 - DNA, 519 bp, Homo sapiens
  misc_feature: GYAE6OF02GSHCE.17.33.C11.1.454.CMB.1.raw
  modified_base (469)..(469): a, c, t, g, unknown or other
  misc_feature (469)..(469): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccaggcactcatttatagtacaaacaacaaacactcctggacccctgcccgattctcaggctccctcttggggcaaagctgccctgacactgtctggtgtgcagcctgaggacgaggctgactattactgcctactctactttggtggtgctgtgctagttcggcggaggaccaagctgaccgtnttaagtcacgcccaaggctcgccccctcggtccactctcgttcccgtccc

SEQ ID NO: 133784 - DNA, 513 bp, Homo sapiens
  misc_feature: GYAE6OF02G5SWE.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctgactattactgcctatcttacttggtgtgctgtgctagttcggcggaggaccaaggctgaccgttctagtcagcccaaggctcgcccctggtcactctcgtcccacctcctcc

SEQ ID NO: 133785 - DNA, 576 bp, Homo sapiens
  misc_feature: GYAE6OF02GB85O.17.33.C11.1.454.CMB.1.raw
tcagcgtagactagcacgaccggtgctcgatttagagtgagctcgttgggtttggggctggcgccaggggtcccttccaatatcagcaccatggcctggactcctctttttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcaccgaggcactcattatagtaacaaacaacaaacactcctcgaccctcgcccgtattctcacggcctccctccgttcggggacaaacgctcgccctgacactgtctggtgtgcagcctgacggacgaggctagactattactcgtcctactcttacgtttggtggtgtctgtcgtcttagttcgggcgggacgggaaccagctcgtaccgttacgttaacgtcgaacggacccgaacggtcctccggtcccccgtcggtacctaccttccgttccggttcccccgccccttccccg

SEQ ID NO: 133786 - DNA, 517 bp, Homo sapiens
  misc_feature: GYAE6OF02JBX1G.17.33.C11.1.454.CMB.1.raw
  modified_base (471)..(471): a, c, t, g, unknown or other
  misc_feature (471)..(471): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgattactatccaaactggttccagcagaaacctggacaagcacccagggcactcatttatagtacaaacaacaaacactcctggacccctgccccgattctcaggctcctccttgggggcaaagctgccctgacactgtctggtgtgcagcctgaggacgaggctgactattactgcctactctactttggtggttgctgtgctattcggcgagggaccaagctgaccgtnttaagtcagcccaaggctgccccctcggtccactctgttcccgccc

SEQ ID NO: 133787 - DNA, 516 bp, Homo sapiens
  misc_feature: GYAE6OF02IGUP2.17.33.C11.1.454.CMB.1.raw
  modified_base (507)..(507): a, c, t, g, unknown or other
  misc_feature (507)..(507): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctattcggcggagggaccaagctgaccgtcttagtcagcccaaggctcgccccctggtcactctgttcccnccctctccc

SEQ ID NO: 133788 - DNA, 513 bp, Homo sapiens
  misc_feature: GYAE6OF02GIXQL.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcgggcgaggaccaagctgaccgtcttaagtcagcccaaggctgcccctggtccactctgttcccgtccc

SEQ ID NO: 133789 - DNA, 515 bp, Homo sapiens
  misc_feature: GYAE6OF02HK20T.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgacccctgcccgattctcagctccctcttggggcaaagctgccctgacactgtctggtgtgcagcctgaggacgaggctgactattactgcctactctactttggtgtgctgtgctagttcggcggagggaccaagctgaccgtcttaagtcagcccaaggcctgcccctcggtccactctcgtccccgtccc

SEQ ID NO: 133790 - DNA, 524 bp, Homo sapiens
  misc_feature: GYAE6OF02I5T2D.17.33.C11.1.454.CMB.1.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggacccctgcccgattcncagctccctcttggggcaaagctgccctgacactgtctggtgtgcagcctgaggacgaggctgactattactgcctactctactttggtggtgctgtgctagttcggcggagggaccaagctgaccgtcttaagtcagcccaaggcctcggccccctcggtccactccgtcgttccccgtcccc

SEQ ID NO: 133791 - DNA, 517 bp, Homo sapiens
  misc_feature: GYAE6OF02IBMAC.17.33.C11.1.454.CMB.1.raw
  modified_base (435)..(435): a, c, t, g, unknown or other
  misc_feature (435)..(435): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgatctcagctcctctggggcaaagctgccctgacactgtctggtgtgcagcctgaggacgaggctgactattactgcctactcttactttggtggtgctgtnctagttcggcggagggccaagctcgaccgtcttaagtcacgcccaaggctcgcccctcggtccactcctcgttccctacccc

SEQ ID NO: 133792 - DNA, 509 bp, Homo sapiens
  misc_feature: GYAE6OF02IBHO5.17.33.C11.1.454.CMB.1.raw
  modified_base (460)..(460): a, c, t, g, unknown or other
  misc_feature (460)..(460): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctccctctggggcaaagctgcctgacactgtctggtgtgcagcctgaggacgaggctgactattactgcctactctactttggtgtgctgtgctattcggcggaggaccagctgaccgtnttaagtcagccaaggctcgcccctggtcactctcgtcccaccctcctcc

SEQ ID NO: 133793 - DNA, 516 bp, Homo sapiens
  misc_feature: GYAE6OF02IOI44.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctctggggcaaagctgcctgacactgtctggtgtgcagcctgaggacgaggctgactattactgcctactctactttgtgtgctgtgctagttcggcggacgggaccaagctagaccgtcttagtcacgcccaaggctcgcccctggtcactctcgtcccgccctcctccg

SEQ ID NO: 133794 - DNA, 520 bp, Homo sapiens
  misc_feature: GYAE6OF02I5YW4.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctacgtttggtggtgctgtgctagttcgggcggagggaccaagctgaccgtcttaagtcagccaaggcctgcccctcggtccactctcgttcccgtccc

SEQ ID NO: 133795 - DNA, 533 bp, Homo sapiens
  misc_feature: GYAE6OF02IM86R.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgatctcaggctccctcctggggcaaagctgccctgacactgtctgtgtgcagcctgaggacgaggctgactattactgcctactcttacttggtgtgctgtgctagttcggcggagggacaagctagaccgttacttagtcgacgtacccgaaggtcctcggccccctcggtcctacctcgttccgttcccgtccccg

SEQ ID NO: 133796 - DNA, 512 bp, Homo sapiens
  misc_feature: GYAE6OF02HSP1Y.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactacctggacccctgcccgattctcagctccctcttggggcaaagctgccctgacactgtctggtgtgcagcctgaggcgaggctgactattactgcctactctactttggtgtgctgtgctagttcgcggagggaccaagctgaccgtctaagtcagcccaaggcctgcccctcggtcactctcgttccctccc

SEQ ID NO: 133797 - DNA, 519 bp, Homo sapiens
  misc_feature: GYAE6OF02GS3SD.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctagttcggcggagggaccaagctgaccgttctagtcagcccaaggctcgcccctggtcactctcgttcccaccctcctcccg

SEQ ID NO: 133798 - DNA, 515 bp, Homo sapiens
  misc_feature: GYAE6OF02G7ZOJ.17.33.C11.1.454.CMB.1.raw
  modified_base (468)..(468): a, c, t, g, unknown or other
  misc_feature (468)..(468): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactacctggacccctgcccgattctcaggctcctcctggggcaaagctgccctgacactgtctggtgtgcagcctgaggacgaggctgactattactgcctactctactttggtgtgctgtgctagttcggcggagggaccaagctgaccgtnttaagtcagcccaaggcctgcccctcggtccactctgtcccctaccc

SEQ ID NO: 133799 - DNA, 530 bp, Homo sapiens
  misc_feature: GYAE6OF02G4WE7.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcacggctccctccttcggggcaaagctcgccctgacactgtctggtgtgcagcctgaggacgaggctgactatactgcctactctacttggtgtgctgtgctagttcggcggaggaccgaagctacgaccgtcttaagtcacgcccaaggcctcgccccgtcgtcacgtcctcggttcccaccctccctaccg

SEQ ID NO: 133800 - DNA, 538 bp, Homo sapiens
  misc_feature: GYAE6OF02HFO98.17.33.C11.1.454.CMB.1.raw
  modified_base (477)..(477): a, c, t, g, unknown or other
  misc_feature (477)..(477): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctccctccttggggcaaagctcgccctgacactgtctggtgtgcagcctgacggacgaggctgactattactgcctactctactttggtggtgtctgtgcttagttcggcggagggaccaagcgtacgaccgtnttaacgtccacgcccgaaggcctcgcccccgtcggtcctacgtcctcgttcccctaccccg

SEQ ID NO: 133801 - DNA, 557 bp, Homo sapiens
  misc_feature: GYAE6OF02J2FS1.17.33.C11.1.454.CMB.1.raw
  modified_base (173)..(173): a, c, t, g, unknown or other
  misc_feature (173)..(173): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggcctcctccttggggcaaagctgccctgaccactgtctggtgtgcagcctgaggacgaggctgactattactgcctactctactttggtgtgctgtgtcttagttcggcggtacggaccgaagtcgtcggaccgtcgtttaacggtccacggcccctaaagggtcctcggtccccccgttcggtccgaccgtttccgttccggttcccctaccc

SEQ ID NO: 133802 - DNA, 539 bp, Homo sapiens
  misc_feature: GYAE6OF02F01UF.17.33.C11.1.454.CMB.1.raw
  modified_base (344)..(344): a, c, t, g, unknown or other
  misc_feature (344)..(344): n is a, c, g, or t
tcagcgtagactagcacgaccggtgctcgatttagagtgagctcggttgggtttgggggcgccaggggtcccttccaatatcagcaccatggcctgggactcctctctttctgttccgtcctcacttgctgcccagggtccaattctcagactgtggtgactcaggagccctcactgacctgtgtccccaggagggacagtcactctcacctgtgcttccaacactggagcagtcaccagtgcttactatccaaactggttccagcagaaacctggacaagccacccagggcactcatttatagtacaaacaacaaacactacctggacccctgacccgattcncaggctccctctggggcaagctgccctgacactgtctgtgtgcagcctagaggacgaggctgactacttactgccttactcttactttggtgtgcttgtgcttagttcgggacgggagggaccaaggctagaccgttattagcagcccgaaggctcgccccctggtccaccgttctcgttccccgcctccctccg

SEQ ID NO: 133803 - DNA, 525 bp, Homo sapiens
  misc_feature: GYAE6OF02HLY7C.17.33.C11.1.454.CMB.1.raw
  modified_base (470)..(470): a, c, t, g, unknown or other
  misc_feature (470)..(470): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaaacaacaaacactcctggacccctgcccgattctcaggctccctccttgggggcaaagctgccctgacactgtctggtgtgcagcctgaggacgaggctgactattactgcctactctactttggtgtgctgtgctagttcggcggagggaccaagctagaccgtnttagtcagcccaaggcctcgccccctggtccactctcgttccccgccctcctccg

SEQ ID NO: 133804 - DNA, 518 bp, Homo sapiens
  misc_feature: GYAE6OF02FZ6RQ.17.33.C11.1.454.CMB.1.raw
  modified_base (466)..(466): a, c, t, g, unknown or other
  misc_feature (466)..(466): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctccctccttggggcaaagctgccctgacactgtctggtgtgcagcctgaggacgaggctgactattactgcctactctacttggtgtgctgtgctattcggcggaggaccaagctgaccgtntaacgtcacgcccaaggcctcgccccctggtccactctcgttcccctacccc

SEQ ID NO: 133805 - DNA, 577 bp, Homo sapiens
  misc_feature: GYAE6OF02JCT1S.17.33.C11.1.454.CMB.1.raw
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtccaccagtgcttactataccaaactggttccagcaagaaacctggacaagccaccgagggcactcatttatagtacaaacaacaaacactcctcggacccctcgcccgtattctcacggcctccctccgttgggggacaaacgctacgccctgactactgtctggtgtgcagcctggaggacgnggctgactattacngtacctactcttacgtttggtgtgctgtgtcgttagttcggcggacgggaccaagcttcgaccgttacgttacgtcacggcccgaaggtccgtccgccccgttcggtacctacgttccgttcgttccccctacccttcccttacccg

SEQ ID NO: 133806 - DNA, 548 bp, Homo sapiens
  misc_feature: GYAE6OF02IWN1R.17.33.C11.1.454.CMB.1.raw
  modified_base (484)..(484): a, c, t, g, unknown or other
  misc_feature (484)..(484): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaaacactggagcagtcaccagtgcttactatccaaactggttccagcagaaacctggacaagcacccagggcactcatttatagtacaaacaaacaaacactcctcggacccctgcccgattcctcaggcctccctccgtggggcaaagctgccctgacactgtctggtgtgcagcctgaggacgaggctgacttattactgccttactcttacgtttggtggtgcgttgtgtcttagttcgggcggagggaccaagctcgaccgttnttacgtcacgcccaaggcctcgcccccgtggtccacgttcctcgtcccctacccttcctacccg

SEQ ID NO: 133807 - DNA, 519 bp, Homo sapiens
  misc_feature: GYAE6OF02HGUIC.17.33.C11.1.454.CMB.1.raw
  modified_base (447)..(447): a, c, t, g, unknown or other
  misc_feature (447)..(447): n is a, c, g, or t
  modified_base (467)..(467): a, c, t, g, unknown or other
  misc_feature (467)..(467): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtaacaaacaacaaacactcctcggacccctgcccgattctcaggctccctcttggggcaaacgctcgcctgacactgtctggtgtgcagcctgagacgaggctgactatactgcctactctactttggtgtgctgtgcttagtcggnggacggacaagctgaccgtnttagtcacggcccaaggctcgcccctgtccactctcgtcccacctcctaccg

SEQ ID NO: 133808 - DNA, 556 bp, Homo sapiens
  misc_feature: GYAE6OF02HQ5TA.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcattatagtacaaacaacaaacactcctggacccctgcccgattctcagctcctccgtggggcaaagctgccctgacactgtcgtggtgtgcagcctggaggacgaggctgactattactgcctactcttacgtttggtggtgtcgttgtgtcttagttcgggcggagggaccaagctagaccgttacttagtcgacgcccgaaggtcctccggcccccgttcggtacctaccgttccgttccggttccccgtcccttcccttacccg

SEQ ID NO: 133809 - DNA, 521 bp, Homo sapiens
  misc_feature: GYAE6OF02IYVQY.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggacccctgcccgattctcaggctccctccttggggcaaagctgccctgacactgtctggtgtgcagcctgaggacgaggctgactattactgcctactctactttggtggtgctgtgctagttcggcggtagggaccaagctgaccgtcttaagtcacgcccaaggcctcgcccctcggcactctcgttccctaccc

SEQ ID NO: 133810 - DNA, 520 bp, Homo sapiens
  misc_feature: GYAE6OF02HC7P2.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctcctccttggggcaaagctagccctgacactgtctggtgtgcagcctgaggacgaggctgactattactgcctactctacttggtgtgctgtgctattcggcggtagggaccaagctagaccgtcttagtcaggcccaaggcctcgcccctcggtcactctcgttcccgcctccctccg

SEQ ID NO: 133811 - DNA, 524 bp, Homo sapiens
  misc_feature: GYAE6OF02IEXBY.17.33.C11.1.454.CMB.1.raw
  modified_base (398)..(398): a, c, t, g, unknown or other
  misc_feature (398)..(398): n is a, c, g, or t
  modified_base (436)..(436): a, c, t, g, unknown or other
  misc_feature (436)..(436): n is a, c, g, or t
  modified_base (476)..(476): a, c, t, g, unknown or other
  misc_feature (476)..(476): n is a, c, g, or t
tcagcgtagactagcacgaccggtgctcgatttagagtgagctcgttgggttttgggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgattctcaggcctcctccttggggcaaagctcgccctgacactgtctggtgtgcagcctgagngaggctgactattaactcgtacctactcttactttggnggttgcttgtgcttattcggcgagggaccagctgaccgtnttaagtcagcccaaggcctagcccctcggtccactctcttccctaccc

SEQ ID NO: 133812 - DNA, 514 bp, Homo sapiens
  misc_feature: GYAE6OF02IHQ9P.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactacctggacccctgcccgattctcaggctccctccttgggggcaaagctgccctgacactgtctggtgtgcagcctgaggacgaggctgactattactgcctactctacttggtgtgctgtgctattcggcggaggaccaagctgaccgtcttaagtcagcccaaggctcgccccgtcgtcactctcgtcccgtccc

SEQ ID NO: 133813 - DNA, 536 bp, Homo sapiens
  misc_feature: GYAE6OF02HUMY9.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcacccagggcactcatttatagtacaaacaacaaacactcctagacccctgcccgattctcagctccctcttggggcaaagctcgccctgacactgtctggtgtgcagcctgaggacgagctgactattactgcctactcttactttggtggtgtcgtgtgtcttagttcggcggacgggaccaagctagaccgttcttaagtcacgcccaaggtcctcgcccccgttcggcctaccgtcttccgtcccctaccccg

SEQ ID NO: 133814 - DNA, 514 bp, Homo sapiens
  misc_feature: GYAE6OF02GE8QL.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtgtgctgtgctatcggcggagggaccaagctgaccgtcttagtcagcccaaggctgcccctggtcactctgttcccgccctctccc

SEQ ID NO: 133815 - DNA, 533 bp, Homo sapiens
  misc_feature: GYAE6OF02IO0MJ.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcacggctccctcctgggggcaaagctgccctgacactgtctggtgtgcagcctgaggacgaggctgactattactgccttactcttacgtttggtgtgcttgtgcttagtcggcggagggaccaaggctacgaccgtcttagtcacgcccaaggcctcgcccctggtccacgtcctcgtccctaccctcctacccg

SEQ ID NO: 133816 - DNA, 507 bp, Homo sapiens
  misc_feature: GYAE6OF02GWO7K.17.33.C11.1.454.CMB.1.raw
  modified_base (464)..(464): a, c, t, g, unknown or other
  misc_feature (464)..(464): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctccctctggggcaaagctgccctgacactgtctggtgtgcagcctgaggacgaggctgactattactgcctactctactttggtgtgctgtgctattcggcggaggacaagctgaccgtntaagtcagcccaagctgcccctggtccactctcgtccctaccc

SEQ ID NO: 133817 - DNA, 524 bp, Homo sapiens
  misc_feature: GYAE6OF02HMD8W.17.33.C11.1.454.CMB.1.raw
  modified_base (432)..(433): a, c, t, g, unknown or other
  misc_feature (432)..(433): n is a, c, g, or t
  modified_base (466)..(466): a, c, t, g, unknown or other
  misc_feature (466)..(466): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctcttggggcaaagctgcctgacactgtctggtgtgcagcctgaggacgaggctgactattactgcctactctacttggtggtnntgtgctagtcggcgagggaccaagctgaccgtnttaacgtcacgcccaaggcctcgccccctcggtacctaccgtctcgtcccctaccccg

SEQ ID NO: 133818 - DNA, 515 bp, Homo sapiens
  misc_feature: GYAE6OF02IITUR.17.33.C11.1.454.CMB.1.raw
  modified_base (468)..(468): a, c, t, g, unknown or other
  misc_feature (468)..(468): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactcgactgtgtccccaggagggacagtcactctcacctgtgcttccaacactggagcagtcaccagtgcttacatccaaactggttccagcagaaacctggacaagcaccagggcactcatttatagtacaaacaacaaacactcctggacccctgcccgattctcaggctcctccttgggggcaaagctgccctgacactgtctggtgtgcagcctgaggacgaggctgactattactgcctactctactttggtggtgctgtgctattcggcgagggaccaagctgaccgtntaagtcagcccaaggcctcgcccctcggtccactctcgtccctaccc

SEQ ID NO: 133819 - DNA, 536 bp, Homo sapiens
  misc_feature: GYAE6OF02I48IE.17.33.C11.1.454.CMB.1.raw
  modified_base (417)..(417): a, c, t, g, unknown or other
  misc_feature (417)..(417): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactacctggaacccctgcccgattctcacggcctccctccgttgggggcaaacgctcgcctgacactgtctggtgtgcagcctgaggacgaggctgactattacngtcctactcttacgttggtgtgctgtgtctagttcggcggacggaccagcgtgaccgtacttacgtcgacgccgaaggctccgccccgtggtcactccgtcgtccccgtcctcctcccg

SEQ ID NO: 133820 - DNA, 532 bp, Homo sapiens
  misc_feature: GYAE6OF02GVWS0.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgtctgtgctagttcggcggagggaccaaggctgaccgtcttagtcaggcccaaggcctcgccccctggtccacgttcctcgttccctaccctccttcccg

SEQ ID NO: 133821 - DNA, 538 bp, Homo sapiens
  misc_feature: GYAE6OF02JC2VK.17.33.C11.1.454.CMB.1.raw
  modified_base (337)..(337): a, c, t, g, unknown or other
  misc_feature (337)..(337): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcattatagtacaaacaacaaacactcctacgacccctgccgattcncagctcctctggggacaagctgcctgacactgtctgtgtgcagctgaggacgagctgactattaactgtacctactcttacgtttggtggttgcttgtgtacgttagttcgggcggacgggaacccaagcgtacgaccgttattaacgtcgaacgcccaaggtctcgcccctcggtccacctcttaccgtcccctaccccg

SEQ ID NO: 133822 - DNA, 521 bp, Homo sapiens
  misc_feature: GYAE6OF02HV9DO.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctgacccctgcccgattctcaggctccctccttgggggcaaagctgccctgacactgtctggtgtgcagcctgaggacgaggctgactattactgcctactctactttggtggtgctgtgctagttcggcggagggaccaagctgaccgtcttagtcagcccaaggctcgccccctggtccactctcgttcccaccctcctcc

SEQ ID NO: 133823 - DNA, 518 bp, Homo sapiens
  misc_feature: GYAE6OF02IFRAE.17.33.C11.1.454.CMB.1.raw
  modified_base (440)..(440): a, c, t, g, unknown or other
  misc_feature (440)..(440): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctcttggggcaaagctgccctgacactgtctggtgtgcagcctgaggacgaggctgactattactgcctactctacgtttggtgtgctgtgntagttcggcggaggaccaagctgaccgtcttaagtcagcccaaggctcgcccctcggtcactctcgttccctaccccg

SEQ ID NO: 133824 - DNA, 549 bp, Homo sapiens
  misc_feature: GYAE6OF02J24W6.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctggaccctgcccgatctcagctcctccttggggcaaagctgccctgacactgtctggtgtgcacgcctgaggacgaggctgactatactgcctactctactttggtgtgctgtgcttagtcgggtcggagggtacccaagtccgtagtacccgtcttaacggtccagaccccgaaggtcccgtcgtaccccccgtcgggtcctactccttaccggttcccctacccccg

SEQ ID NO: 133825 - DNA, 650 bp, Homo sapiens
  misc_feature: GYAE6OF02FGRJD.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttcaacactggagcagtcaccagtgcttactataccaaacgtggttccagcaacgaaacctggaacaagccacccgagggccactctatttatagtaacaaacaacaaacactcctcggacccctgcccgtattcctcgacggcctccctcgttacggggacaaacgctcgcctgacctacgtgtctggtcgtgcagtcctggacggacgacggctacggaacttattactcgacccttactccttacgtttgggtcggttgtccgttggttcgtacgtttacggttccgggtacggggtaaccgggtaaccgaaggtccgttaccggtaccggttacgttaacggtaccgaaccggacccgtaaacgggtccttacccggacccccgtttcgggtaccctaaccgtttcccgtaccgtttacccccgtaccccg

SEQ ID NO: 133826 - DNA, 511 bp, Homo sapiens
  misc_feature: GYAE6OF02JD2EN.17.33.C11.1.454.CMB.1.raw
  modified_base (429)..(429): a, c, t, g, unknown or other
  misc_feature (429)..(429): n is a, c, g, or t
  modified_base (467)..(467): a, c, t, g, unknown or other
  misc_feature (467)..(467): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtatccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctccctcttggggcaaagctgccctgacactgtctggtgtgcagcctgaggacgaggctgactattactgcctactctactttggngtgctgtgctagttcggcgagggaccaagctgaccgtntagtcagccgaagctcgcccctggtccactcgtcgtcccgtccc

SEQ ID NO: 133827 - DNA, 516 bp, Homo sapiens
  misc_feature: GYAE6OF02GVB4E.17.33.C11.1.454.CMB.1.raw
  modified_base (434)..(434): a, c, t, g, unknown or other
  misc_feature (434)..(434): n is a, c, g, or t
tcagcgtagactagcacgaccggtgctcgatttagagtgagctcgttgggtttggggctggcgccaggggtcccttcccaatatcagcaccatggcctggactcctctctttctgttcctcctcacttgctgcccagggtccaattctcagactgtggtgactcaggagccctcactgactgtgttcccaggagggacagtcactctcacctgtgcttccaacactggagcagtcaccagtgcttactatccaaaactggttccagcagaaacctggacaagcacccaggcactcatttatagtacaaacaacaaacactcctggacccctgcccgatctcaggctccctccttggggcaaagctgccctgacactgtcctggtgtgcagcctgaggacgaggctgactattactgcctactctacttgtgtgntgtgctattcggcggaggaccaagctgtaccgtcttaagtcacgcccgaagcctcgcccctcggtcactctcgtccctcccc

SEQ ID NO: 133828 - DNA, 523 bp, Homo sapiens
  misc_feature: GYAE6OF02FMITJ.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctccctcctggggcaaagctgccctgacactgtctggtgtgcagctgaggacgaggctgactattactgcctactctactttggtgtgtctgtgcttagttcgggcggagggaccaagtcgtagaccgtcttaacgtcagcccaaggctcgcccctcggtccacctctcgtcccgtcccc

SEQ ID NO: 133829 - DNA, 641 bp, Homo sapiens
  misc_feature: GYAE6OF02IL7LF.17.33.C11.1.454.CMB.1.raw
  modified_base (235)..(235): a, c, t, g, unknown or other
  misc_feature (235)..(235): n is a, c, g, or t
  modified_base (369)..(369): a, c, t, g, unknown or other
  misc_feature (369)..(369): n is a, c, g, or t
tcagcgtagactagcacgaccggtgctcgatttagagtgagctcgttgggtttgggctggcgccagggtcccttccaatatcagcaccatggcctggactcctctcttctgttcctcctcacttgctcgcccaggtccaattctcagactgtcggtcgactcgaggacgccctcactcgactgtcgtcccaggacggacacgtcactctcaccgtgtcgcttccaacactggacncacgtcaccagtcgcttactactaccaacgtcgtaccacgcgaacgaaccgtcggacgaacgccgaccgacggcacgtactactttacgtacgtaacaaacaacaacactccgtacgaccctcgaccgtattcncacgtcctcctcgtcggacaacgcgtcgcctacgactacgtcgtcgtcggtcgtcgcgtacgtccgtaggacggacgacggtcgtacgtacgttacgttaccgtcgtaccttacgttacgttacgtttcggtcggttcgtcgttcgtcgtacgttacgttccgggtacggtacggtaccacgtccgtacgtaccgttacgttacgtcgtaccgtaccgtacggtccgtccgtccccgtcggtacctacgttccgttccgttacccctacccg

SEQ ID NO: 133830 - DNA, 523 bp, Homo sapiens
  misc_feature: GYAE6OF02I6606.17.33.C11.1.454.CMB.1.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggacccctgcccgattctcaggctccctccttgggggcaaagctgccctgacactgtctggtgtgcagccctgaggacgaggctgactattactgcctactctactttggtgtgtctgtgctagttcggcggagggaccaagctgaccgtcttagcagcccaaggcctgcccctcggtcacgtctcgttccccgcctcctcccg

SEQ ID NO: 133831 - DNA, 526 bp, Homo sapiens
  misc_feature: GYAE6OF02IEVAW.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgccccgattctcatcgctccctcctggggcaaacgctcgccctgaccactgtctggtgtgcagcctgagacgaggctgactattactgcctactctactttggtgtgctgtgtctagttcggcggagggaccaagctgaccgttcgttaagtcacgcccaaggcctcgcccccgtcggtccactcctcgttcccccg

SEQ ID NO: 133832 - DNA, 526 bp, Homo sapiens
  misc_feature: GYAE6OF02HQ16M.17.33.C11.1.454.CMB.1.raw
  modified_base (428)..(428): a, c, t, g, unknown or other
  misc_feature (428)..(428): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctggacccctgcccgattctcaggctccctccttgggggcaaagctgccctgacactgtctggtgtgcagcctgaggacgaggctgactattactgcctactctactttggnggtgtctgtgtctagttcggcggagggaccaagctagaccgtcttagtcacgcccaaggctcgccccctggtcactcctcgttccccgccctcctccc

SEQ ID NO: 133833 - DNA, 512 bp, Homo sapiens
  misc_feature: GYAE6OF02IADO1.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgatctcagctcctcctggggcaaagctgccctgacactgtctggtgtgcagcctgaggacgaggctgactattactgcctactcttactttggtgtgctgtgctattcggcggagggaccaagctgaccgtcttaagcagccgaaggctcgcccctggtccactctcgttccctcccc

SEQ ID NO: 133834 - DNA, 523 bp, Homo sapiens
  misc_feature: GYAE6OF02HLM0S.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactcctcggacccctgcccgattctcacggctccctcctggggcaaagctcgcctgacactgtctggtgtgcagcctgaggacgaggctgactattactgcctacttctactttggtggttgctgtgcttagttcggcggagggaccaagctgaccgtcttaagcacgccaaggctcgcccctcggtccactctcgttccctacccc

SEQ ID NO: 133835 - DNA, 531 bp, Homo sapiens
  misc_feature: GYAE6OF02HZUSE.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctagttcggcggagggaccaaggctgaccgtcttaagtcagcccaaggcctcgcccccgtcggtccacctctcgttccccaccctccctacccg

SEQ ID NO: 133836 - DNA, 589 bp, Homo sapiens
  misc_feature: GYAE6OF02FXESH.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgccccgattctcaggctccctcgttggggcaaagctgccctgacactgtctggtgtgcagcctgaggacgaggctgactattactgcctactcttacgtttggtggtgtcgtgttcgtcttagttcgggcgggtaacgggaaccctaaggccgttaggtacccggttacgttaacggtccgaaggacccccgtaaagggcccgttccggccccccggttcgggtaccctaccgtccggttcccgttccccggtccccccg

SEQ ID NO: 133837 - DNA, 524 bp, Homo sapiens
  misc_feature: GYAE6OF02IE4RA.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcatttatagtacaaacaacaaacactcctggacccctgccccgattctcaggcctccctccttgggggcaaagctgccctgacactgtctggtgtgcagcctgaggacgaggctgactattactgcctactcttactttggtggtgctgtgcttagttcggcgggagggaccaagctgaccgtcttaagtcagcccaaggctcgcccctcggtccactctcgtccctacccc

SEQ ID NO: 133838 - DNA, 531 bp, Homo sapiens
  misc_feature: GYAE6OF02GK83J.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgacccctgcccgattctcaggctccctcttcggggcaaagctgccctgacactgtctggtgtgcagccgtgacgggacgaggctgactattacgtcgccttactctactttggtggtgtctgtgcttagtcggcggaggaccgaagctagaccgttcttagtcacgcccgaaggcctcgccccgtcggtccactcctcgtcccgtcccc

SEQ ID NO: 133839 - DNA, 516 bp, Homo sapiens
  misc_feature: GYAE6OF02J1GRX.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaacactcctggacccctgcccgattctcagctcctcctggggcaaagctgccctgacactcgtctggtgtgcagcctgaggacgaggctgactatactgccttactcctactttggtgtgcgttgtgctagttcggcggaggccaagcctgaccgtcttacgctacgccgagctcgcccctgtccactctacgtcccgccctctcccg

SEQ ID NO: 133840 - DNA, 507 bp, Homo sapiens
  misc_feature: GYAE6OF02IX0JN.17.33.C11.1.454.CMB.1.raw
  modified_base (339)..(339): a, c, t, g, unknown or other
  misc_feature (339)..(339): n is a, c, g, or t
  modified_base (466)..(466): a, c, t, g, unknown or other
  misc_feature (466)..(466): n is a, c, g, or t
tcagcgtagactagcacgaccggtgctcgatttagagtgagctcgttgggtttgggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattcncaggctccctcttggggcaaagctgccctgacactgtctggtgtgcagcctgaggacgaggctgactattactgcctactctactttggtggtgctgtgctattcggcggaggacaagctgaccgtntaagtcagccaagctgcccctggtccactctcgtcccaccc

SEQ ID NO: 133841 - DNA, 535 bp, Homo sapiens
  misc_feature: GYAE6OF02GMY07.17.33.C11.1.454.CMB.1.raw
  modified_base (472)..(472): a, c, t, g, unknown or other
  misc_feature (472)..(472): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacgactggagcagtcaccagtgcttactatccaaactggttccagcagaacctggacaagcacccagggcactcatttatagtacaaacaacaaacactcctggacccctgcccgattctcaggctccctccttggggacaaacgctgccctgaccactcgtctggtgtgcagcctgaggacgaggctgacttatactgcctactctactttggtgtgctgtgctagttcggcggagggaccaagctgaccgtnttacgtcacgcccgaaggcctccgccccgtcggtccactcctcgttccccaccctcctacccg

SEQ ID NO: 133842 - DNA, 561 bp, Homo sapiens
  misc_feature: GYAE6OF02H74Y9.17.33.C11.1.454.CMB.1.raw
  modified_base (297)..(297): a, c, t, g, unknown or other
  misc_feature (297)..(297): n is a, c, g, or t
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
  modified_base (478)..(478): a, c, t, g, unknown or other
  misc_feature (478)..(478): n is a, c, g, or t
  modified_base (489)..(489): a, c, t, g, unknown or other
  misc_feature (489)..(489): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaaacctggacaagcaccaggcactcatttanagtaacaaacaacaaacactcctagaccctcgcccgattctcacgctccctcgtggggacaaagctcgccctgacactgtctggtgtgcagccgtgacggacgaggctagtactattacncgtccctactcttacgtttggnggttgcgtgtcgcttagtcgggcggtacgggacaacgtnacgtaccgttnttaacgtcacgtaccccgaaggtccctccggcccccgttcggtaccctacttcctccggttcccccgtcccc

SEQ ID NO: 133843 - DNA, 521 bp, Homo sapiens
  misc_feature: GYAE6OF02ITQ1X.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctcgccctgacactgtctggtgtgcagcctgacggcgaggctgactattactgcctactctacttggtggtgctgtgctagttcggcggaggaccaagctgaccgtcttaagcacgcccaaggtcctcgcccccgtggtccactctcgttccctaccc

SEQ ID NO: 133844 - DNA, 515 bp, Homo sapiens
  misc_feature: GYAE6OF02HL1K5.17.33.C11.1.454.CMB.1.raw
  modified_base (424)..(424): a, c, t, g, unknown or other
  misc_feature (424)..(424): n is a, c, g, or t
  modified_base (464)..(464): a, c, t, g, unknown or other
  misc_feature (464)..(464): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctggacccctgcccgatctcaggctccctcttggggcaaagctgcctgacactgtctggtgtgcagcctgaggacgaggctgactattactgcctactctactttggngtgctgtgctattcgggcggagggaccaaggctgaccgtnttaagtcagcccaaggctgccccctggtcactctcgttcccaccctctccc

SEQ ID NO: 133845 - DNA, 531 bp, Homo sapiens
  misc_feature: GYAE6OF02I4EV2.17.33.C11.1.454.CMB.1.raw
  modified_base (436)..(436): a, c, t, g, unknown or other
  misc_feature (436)..(436): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgaccctgcccgattctcaggctcctccgttgggggcaaagctcgccctgaccactgtctggtgtgcagcctgaggacgaggctgactattactgcctactctactttggtgtgntgtgctagtccggcgggacgggaccaagcgtgaccgttcgttaacgtcacgccgaacgcgtccgcccctcggtccacctcttcgtcccctacccc

SEQ ID NO: 133846 - DNA, 619 bp, Homo sapiens
  misc_feature: GYAE6OF02I8SVX.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctgacaagcacccagggcactcattatagtacaaacaacaaacactcctaggacccctgcccgatctcaggcctcctccgtggggcaaagctgccctgacactgtctggtgtgcagcctgaggacgaggctgactattactcgtccttactccttacgttttggtacgttgcgttgtgcttagttccgggacgggacgggaccaaaggtccgttacggaacccggtttacgttaacgttccgaacggtaccccgaaacgggtccctaccgggtcccccccgttaccgggttaccctaacccgtttcccgttacccggtttccccccctacccccgttcccccttaccccgg

SEQ ID NO: 133847 - DNA, 534 bp, Homo sapiens
  misc_feature: GYAE6OF02JGR95.17.33.C11.1.454.CMB.1.raw
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggcctccctccttgggggcaaagctgccctgacactgtctggtgtgcagcctgaggacgaggctgactatactgccttactctacttggtggtnctgtnctattcgggcggagggaccaagctgaccgttcttagtcacggcccaagctcgcccccgtggtccacgtcctcgttcccctacccttccctacccg

SEQ ID NO: 133848 - DNA, 536 bp, Homo sapiens
  misc_feature: GYAE6OF02JF1HJ.17.33.C11.1.454.CMB.1.raw
  modified_base (296)..(296): a, c, t, g, unknown or other
  misc_feature (296)..(296): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatcaaactggttccagcagaaacctggacaagcaccaggcactcattanagtacaaacaacaaacactacctggaccctgcccgaattctcaggctccgtctggggacaaagctgcctgacactgtctggtgtgcagcctgagacgagctgactatactgcctactctacttggtcgtgctgtcgtctagttcggcgtaagggaccaaagcgtacgaccgtcttaaggtctacgacccgaaggtccgtaccgtccccgtacggtccaccgtcgttccgtccccgtcccc

SEQ ID NO: 133849 - DNA, 512 bp, Homo sapiens
  misc_feature: GYAE6OF02ISMD1.17.33.C11.1.454.CMB.1.raw
  modified_base (337)..(337): a, c, t, g, unknown or other
  misc_feature (337)..(337): n is a, c, g, or t
  modified_base (502)..(502): a, c, t, g, unknown or other
  misc_feature (502)..(502): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgacccctgcccgattcncagctccctcttggggcaaagctgcctggcactgtctggtgtgcagcctgaggacgaggctgactattactgcctactctactttggtgtgctgtgctagttcggcggaggaccaagctgaccgtctagtcacgccaaggctcgccccgtgtcactctcgtcccnccctcctccg

SEQ ID NO: 133850 - DNA, 519 bp, Homo sapiens
  misc_feature: GYAE6OF02G1S2S.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgccttactcttactttggtgtgctgtgctagtcggcggagggaccaagctgaccgtctagtcagcccaaggctcgcccctggtcactctcgttcccgcctcctccg

SEQ ID NO: 133851 - DNA, 511 bp, Homo sapiens
  misc_feature: GYAE6OF02F78A1.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggaggaccaagctgaccgtcttaagtcagcccaaggctgcccctcggtcactctgtcccaccc

SEQ ID NO: 133852 - DNA, 571 bp, Homo sapiens
  misc_feature: GYAE6OF02H9SM4.17.33.C11.1.454.CMB.1.raw
  modified_base (341)..(341): a, c, t, g, unknown or other
  misc_feature (341)..(341): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggacccctgcccgattcncagcctccctcgttggggcaaagctcgccctgacactgtctggtgtgcagcctgaggacgaggctgactattactgcctactcttacgtttggtggtgcttgtcgtctagttcgggcgggtacgggaccaagtctacgacccgttcttaacggtccaacggacccgaaacgggtcctaccggccccccgttcgggtccctacgtcccgtttccggttcccccgtcccccg

SEQ ID NO: 133853 - DNA, 535 bp, Homo sapiens
  misc_feature: GYAE6OF02F29LG.17.33.C11.1.454.CMB.1.raw
  modified_base (411)..(411): a, c, t, g, unknown or other
  misc_feature (411)..(411): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattacngcctactcttactttggtgtgctgtgctagttcggcggagggaccaagctgaccgttcttagtcacgcccgaaggcctacggccccctggtccacttcctcgttcccctaccctcccttacccg

SEQ ID NO: 133854 - DNA, 530 bp, Homo sapiens
  misc_feature: GYAE6OF02FXSKB.17.33.C11.1.454.CMB.1.raw
  modified_base (407)..(407): a, c, t, g, unknown or other
  misc_feature (407)..(407): n is a, c, g, or t
  modified_base (470)..(470): a, c, t, g, unknown or other
  misc_feature (470)..(470): n is a, c, g, or t
  modified_base (504)..(504): a, c, t, g, unknown or other
  misc_feature (504)..(504): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcaccaggcactcattatagtacaaacaacaaacactcctggaccctgcccgattctcaggctccctcttggggacaagctgccctgacactgtctggtgtgcacgctggaggacgaggctgactattacgngtcctactcttactttggtggtgtcttgtgcttagttcgggcgagggaccaagctgaccgttnttacgtcagcccgaaggcctccgcccctggtccncgtccgtcgtcccgtccctcccgtcc

SEQ ID NO: 133855 - DNA, 526 bp, Homo sapiens
  misc_feature: GYAE6OF02HDAQU.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgaccctgcccgattctcagctcctcttggggacaaagctcgccctgacactgtctggtgtgcagcctgaggacgaggctgactatactgcctactctacgtttggtgtgctgtgtctagttcggcgggaggacaagctcggacgtctaagtcacgacccgaaggcctcgccccctcggtcctaccgtcttccgtcccctacccc

SEQ ID NO: 133856 - DNA, 545 bp, Homo sapiens
  misc_feature: GYAE6OF02HA0YK.17.33.C11.1.454.CMB.1.raw
  modified_base (413)..(413): a, c, t, g, unknown or other
  misc_feature (413)..(413): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaacggccctggagtggcttgcgctcatttattgggatgagagtaagcactacagtccgtctctgaagaacaggctcaccatcaccaaggacacctccaacaaaccaggtggtaccttacaatgaccaatatcgacctgtgacacagccanattattactgttcacgctctagttgggttcggggtatttacgttagtcccttactttgactacgtcgggccagggtactcgtcggtacctaccggtctccgcacgccctccaccgaacgggcccagtcccgg

SEQ ID NO: 133857 - DNA, 531 bp, Homo sapiens
  misc_feature: GYAE6OF02GEWBX.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgattctcaggctccctccttggggcaaagctgccctgacactgtctggtgtgcagcctggaggacgaggctgactattactgcctactctactttggtgtgctgtgctattcgggcggagggaccaagctgaccgtcttagtcagcccaaggcctcgccccctggtccacgttcctcgttccccacccttccctcccg

SEQ ID NO: 133858 - DNA, 511 bp, Homo sapiens
  misc_feature: GYAE6OF02GXMFF.17.33.C11.1.454.CMB.1.raw
  modified_base (383)..(383): a, c, t, g, unknown or other
  misc_feature (383)..(383): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggngtgcagcctgaggacgaggctgactattactgcctactctactttgtgtgctgtgctattcggcgagggacaagctgaccgtcttacgcagccaaggctgcccctcggtccacgtctcgtccctcccc

SEQ ID NO: 133859 - DNA, 546 bp, Homo sapiens
  misc_feature: GYAE6OF02IIYZM.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccgtggggcaaagctgcctgacactgtctggtgtgcagcctgaggacgaggctgactattactgccttactctacgtttggtggtgcgtgtgcttagttcgggcgggtaggaccaaggtctcgaccgttcttacgtcacgcccgaaggctccgccccgtcggtcctactccgttccgttccccgtccctccctacccg

SEQ ID NO: 133860 - DNA, 655 bp, Homo sapiens
  misc_feature: GYAE6OF02JQEQ1.17.33.C11.1.454.CMB.1.raw
  modified_base (231)..(231): a, c, t, g, unknown or other
  misc_feature (231)..(231): n is a, c, g, or t
tcagcgtagactagcacgaccggtgctcgatttagagtgagctcgttgggtttggggggtcggccaggggtcccgttccaactatcagcaccatggcctggactcctctctttctgttcctcctcacttgctgccagggtcaattctcagactgtggtgactcaggagccctcactgactgtgtccccaggagggacagtcactctcacctgtgcttccaacactgggacncagtccaccagtgtcttaactataccaaacgttcggttaccagacaacgaaaccgtggaaccaagccaacccgagggctaactactattaatacgtaacaaacaaacaaacaccgtccgtacgaccctcgaccgtacttctacacggcctacccgttccggttacgggggacaaacgccgtcgcccgtagtactacctcgttcgtggtggtcgacgacgtccgtggaacgggtacggaggtctacgtactaactttactcgtaccgttacttacttacgtttgggtacgtcggtcctggtcttcgttacggttcgggacgggaaggtaccgaagttcgaccggtacgttacgtagtacacggtacccgaggcctccgaccccgtcggtccgaccgttccttcccggttccccgcccttaccctg

SEQ ID NO: 133861 - DNA, 531 bp, Homo sapiens
  misc_feature: GYAE6OF02JDTIT.17.33.C11.1.454.CMB.1.raw
  modified_base (299)..(299): a, c, t, g, unknown or other
  misc_feature (299)..(299): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccacactggagcagtcaccagtgcttactatccaaactggttccagcagaaacctggacaagcacccagggcactcatttanagtacaaacaacaaacactcctgacccctgcccgattctcaggctccctcttggggcaaagctgccctgacactgtctggtgtgcagcctggacggacgnggctgactattacngcctactctactttggnggtnctgtgctgttcggcggagggaccaagcgtgaccgttctaaggtcacgcccgaaggcctcggccccctcgggtccacgttcctcgttccccgtccccg

SEQ ID NO: 133862 - DNA, 547 bp, Homo sapiens
  misc_feature: GYAE6OF02IYTFD.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctggactattactgcccttactcctacgttttggtggttgcttgtcgcttagttcgggcgggtagggacccaagccttggaccgttcttaagtccagcccaaggcctcgcccccgttggtcctacgtccttcgttccccgtccccg

SEQ ID NO: 133863 - DNA, 522 bp, Homo sapiens
  misc_feature: GYAE6OF02GVMLF.17.33.C11.1.454.CMB.1.raw
  modified_base (464)..(464): a, c, t, g, unknown or other
  misc_feature (464)..(464): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctgacccctgcccgattctcagctcctccttgggggcaaagctgccctgacactgtctggtgtgcagcctggaggacgaggctgactattactgcctactctactttggtgtgctgtgcttagtcggcggaggaccaagctgaccgtnttagtcacgcccgaaggtctcgccccgtggtccactcctcgtcccgtccctcctcccg

SEQ ID NO: 133864 - DNA, 537 bp, Homo sapiens
  misc_feature: GYAE6OF02F541E.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaaacactcctgacccctgcccgattctcacggctccctccttggggcaaagctgccctgacactgtctgtgtgcagcctgaggacgaggctgactattacgtcgccttactcttactttggtggtgtctgtgtcttagttcggcggaggaccaagctagaccgtctaacgtcgaacgcccaaggcctccgccccgtcggtccactccgtccgttccccgtcccc

SEQ ID NO: 133865 - DNA, 531 bp, Homo sapiens
  misc_feature: GYAE6OF02JBIXF.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctacggacccctgccccgattctcacggcctccctccttggggcaaagctcgccctgacactgtctggtgtgcagcctgaggacgaggctgactattactgcctactctactttggtggttgctgtgctagttcgggcggaggaccaagctagaccgtcgttaagtcagcccgaagcctcgccccgtcggtccacgtctcgtcccgtcccc

SEQ ID NO: 133866 - DNA, 543 bp, Homo sapiens
  misc_feature: GYAE6OF02IR6P0.17.33.C11.1.454.CMB.1.raw
  modified_base (486)..(486): a, c, t, g, unknown or other
  misc_feature (486)..(486): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctgacccctgcccgattctcacgcctcccgtccgttcggggacaaacgctcgccctgacactgtctggtgtgcacgctggaggacgaggctgacttacttactgccttactcttacgtttggttgtgcttgtgtcttagtcggcggacgggaccaagtcgtagtaccgtnttacgtcacgcccaaggctccgcccgtcgcacgttctccgttcccacctccttaccg

SEQ ID NO: 133867 - DNA, 523 bp, Homo sapiens
  misc_feature: GYAE6OF02GHNMN.17.33.C11.1.454.CMB.1.raw
  modified_base (446)..(446): a, c, t, g, unknown or other
  misc_feature (446)..(446): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctgacaagcacccagggcactcatttatagtacaaacaacaaacactcctgacccctgcccgatctcaggctcctccttggggcaaagctgccctgacactgtctggtgtgcagcctgaggacgaggctgactatactgcctactctactttggtggtgctgtgctagttcggngagggaccaagcgtgaccgtcttaagtcacgcccaaggctcgaccccgtcggtaacctcgtcgttccccgcctcccg

SEQ ID NO: 133868 - DNA, 536 bp, Homo sapiens
  misc_feature: GYAE6OF02I0PF6.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtaacaaacaacaaacactcctggacccctgcccgatctcaggctccctccttggggcaaagctgccctgacactgtctggtgtgcagcctggaggacgaggctgactattactgcctactctactttggtgtgctgtgctagttcgggcggagggaccaagcgtcgaccgttacttaacgtcacgcccgaaggtcctcgcccccgtcggtccacgtcttccgttccccgtcccc

SEQ ID NO: 133869 - DNA, 535 bp, Homo sapiens
  misc_feature: GYAE6OF02GODAG.17.33.C11.1.454.CMB.1.raw
  modified_base (297)..(297): a, c, t, g, unknown or other
  misc_feature (297)..(297): n is a, c, g, or t
  modified_base (508)..(508): a, c, t, g, unknown or other
  misc_feature (508)..(508): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttanagtacaaacaacaaacactcctggacccctgcccgattctcaggctccctccgttgggggcaaagctgccctgacactgtctggtgtgcagcctgaggacgaggctgactatactgcctactcttactttggtgtgcgttgtgcttagttcggcggacgggaccaagctgaccgttcttaagcacgcccgaaggcctcgccccctggtccncttcctccgttccccaccctcctcccg

SEQ ID NO: 133870 - DNA, 544 bp, Homo sapiens
  misc_feature: GYAE6OF02GU00Q.17.33.C11.1.454.CMB.1.raw
  modified_base (343)..(343): a, c, t, g, unknown or other
  misc_feature (343)..(343): n is a, c, g, or t
  modified_base (390)..(390): a, c, t, g, unknown or other
  misc_feature (390)..(390): n is a, c, g, or t
  modified_base (452)..(452): a, c, t, g, unknown or other
  misc_feature (452)..(452): n is a, c, g, or t
  modified_base (487)..(487): a, c, t, g, unknown or other
  misc_feature (487)..(487): n is a, c, g, or t
tcagcgtagactagcacgaccggtgctcgatttagagtgagctcgttgggtttggggctggcgccaggggtcccttccaatatcagcaccatgggccctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttaactatccaaactggttccagcagaaacctggacaagcacccaggcactcatttatagtacaaacaacaaacactcctcggacccctgcccgattcncaggctccctctgggggcaaagctagccctgacactgtactggtgtncgagcctgacgggacgaggtctgaactattactcgcctactctactttgggtgtgtctgtgntagttcggacggaaggaccaaggctaggaccgttnttaagtcaacgcccaaggccttacgccccttcggtccacctcttcgtccctaccccg

SEQ ID NO: 133871 - DNA, 704 bp, Homo sapiens
  misc_feature: GYAE6OF02JCCW3.17.33.C11.1.454.CMB.1.raw
  modified_base (294)..(294): a, c, t, g, unknown or other
  misc_feature (294)..(294): n is a, c, g, or t
tcagcgtagactagcacgaccggtgctcgatttagagtgagctcgttgggtttggggcgtggtgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactactcaactggttccagcagaacctggacaagcacccaggtcactnactttatagtacaaacaacaaacactacctcggaccctgacccgatctacacggcctccctccgttggggctaaacgctcgaccctgacactcgtcttcgggtgtcgaccgtagccccgttggaacgggaccggaaacgggtcgtacggaaaccttacgtttaacctcggtaccccgttaaaccttcccggttaaaccttttttcgggggtacgggtttccgggtcgtttggttaaccggtcgttttaaccggttcccgggttaccgggggaaacgggttaccggaaacgtccgttacggtaccccggttacgtttaacgtccgtaacggaccccgtaaagggcccgttaccggccccccgttacggttacccggacctttcccgttcccggttacccccttaacccccg

SEQ ID NO: 133872 - DNA, 516 bp, Homo sapiens
  misc_feature: GYAE6OF02H8YXF.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgcttagttcggcggacgggaccaagctgacgtcttagcagccaaggctcgcccctgtcactctcgtcccgccctctccc

SEQ ID NO: 133873 - DNA, 511 bp, Homo sapiens
  misc_feature: GYAE6OF02FW4XB.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagccctgacggacgaggctgactattactgcctactctactttggtgtgctgtgctagttcggcggaggaccagctgacgtctagtcagccaaggctcgccctcggtcactctcgtccctaccc

SEQ ID NO: 133874 - DNA, 514 bp, Homo sapiens
  misc_feature: GYAE6OF02I1EO2.17.33.C11.1.454.CMB.1.raw
  modified_base (340)..(340): a, c, t, g, unknown or other
  misc_feature (340)..(340): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattcncaggctccctccttggggcaaagctgccctgacactgtctggtgtgcagcctgaggacgaggctgactatactgcctactcttactttggtgtgctgtgctattcggcggagggaccaagctgaccgtnttaagtcagccaaggcncgcccctggtccactctcgtcccgtccc

SEQ ID NO: 133875 - DNA, 518 bp, Homo sapiens
  misc_feature: GYAE6OF02FRLLS.17.33.C11.1.454.CMB.1.raw
  modified_base (430)..(430): a, c, t, g, unknown or other
  misc_feature (430)..(430): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcatttatagtacaaacaacaaacactcctggacccctgcccgattctcaggctccctcttggggcaaagctgccctgacactgtctggtgtgcagcctgaggacgaggctgactattactgcctactctactttggtggtntctgtgctattcggcggagggaccaagctgaccgtcttagtcacgcccaaggctcgccccctggtcnctctcgtcccnccctcctccc

SEQ ID NO: 133876 - DNA, 520 bp, Homo sapiens
  misc_feature: GYAE6OF02GO87J.17.33.C11.1.454.CMB.1.raw
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (456)..(456): a, c, t, g, unknown or other
  misc_feature (456)..(456): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctcttggggcaaagctgccctgacactgtctggtgtgcagcctgaggacgaggctgactattacngcctactctacttggtgtnctgtnctattcggcggaggaccaagcngaccgtcttagcagcccaaggtctcgcccctcggtcctactcctcgttccccacctcctacccg

SEQ ID NO: 133877 - DNA, 514 bp, Homo sapiens
  misc_feature: GYAE6OF02IGL2V.17.33.C11.1.454.CMB.1.raw
  modified_base (219)..(219): a, c, t, g, unknown or other
  misc_feature (219)..(219): n is a, c, g, or t
  modified_base (436)..(436): a, c, t, g, unknown or other
  misc_feature (436)..(436): n is a, c, g, or t
  modified_base (506)..(506): a, c, t, g, unknown or other
  misc_feature (506)..(506): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaanactggagcagtcaccagtgcttacatccaaactggttccagcagaaacctggacaagcacccagggcactcattatagtacaaacaacaaacactcctggacccctgcccgattctcaggctccctccttggggcaaagctagccctgacactgtctggtgtgcagctagaggacgaggctgactattactgcttactcttacttggtgtgctgtgntattcggcggagggaccaaggctgaccgtcttacgcagcccaaggctcgcccctggtcactctcgtcccncctctccg

SEQ ID NO: 133878 - DNA, 543 bp, Homo sapiens
  misc_feature: GYAE6OF02HYJ4S.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgattctcaggcctccctccttggggcaaagctgccctgacactgtctggtgtgcagcctgaggacgaggctgactattactgcctactcttacgtttggtggtgtcttgtgcttagttcgggcggacgggaccaagctgaccgtcttaagtcacgcccgaaggcctcggcccccttcggtcctaccgtcttccgttcccctacccccg

SEQ ID NO: 133879 - DNA, 530 bp, Homo sapiens
  misc_feature: GYAE6OF02H4VTW.17.33.C11.1.454.CMB.1.raw
  modified_base (229)..(229): a, c, t, g, unknown or other
  misc_feature (229)..(229): n is a, c, g, or t
  modified_base (335)..(335): a, c, t, g, unknown or other
  misc_feature (335)..(335): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagcaccaggcactcatttatagtacaaacaacaaacactcctgaccctgccgattcncagctcctccttggggcaaagctgccctgacactgtctggtgtgcagcctgaggacgaggctgactattactgtcctactctacgtttggtgtgctgtgcttagttcggcggtagggaccaagctgaccgtcgttaacgtcacgcccaaggccgtacgcccccgtcggtcctactccgttccgttccctaccccg

SEQ ID NO: 133880 - DNA, 862 bp, Homo sapiens
  misc_feature: GYAE6OF02H5SBV.17.33.C11.1.454.CMB.1.raw
tcagcgtagactagcacgaccggtgctcgatttagagtgagctcgtgggtttagggggctggcgccaggggtcccttccgaatactcacgcgacctactagggccctggacctccttcgtctttctgttcctcctcacttgctcgccgagggttccaacttctcgagtacgtgtcggtcgtacgttcctagggtagcccttacttacgtaggtacttcgttgtccccagggagggacaggtcacgtcgtcgacctgggtagtcgttccaaacgaccgggttcggagcacgtcacctagtgcttactactccaaacgttggttccacgtctacgtaacctggaacaagaccaccgaggccacctacgactttacgaggtaacaaacaacaacgacttccgtacggacccctagtacccgtattcgtcgaacggtccgttccgttacgttacgggggaccaaaacggtccgtacggtccccgtagtacctacgttcggtacgttcgggtacgttacgaccgtaacgtcccgttacggaacggggtaaccggtaacggaccgttaaccggtaaacgtttaaacgttttaacccgtcggtttacccttaacgtttacccgtttaacgttttacggggttacgggttacgtaccggttacggtttcggtaccgtttaacgggttacccgggggaaccgggtaaaccgggggtaaccgtaacgggttccgttacggtaacccgtttaccgtttaaacgggtccgtaaccgggtacccgaaacggggtttcccgtacccggttacccccggttacgggtaccccgttaaccggtttcccgtttacccgggttaccccgttaccccccgg

SEQ ID NO: 133881 - DNA, 594 bp, Homo sapiens
  misc_feature: GYAE6OF02HGI03.17.33.C11.1.454.CMB.1.raw
  modified_base (291)..(291): a, c, t, g, unknown or other
  misc_feature (291)..(291): n is a, c, g, or t
  modified_base (387)..(387): a, c, t, g, unknown or other
  misc_feature (387)..(387): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcacccaggcactnatttatagtacaaacaacaaacactcctcggacccctgcccgattcctcaggcctccctccgttgggggacaaagctgccctgacactgtctggtntgcagcctgaggacgaggctgacttattactcgccttactcttacgtttggtgtgctgtcgtacgttagttcgggcgggtacgggaccaaggcgtacggtaccgttaccgttaagtcgacggtcccgaaagggtcctaccggtccccccgttacgggttccctaccgttccgttacccggttcccccgtccccttcccttaccccgg

SEQ ID NO: 133882 - DNA, 522 bp, Homo sapiens
  misc_feature: GYAE6OF02IC1OV.17.33.C11.1.454.CMB.1.raw
  modified_base (223)..(223): a, c, t, g, unknown or other
  misc_feature (223)..(223): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgttcccaggagggacagtcactctcacctgtgcttccaacnctggagcagtcaccagtgcttactatccaaactggttccagcagaaacctggacaagcacccagggcactcatttatagtacaaacaacaaacactcctggacccctgcccgattctcacggctccctcctcgggggcaaagctagccctgacactgtctggtgtgcagcctgaggacgaggctgactattctgcctactctactttggtgtgctgtgctagttcggcggagggaccaagctgaccgtgttaagcacgcccaaggcctcgcccctcggtccacgtctcgtcccgtcccc

SEQ ID NO: 133883 - DNA, 525 bp, Homo sapiens
  misc_feature: GYAE6OF02JIMM6.17.33.C11.1.454.CMB.1.raw
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgacccctgcccgattctcaggctccctctggggcaaagctgccctgacactgtctggtntgcagctgaggcgaggctgactattacngccttactcttactttggtggtncttgtgctagttcggcggtagggaccaagctgaccgttcttaagtcacgcccaaggctccgcccctggtccacgtctcgtcccgcccttcctcccg

SEQ ID NO: 133884 - DNA, 532 bp, Homo sapiens
  misc_feature: GYAE6OF02GR8NA.17.33.C11.1.454.CMB.1.raw
  modified_base (292)..(292): a, c, t, g, unknown or other
  misc_feature (292)..(292): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctgacaagcacccagggcacncatttatagtacaaacaacaaacactcctcggacccctgcccgattctcagctccctcgttggggcaaagctgccctgacactgtctggtgtgcagcctgaggacgaggctgactattactcgccttactcttacgtttggtggtgtctgtgcttagttcggcggagggacaagctacgaccgttcttagtcgacgcccgaaggctccgccccgtcggtccactctccgtccctaccccg

SEQ ID NO: 133885 - DNA, 553 bp, Homo sapiens
  misc_feature: GYAE6OF02GQO0B.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactacctcggacccctcgcccgattctcacggctcccgtccttcgggggcaaagctcgcctgacactgtcctggtgtgcagctgaggacgaggctgactattactgcccttactacttacgtttggtggtgcgttgtcgtcttagttcggcgggacgggaccaagctgaccgttacgttaacgtcaacgaccgaacggtcctacggccccgtcggtccactccttcgtccccgtcccc

SEQ ID NO: 133886 - DNA, 518 bp, Homo sapiens
  misc_feature: GYAE6OF02HE5RS.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggcctcgcccctggtccactctcgtccctacccc

SEQ ID NO: 133887 - DNA, 518 bp, Homo sapiens
  misc_feature: GYAE6OF02HBQFF.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagccctgaggacgaggctgactattactgcctactctactttggtgtgctgtgctagttcggcggagggaccaagctgaccgtcttagtcagcccaaggctcgcccctgtcactctcgtccctacctcctccg

SEQ ID NO: 133888 - DNA, 595 bp, Homo sapiens
  misc_feature: GYAE6OF02JCN5Q.17.33.C11.1.454.CMB.1.raw
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggaccctgccccgattctcaggcctacctccttggggcaaagctgccctgacactgtctggtgtgcagcctgaggacgaggctgactattactgcctactccgtacttttcggnggttncgtagtgtcgttagttccgggcgggtacgggaccgtaaagcgttacgacccgttcgttaacggtcctaacggtccccgaaagggtcccttaccggacccccccgttacgggttccctaacccgtttccgttaccggttttccccccaaccccccg

SEQ ID NO: 133889 - DNA, 634 bp, Homo sapiens
  misc_feature: GYAE6OF02H2Y3B.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttaccagcaagaaacctggaacaagccacccgaggcactcatttatagtaacaaacaacaaacactcctacggacccctcgaccccgattcctacacggccttccctccgttgggggaccaaaacggccgtacgtcccctagaacctaccgttcggtacgttgggtcgttcgaccgacgccgtacggagggacgacgggtctacgtactagttaacgtcgtacccttacttccttacgtttggtcggttgccgttgtcgtcgttacgttcgggcggaacgggacaacgtcgtacgtaccgtcgtttaacggccgacgcccgaaggtcctccggtcccccgtccggtacctccgttcgtcccgttcccctacccccg

SEQ ID NO: 133890 - DNA, 510 bp, Homo sapiens
  misc_feature: GYAE6OF02GRV2U.17.33.C11.1.454.CMB.1.raw
  modified_base (465)..(465): a, c, t, g, unknown or other
  misc_feature (465)..(465): n is a, c, g, or t
  modified_base (495)..(495): a, c, t, g, unknown or other
  misc_feature (495)..(495): n is a, c, g, or t
tcagcgtagactagcacgaccggtgctcgatttagagtgagctcgttgggtttggggctggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctggacccctgcccgattctcaggctccctcttggggcaaagctgccctgacactgtctggtgtgcagcctgaggacgaggctgactatactgcctactctactttggtggtgctgtgctagttcggcggaggaccaagctgaccgtntaagtcagccgaagctcgcccctcggtccnctctcgtccctcccg

SEQ ID NO: 133891 - DNA, 544 bp, Homo sapiens
  misc_feature: GYAE6OF02I8R9M.17.33.C11.1.454.CMB.1.raw
  modified_base (412)..(412): a, c, t, g, unknown or other
  misc_feature (412)..(412): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggacccctgcccgattctcagcctccctccgttggggacaaagctgcctgacactgtctggtgtgcagctgaggacgaggctgactattacngtcctactcttacgtttggtgtgctgtgtctagttcgggcggacgggaccaaggtctgaccgttcttagtcacggcccaaggcctccgcccccgtggtccacgtccgtccgttccccgcccttccctacccg

SEQ ID NO: 133892 - DNA, 690 bp, Homo sapiens
  misc_feature: GYAE6OF02JBYVR.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctgacaagcacccaggcactcatttatagtacaaacaacaaacactcctacggacccctcgcccgtattcctccacggcctacccgttcccgttcgggggacaaacgctacgcccgtcgaccaccgtgtccgttggtgtcggacgacgtcccgtaggacgggaacggtagggccgtaggtaacttaacgttacttcgtacccttaaccgttccgttaacgttttcgggttcgggttcgtccgttaggttgtaccgtttacggtttccgggacgggtacggggaacccgtaacggtacgtcggtaccgttaccgttaacggttccgtaaccggtccccgaacgggtcccgtcccggtcccccccggttcgggttacccgtaccgttcccgtttacccggttaccccccttaacccccccg

SEQ ID NO: 133893 - DNA, 558 bp, Homo sapiens
  misc_feature: GYAE6OF02HJ8CS.17.33.C11.1.454.CMB.1.raw
  modified_base (302)..(302): a, c, t, g, unknown or other
  misc_feature (302)..(302): n is a, c, g, or t
  modified_base (427)..(427): a, c, t, g, unknown or other
  misc_feature (427)..(427): n is a, c, g, or t
tcagcgtagactagcacgaccggtgctcgatttagagtgagctcgttgggtttggggctggcgccagggtcccgttccaatatcagcaccatggcctggactcctctctttctgttcctcctcacttgctgcccaggggtccaattctcagactggtggtgactcgaggagccctcactgactgtgtccccaggagggacagtcactctcacctgtgcttccaacactggagcagtcaccagtgcttacatccaaaactggttccagcagaaacctggacaagcacccaggcactcatttanagtaacaaacaaacaaacactacctaggaacccctgaccccgattctcacggctccctccttgggggccaaagctcgccctgacctactgtctggtcgtgccaagccctgacgggaccgaggccngacctattacctaggcctacttctacgtttgggtggtacgcttggtcgtcgtagttcgcggacgggacaagctacgaccgtattaacgtcacgccaaggctcgcccctcggacaccgtctcgttcccgccc

SEQ ID NO: 133894 - DNA, 550 bp, Homo sapiens
  misc_feature: GYAE6OF02ID8HS.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttataagtacaaaacaacaaaacactacctcggacccctcgaccccgattctcaggcctccctccgttgggggcaaagctcgccctgacactgtctggtgtgcagccgtgacggaggaggctgacttattaactgtccctacttccttacgtttggtggtgtctggttgcttagttcgggcgagggaccagcgtgaccgttgtaagtcacgcccaaggcctcgccccgtcggctacctctccgtccccgtccc

SEQ ID NO: 133895 - DNA, 527 bp, Homo sapiens
  misc_feature: GYAE6OF02F2SXF.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaaacactacctggacccctgccccgattcctcacggcctccctccttggggcaaagctgccctgacactgtctggtgtgcagcctgaggacgaggctgactattactgcctactcttactttggtggtgctgtgcttattcggcggaggaccaagctgaccgtctaagtcagcccaaggctcgccccgtcggtccactcctcgtccccgtcccc

SEQ ID NO: 133896 - DNA, 543 bp, Homo sapiens
  misc_feature: GYAE6OF02I1LVD.17.33.C11.1.454.CMB.1.raw
  modified_base (521)..(521): a, c, t, g, unknown or other
  misc_feature (521)..(521): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggcctccctccgttggggcaaagctcgcctgacactgtcctggtgtgcagcctgacggacggaggctagactattactcgcctactcttactttggtggtgtctgtgctagttcgggcggagggaccaaggcgtcgaccgttcttacgtcgacgacctaaggctccgccccgtcgtccnccgtcttccgttccctaccccg

SEQ ID NO: 133897 - DNA, 515 bp, Homo sapiens
  misc_feature: GYAE6OF02IE24T.17.33.C11.1.454.CMB.1.raw
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacagcaccaggcactcatttatagtacaaacaacaaacactcctggacccctgcccgatctcagctcctccttggggcaaagctagccctgacactgtctggtgtgcagcctgaggcgaggctagacttatactgcctactctacgtttggngtgctgtgcttagttcggngacgggacagctgaccgttctaagtcagcccgaaggtctcgccccgtggtccactctcgttccctacccc

SEQ ID NO: 133898 - DNA, 626 bp, Homo sapiens
  misc_feature: GYAE6OF02I2KQ1.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactgttccagcaagaaacctggacaagcacccgaggcactcatttataagtaacaaacaaacaaacactcctacgacccctgcccgattctcacggcctccctccgttcggggacaaagctcgaccctgacactgtcgtggtgtcgcgacgccgtaggaggaacggaggctacgtaactacttaaccgtcgtaccttaccttacgttaccgtttgggtggtcgtcgttgttcgtcgttacggttcgggccgggtaacgggaaccgtaagtcgtacgtacccgttacgttaacggtcgaaccgacccggaacggtccgttacccggcccccgttaccggtcctaccgttcccgttaccgttccccctaccccg

SEQ ID NO: 133899 - DNA, 649 bp, Homo sapiens
  misc_feature: GYAE6OF02JJ593.17.33.C11.1.454.CMB.1.raw
  modified_base (303)..(303): a, c, t, g, unknown or other
  misc_feature (303)..(303): n is a, c, g, or t
  modified_base (567)..(567): a, c, t, g, unknown or other
  misc_feature (567)..(567): n is a, c, g, or t
tcagcgtagactagcacgaccggtgctcgatttagagtgagctcgttgggtttggggggcggccaggggtcccgttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttaccagcagaaacctggacaacgcaccgacggacactcaatttanagttaacaaacaacaaacaactcctcggaacccctcgacccgatttccaccgtaaggcctacccttcccgttaggggggaccaaaaggcctagccccgtaggaacccacttgtcctggggtctcggtacacggcctacggacgggacggtacggtaccgtagtaacgttacttaccgtgtcccgttacttacttacgtttgggttcggtcgtcgttgtcgtacgttacgttcggacgggtacggacgtagcgttacgaccgttnttacgtcgacggccctaaggcctacggcccccttccgggtacctaccgttccgtccgttaccccctacccgttccttacccg

SEQ ID NO: 133900 - DNA, 562 bp, Homo sapiens
  misc_feature: GYAE6OF02GDI2M.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcgaccctgcccgattctcagcctccctccgttggggcaagctcgccctgacactgtctggtgtgcagcctggaggacgaggctgactattactcgccttactcttacgtttggtggtcgcgtgtgcttagttccgggcggacgggaccaagtcgtagtaccgtcttacgtcacgcccgaaggtcctccgtcccccgtcggttccaccttccgttccgttaccccctaccccttcccttacccg

SEQ ID NO: 133901 - DNA, 721 bp, Homo sapiens
  misc_feature: GYAE6OF02IZJEI.17.33.C11.1.454.CMB.1.raw
  modified_base (328)..(328): a, c, t, g, unknown or other
  misc_feature (328)..(328): n is a, c, g, or t
  modified_base (512)..(512): a, c, t, g, unknown or other
  misc_feature (512)..(512): n is a, c, g, or t
tcagcgtagactagcacgaccggtgctcgatttagagtgagctcgttgggtttggggcgtggcgccaggggtcccttccaatatcagcaccatggcctggactcctctcttctgttcctcctcacttgctgcccagggtccaattctcagactgtggtgactcaggagccctcactgactgtgtccccaggagggacagtcactctcacctgtcgcttacccaacactggagcaagtccaaccagtcgctttactactaccaaactggttccagcaagaaacctggaacaagccaccaacgggtcacgtcatttactagtaccaaaanaaacaaacaccgtcctacggaaccctcgaccccgtattcctacacggtccctcccgttcccggtacgggggactaaacgccgttacgccccgtagaacccttaccgtgttcccgtggggtcgtacgccgtaacgccgttacggaacgggaacggtcggacgttcgaaaccgttaacgtttaccncggttaccctaacgttcccgtttaacgtttcgggtcgggtttacgccgtttggttcgtaccgtttacggttccggggacgggtaacggggaccctaaaggccgttcggttaacccggtcttttaaacggacgtaccggaaccccggaagtcccgttacggccccccgtttcgggacctaccttacccgtttccgtaccccccgtaaccc

SEQ ID NO: 133902 - DNA, 528 bp, Homo sapiens
  misc_feature: GYAE6OF02GB359.17.33.C11.1.454.CMB.1.raw
  modified_base (471)..(471): a, c, t, g, unknown or other
  misc_feature (471)..(471): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgacccctgcccattctcacgctccctccgttggggcaaagctgccctgacactgtctggtgtgcagcctgaggacgaggctgactattactgtcctactcttactttggtgttgctgtgtcttagttcggcggaggaccaagctcgaccgtnttagtcacgcccaaggcctccgcccctggtccactcctcgttcccaccctcctcccg

SEQ ID NO: 133903 - DNA, 560 bp, Homo sapiens
  misc_feature: GYAE6OF02GDIOM.17.33.C11.1.454.CMB.1.raw
  modified_base (341)..(341): a, c, t, g, unknown or other
  misc_feature (341)..(341): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctaggacccctgccccgattcncaggctccctccttggggcaaagctgccctgacactgtctggtgtgcagcctgaggacgaggctgactattactcgccttactcttacgtttggtggtcgctgtgcttagttcgggcggtacgggaccaaggcctacggtaccgttacttaacggtccgacgacccgaaggtccgtccgcccccgttcggtcctaccgtccttcgttcccctacccccg

SEQ ID NO: 133904 - DNA, 536 bp, Homo sapiens
  misc_feature: GYAE6OF02JFTE5.17.33.C11.1.454.CMB.1.raw
  modified_base (432)..(432): a, c, t, g, unknown or other
  misc_feature (432)..(432): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactacctggacccctgcccgattctcaggctccctccttggggcaaagctgccctgacactgtctggtgtgcagcctgaggacgaggctgactattactgcctactctactttggngtgctgtgctagttcggcggtagggaccaagctgaccgttactaagtcacgacccaaggtcctccgccccctcggtcctaccttcgtccgttcccctacccccg

SEQ ID NO: 133905 - DNA, 533 bp, Homo sapiens
  misc_feature: GYAE6OF02F2QCY.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctcgacccctgcccgattctcaggctccctccgttggggcaagctgccctgacactgtctgtgtgcagcctggaggacgaggctgactattactgcctacttctactttggtggtgtctgtgcttagttcggcggacggacaagctgaccgtcgttaagtcacgacccgaaggccgtcggccccgtcggtccactccgttccgtccccgtcccc

SEQ ID NO: 133906 - DNA, 741 bp, Homo sapiens
  misc_feature: GYAE6OF02ITBUG.17.33.C11.1.454.CMB.1.raw
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttaccaacactggagcagtcaccagtgacttactataccaaactggttccagcaacgaaacctggacaagcacccagggcactcatttanagtaacaaacaacaaacactcncgaccctgcccgtatctcacggcctccctccgttcggggacaaacgctcgtccctagactacgtcgtcgtggtgtcgcacgtcctaggacgggaacgagggtctaggtacttaagttacgtcgtacccgttactttaccgttaacggtttttgggttcgggttcggtcgtttcggttacggttaccgtttacggtttccgggggaccggggtaaccgggggtaaacccgtaaacgggtaccgtttacgggttaaccccggtttaccgttttaaacgggttacctaaccggggtaccccgtaaaaccggggtcccggttaccccggtacccccccggttaccggtttacccgtaccccggtttacccgtttccccgggttttcccccccggttacccccgtttcccctttaaccccgg

SEQ ID NO: 133907 - DNA, 519 bp, Homo sapiens
  misc_feature: GYAE6OF02FRB41.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttattatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgcttattcggcggaggaccaagctgaccgtctaagtcagcccaaggcctgccccctcggtccactctcgttcccgtcccc

SEQ ID NO: 133908 - DNA, 521 bp, Homo sapiens
  misc_feature: GYAE6OF02GVY8U.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactacctgacccctgcccgattctcaggctccctccttggggcaagctgccctgacactgtctggtgtgcagcctgaggacgaggctgactatactgcctactctactttggtgtgctgtgctagttcggcggagggaccaagctgaccgttctagtcagcccaaggcctcgccccgtggtccactcctcgtccccaccctcctcccg

SEQ ID NO: 133909 - DNA, 524 bp, Homo sapiens
  misc_feature: GYAE6OF02G8ZZT.17.33.C11.1.454.CMB.1.raw
  modified_base (296)..(296): a, c, t, g, unknown or other
  misc_feature (296)..(296): n is a, c, g, or t
  modified_base (409)..(409): a, c, t, g, unknown or other
  misc_feature (409)..(409): n is a, c, g, or t
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
  modified_base (498)..(498): a, c, t, g, unknown or other
  misc_feature (498)..(498): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattanagtacaaacaacaaacactacctggacccctgcccgattctcaggctccctcgtggggcaaagctgccctgacactgtctggtgtgcagcctgaggacgaggctgactatacncgcctactcttacttggtgtgctgtgcttagtcggcggaggaccaagcngaccgtntacgtcacgcccaaggcctcgccccttggtccncgtctcggttccccgccctctacccg

SEQ ID NO: 133910 - DNA, 562 bp, Homo sapiens
  misc_feature: GYAE6OF02ITFAU.17.33.C11.1.454.CMB.1.raw
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagtcagaaacctggacaagcacccaggcactcatttatagtacaaacaacaaacactcctcgacccctcgcccgtattctcagcctccctccttcggggacaaagctgcctgacactgtctggtgtgcagtcctgaggacgaggctgactattactgcctactcttacgtttggtgtgctgtgtcttagtcggcgggaggaccgaagtcgtgaccgttacgttacgtcacgtcccgaacggtccgtccgccccgttcggtcctaccgttccgttccgttccccgtcccttcccgttacccg

SEQ ID NO: 133911 - DNA, 535 bp, Homo sapiens
  misc_feature: GYAE6OF02GM56J.17.33.C11.1.454.CMB.1.raw
  modified_base (229)..(229): a, c, t, g, unknown or other
  misc_feature (229)..(229): n is a, c, g, or t
  modified_base (423)..(423): a, c, t, g, unknown or other
  misc_feature (423)..(423): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagcacccagggcactcattatagtacaaacaaacaaacactcctaggacccctgcccgattctcacggctccctcttgggggcaaacgctcgccctgacactcgtctggtgtgtcagccgtgaggacgaggtctgactattactnccttactcttactttggtggtcgtcgtgtgcttagttcggcggtaggacagcctgaccgttctaagtcagcccaaggctcgccccgtcggtccactccttcgtcccgtcccc

SEQ ID NO: 133912 - DNA, 514 bp, Homo sapiens
  misc_feature: GYAE6OF02I3I77.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctggacccctgcccgattctcaggctccctcctggggcaaagctgccctgacactgtctggtgtgcagcctgaggacgaggctgactattactgcctactctactttggtgtgtctgtgctatcggcgagggaccaagctgacgtcttagtcacgccaaggctcgcccctcggtcaccgtctcgttcccctacccg

SEQ ID NO: 133913 - DNA, 569 bp, Homo sapiens
  misc_feature: GYAE6OF02FH3BP.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctccctcttcggggcaagctgccctgacactgtctggtgtgcacgcctggacggacgacggctacgacttacttactcgccttactcttacgtttggtggtgctgtgtcgttagttcggcgggtacggaccagcgtcgtaccgttacttaacggtcaccgacccgaaggcctacccggtcccccgttcgggtaccctaccgttccgttccgttccccctacccccg

SEQ ID NO: 133914 - DNA, 578 bp, Homo sapiens
  misc_feature: GYAE6OF02G73V8.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactacctcgaccctcgcccgattctcgacggcctccctccgttcgggggacaaacgctcgccctgacactcgtcgtggtgtgcgacgcctggagggacggaggcgtgactattactgtccttactcttacgtttggttggtgtctgtgcttagtcgggacggacgggaccgaagtcgtacgaccgttacgttagtcacggcccgaacggtcctccgccccgtcggtccaccgttccgttccgttccccgtcccttcccgtcccg

SEQ ID NO: 133915 - DNA, 704 bp, Homo sapiens
  misc_feature: GYAE6OF02HA7LB.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgacctcgaggacgccctcactgactgtccgtcccgagggagggacagtcactctccacctggtcgtccttaccaactacgtgggacgcgacgtccaccgagtcgtaccttaactactaccaaacgttcggttaccgacgcaacgtaaaccgtggaacaacgccacccgacgggcactctatttatacgtaacaaacaaaccaaactacctccgtaccggtacccctcgacccgtacttctacgacggtcctcccgtcggttcggggacaaacgtcgtcgccctagactacgttgtcgtgggtcgtcgcgacgtccgtagggacggacggacggcgtacgtaacttaactttacgtccgtacccttacttacctttacggtttgggtcggttcgtcgttggtcgtcttacggttcgggacgggtaacgggaaccgtaacgtccgttacggtaccgtttacgtttaacgtcgtaaccggtacccggaacggtccgtcccggtcccccgttcggtaccctaccgttcgttcccggttccccgtcccccg

SEQ ID NO: 133916 - DNA, 593 bp, Homo sapiens
  misc_feature: GYAE6OF02HZTAC.17.33.C11.1.454.CMB.1.raw
  modified_base (375)..(375): a, c, t, g, unknown or other
  misc_feature (375)..(375): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacactggagcagtcaccagtgcttactatccaaactggttccagcagaaacctggacaagcaccgaggcactcatttatagtaacaaacaacaaacactcctacgaccctcgcccgtatctcacggccttcccgtcgttcggggacaaagctanccctgacactgtctggtgtgcacgtcgtgacggacgagctgtactaattacgtacgaccttatccttacgttggtcgtgcgttggtcgtacttaggttcggacgggtacgggaaccgtaacgcgttacgaccgttacgtttaacggtaccgacgtcccgaaacggtcctccgtcccccgtcggtacctaccgttcttacccggtcccccttaaccccg

SEQ ID NO: 133917 - DNA, 548 bp, Homo sapiens
  misc_feature: GYAE6OF02HGBT9.17.33.C11.1.454.CMB.1.raw
  modified_base (334)..(334): a, c, t, g, unknown or other
  misc_feature (334)..(334): n is a, c, g, or t
  modified_base (378)..(378): a, c, t, g, unknown or other
  misc_feature (378)..(378): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctgacaagcacccagggcactcatttatagtacaaacaacaaacactcctgaccctgcccgatcncagctccctcgtggggcaagctgcctgacactgtctggtgtgcngctggaggacgaggctgactattactgccttactctactttggtgtgtcgtgtgtctagttcggcgggtagggaccaagcgtacgaccgtacttagtcacggcccaaggcctcggcccccgttcggtacctaccgttcgttcccggttccccgtcccctcccgttacccg

SEQ ID NO: 133918 - DNA, 637 bp, Homo sapiens
  misc_feature: GYAE6OF02IBW1V.17.33.C11.1.454.CMB.1.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (440)..(440): a, c, t, g, unknown or other
  misc_feature (440)..(440): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacnctggancagtcaccagtncttactatccaaactggttccagcagaaacctggacaaacgcaacccgacgggacactaccatttacagtaacaaacaacaaacactctacggaccctcgcccgtatctacgacgcctccctcgttggggcaaacgctacgccctgacctacgtcgtcctggttcgtacggtcacgcctaggacggaggaacggcgtanacgttacttaacgtcgtacccttacttaccgttacgttttgggcggttacggtccgttggtacgtccgtttaacgttcgggacggggtacgggtaaccgaaaggtccgtacgtaccgttacgttaacgtccgtacggtaccctaagggcctccgggtaccccctcggtcctaccgtcttccggttcccccgtccccg

SEQ ID NO: 133919 - DNA, 585 bp, Homo sapiens
  misc_feature: GYAE6OF02HZYDC.17.33.C11.1.454.CMB.1.raw
  modified_base (295)..(295): a, c, t, g, unknown or other
  misc_feature (295)..(295): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtcaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttanagtacaaacaacaaacactcctggacccctgcccgattctcaggctccctccgttggggacaaagctcgccctgacactgtctggtgtgcacgcctggacggacgacggctgactattactcgccttactcttacgtttgggtgtgtcgttgtgtcttagttccgggcggagggacctaaggctacggtacccgttcgtttaacgccgtacggcccgaaggtccgtccggtccccccgtcgggttcctaccgttccgttccggtttccccccgtcccttccccttacccg

SEQ ID NO: 133920 - DNA, 581 bp, Homo sapiens
  misc_feature: GYAE6OF02HE0NM.17.33.C11.1.454.CMB.1.raw
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (391)..(391): a, c, t, g, unknown or other
  misc_feature (391)..(391): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaacctggacaagcaccgaggcactcatttanagtacaaacaaacaaacactctcggacccctgcccattcncacggcctcctcgtggggacaaagctcgcctgactactcgtcgtggtgtgcngcctggaggacgaggctgtacttattactcgtaccttactcttacgtttggtagggttcgcgttgttcgtcgttacggttcgggtaccgggacgggaccgaaggtcctacggtaccgttacgttaacgtcgacgccggaacgtccgtccgtccccgttcggtcctaccgttccttccgtccccggtaccc

SEQ ID NO: 133921 - DNA, 175 bp, Homo sapiens
  misc_feature: GYAE6OF02GYVSJ.17.33.C11.1.454.CMB.1.raw
  modified_base (173)..(175): a, c, t, g, unknown or other
  misc_feature (173)..(175): n is a, c, g, or t
tcagcgtagactagcacgaccggtgctcgatttagagtgagctcgttgggtttgggggaagaggaagactgacggtcccccaggagttcaggtgctgggcacagcggccctgggctgcctggtcaaggactacttccctagtctacgctgagcgggctggcaaggcgcatagnnn

SEQ ID NO: 133922 - DNA, 590 bp, Homo sapiens
  misc_feature: GYAE6OF02I9VDX.17.33.C11.1.454.CMB.1.raw
  modified_base (335)..(335): a, c, t, g, unknown or other
  misc_feature (335)..(335): n is a, c, g, or t
  modified_base (447)..(447): a, c, t, g, unknown or other
  misc_feature (447)..(447): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgaccctgccgattcncaggctccctccgttggggacaaacgctcgccctgacactgtcgtgtgtgcacgctggacggacgacggctcgtaactattacctcgccttactctacgtttggttgtcggntgtcgtcttagttcggcgggaacgggaccaaggcgtaggtaccgttaccgttacgtacgacggtcccaacggtcctaccggtccccccgttacggttcccgtaccttccgttccgttcccccgtaccccttccccgttacccg

SEQ ID NO: 133923 - DNA, 573 bp, Homo sapiens
  misc_feature: GYAE6OF02F8M7G.17.33.C11.1.454.CMB.1.raw
  modified_base (468)..(468): a, c, t, g, unknown or other
  misc_feature (468)..(468): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccgagggagggacagtcactctcacctgtgccttaccaacactggagcagtccaccagtgcttactactccaaactcggttccagcaacgaaacctggacaagcacccgagggcactcatttatagtaacaaacaaacaaacactcctacggacccctgccccgtattcctcacggcctccctccgttcgggggacaaagctcgccctgactactgtcgtggtgtgcagctggaggacgaggctgactattactcgccttactcttacgtttggtggtgntgtgtcttagttcgggacggacggaccaagcgtcgtaccgttcgttaacgtcacgacccgaaggccgtccgccccgtcggtccacgtcgttccgtcccctccccg

SEQ ID NO: 133924 - DNA, 746 bp, Homo sapiens
  misc_feature: GYAE6OF02HK4VH.17.33.C11.1.454.CMB.1.raw
  modified_base (455)..(455): a, c, t, g, unknown or other
  misc_feature (455)..(455): n is a, c, g, or t
tcagcgtagactagcacgaccggtgctcgatttagagtgagctcgttgggtttggggggtcggccgaggggtcccgttccgaatatcagcaccatggcctggactcctctctttctgttcctcctcacttgctgccagggtccaattctcagactgtggtgactcaggagccctcactgactgtgtccccaggagggacagtcactctcacctgtgcttcaacactggagcagtcaccagtgcttaactactcctaaactcggttccagacaagaaaccgtaggaacaacgacaacccgacgggtcaactacatttataagtaacaaaactaaacaaacaacgtcctacggaacccctgacccgtaattcctacacgggtacctcccctccggtttacggggggaacctaaacggtcttcgaccccgtaggtaaccaacttgttccgtcgggttnttcggacgcgtaccgtacggaacgggtacgacgggacgtcgaacgttaacttaacgtcgaccttaccttacttaacgttttgggttacgggttgtcgttcgttacggtacgtttacgttccggggtacgggtaaccggggactaaacgggtcgtaaccggtaccggttaccttaacggttaccggtaaccgacccggtaaaccgtcggtacccgtccccccggttagggttaccccgtacccttaccggtttaccccgtttccccgttaacccccttccccgtttaccccg

SEQ ID NO: 133925 - DNA, 522 bp, Homo sapiens
  misc_feature: GYAE6OF02GBLEW.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcagctccctcttggggcaaagctgccctgacactgtctggtgtgcagcctgaggcgaggctgactatactgcctactctacttggtggtgctgtgcttgttcggcggaggaccaagctcgaccgttacttaacggtcacgcccgaaggctcggcccctggtccactcgtcgtcccctacccc

SEQ ID NO: 133926 - DNA, 575 bp, Homo sapiens
  misc_feature: GYAE6OF02I9Q26.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggacccctgcccgattctcaggctccctcgttggggcaagctcgccctgacactgtctggtgtgcacgccgtgaggacgaggctgactattactcgtccttacttcctacgttttggtggttgcttggtcgtcgttagttcgggcgggaacgggaccaaggtccgtaggaccgttcgttaacggtcgacgacccgtaaggtcctacggtccccccgtcggtaccaccgttccgttccgttccccctaccccg

SEQ ID NO: 133927 - DNA, 550 bp, Homo sapiens
  misc_feature: GYAE6OF02HVTGZ.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctcgcccgattctcacggctccctccgttgggggcaaagctgccctgacactgtctggtgtgcagcctgaggacgaggctgactattactgcctacttctacgtttggtgtgtcgtgtgtctagttcgggcggagggaccaagcgtcgaccgtacttagtcacgcccaacggctaccgtccccctcggtccacgttccgtccgttccccgtccctcccttcccg

SEQ ID NO: 133928 - DNA, 557 bp, Homo sapiens
  misc_feature: GYAE6OF02F91NL.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctaggacccctgccccgattcctcacggcctccctccgttgggggacaaagctgcccctgacacgtgtcgtggtcgtgcagccgtggacggacggaggcgtgacctattaccgtgccctactcttacgtttggtggtgcgttgtgcgtttagtcgggcggtaaggaccgaagcgtacgacgttacgtagtcacgcccgaagcctccgcccctcggtcctacgtctccgtcccgtcccc

SEQ ID NO: 133929 - DNA, 678 bp, Homo sapiens
  misc_feature: GYAE6OF02H0OS6.17.33.C11.1.454.CMB.1.raw
  modified_base (171)..(171): a, c, t, g, unknown or other
  misc_feature (171)..(171): n is a, c, g, or t
  modified_base (310)..(310): a, c, t, g, unknown or other
  misc_feature (310)..(310): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccaacactggagcagtcaccagtgcttactatccaaaacttggttaccagacaagaaacctgggaacaagcaacccgagggcaactcactttaanagtaacaaacaaacaaacactctacggaccctgacccgattctcacggcctcctcccgttaggggacaaagctcgcctagaccactgtcttggtagtcgtcagtccgtggaacggacgaggtcgtagaacgttaattacgtcgaccttaacctttacgttaacgttttcgggttaggtcggacttggtcgtacgtttagtttccggggaccgggtaagggtaccgtaacggtcgtaacgggtacccgtttacgttaacgtccgtaacggtaaccccgaaaggtcccgtaccggtcccccccgttacgggttaccacccgtttacccgtttcccggttcccccgttccccggttaccctttaaccccgg

SEQ ID NO: 133930 - DNA, 540 bp, Homo sapiens
  misc_feature: GYAE6OF02F2Y2P.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcattatagtacaaacaacaaacactcctggacccctgcccgattctcaggctccctccttggggcaaagctgccctgacactgtctggtgtgcagcctggaggacgaggctgactattactgcctactctactttggtggtgctgtgcttattcgggcggaggaccaagtcgtcgaccgttcttaacggtcacggacccaaggcctcggcccccttcggtccaccttcctcgttccccctaccccg

SEQ ID NO: 133931 - DNA, 543 bp, Homo sapiens
  misc_feature: GYAE6OF02GHVG9.17.33.C11.1.454.CMB.1.raw
  modified_base (299)..(299): a, c, t, g, unknown or other
  misc_feature (299)..(299): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaaacaaacactacctgacccctgcccgattctcaggctccctccttcggggcaaagctgccctgaccactgtctggtgtgcagcctgaggacgaggctagacttattacctgcccttactcttagtttggtggtgtctgtgctagttcggcggacgggacaagcgtgaccgttctaagtcaacgcccaaggcctaccggcccctcggtccctacgtcgtccgttccctacccccg

SEQ ID NO: 133932 - DNA, 562 bp, Homo sapiens
  misc_feature: GYAE6OF02F99F2.17.33.C11.1.454.CMB.1.raw
  modified_base (301)..(301): a, c, t, g, unknown or other
  misc_feature (301)..(301): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagcacccagggcactcatttanagtacaaacaacaaacactcctgacccctgcccgattctcacggcctccctcctggggacaaaggctcgccctgaccactgtctggtgtgcagccgtgaggacgaggctgactattacctgcccttactcttacgtttggtcggttgcttggtcgtcttagtttccgggacggacgggacctaagcgttacgtaccgttcgttaaggtcacgacccaaggccgtcgcccccgtcggtccaccgtcgtccgtcccctacccg

SEQ ID NO: 133933 - DNA, 656 bp, Homo sapiens
  misc_feature: GYAE6OF02FV6TA.17.33.C11.1.454.CMB.1.raw
  modified_base (461)..(461): a, c, t, g, unknown or other
  misc_feature (461)..(461): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactaccaaacgttcggttaccagcaacgaaaccgtggaacaagccaacccgagggccactctatttatagtaacaaacaacaaacactccgacgaccctcgccgattcctcgacggtcctccctcggttcggggacaaacgtcgtcgcccgtagacctacgttcgtcgtggtcgtgcacgtccgtggaacggacggacggtcgtcgacttaattacncggtacccttacttccttaacgtttgggtggtctcgttgtcgtctttacggttcgggacgggtacggaacctaacggtcgtacgaccgttacgttagtccgaccgtacccgaaggtccctacccggtccccccgttagggtaccctaccgttaccgttcccggttacccccttaccccgttccctttaaccccgg

SEQ ID NO: 133934 - DNA, 593 bp, Homo sapiens
  misc_feature: GYAE6OF02HHRUV.17.33.C11.1.454.CMB.1.raw
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgttcccaggagggacagtcactctcacctgtgcttaccaacactggancagtcaccagtgcttactatccaaactggttccagcagaaacctggacaagcaccagggcactcatttanagtacaaacaacaaacactacctcgacccctcgcccgtatctcacggcctccctccgttggggcaaagctcgccctgacactcgtctggtgtcgcacgtcctaggagggacgagggtcctaggtaacgtacttacttcgtcccttacttctttacgtttggtcggttgtcttgtgtcgttagttcgggcgggacgggaccaagcgtcggtaccgttacgttaacgtcgaccgtaccgaacggtcctccggtccccgtcggtacctaccgtccgttccggttaccccgtccccg

SEQ ID NO: 133935 - DNA, 692 bp, Homo sapiens
  misc_feature: GYAE6OF02GA1D3.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgccttccaacactggagcagtcaccagtgcttactactaccaaacgttggttccagacaacgaaacctggacaagccacccgaggcactctatttaataacgtaacaaacaacaaaccactaccgtcgacccctcgacccgtattcctcgacggtcccttacccgttccggttacgggggaaccaaacggtcctacgtccctacgacctacgttcggttcgttcggtcgtcgccgacgtccggtaggaacgggacggacggtacctagtaaccttacgttactccgtcctttaccttcgtttacgtttcgggtggttcgtacgttggtccgtacgttacggtcgggaccgggacggtaaccgaagtccgtacgtaccgttacgttacgacgtacccggacccggaacgtcccgtacccggttcccccgtacggttacccgaccgtttcccgttccccgtaccccgtccccgttccttacccgg

SEQ ID NO: 133936 - DNA, 564 bp, Homo sapiens
  misc_feature: GYAE6OF02I5SLK.17.33.C11.1.454.CMB.1.raw
  modified_base (410)..(410): a, c, t, g, unknown or other
  misc_feature (410)..(410): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctcggacccctgacccgatctcaggcctccctccttggggcaagctgcctgacactgtctggtgtgcagcctgaggacgagctgactattactncctactcttacgtttgggtcgtgtcttggtgtcttacgttcgggcggtagggaccaagtctagacccgttcttacgcacgcccgaaggcctaccggcccccgtggtaccctaccgttccgttaccggtttcccccgtccccttcccgttacccg

SEQ ID NO: 133937 - DNA, 571 bp, Homo sapiens
  misc_feature: GYAE6OF02GFVUM.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcaagaaacctggacaagcacccagggcactcattatagtaacaaacaacaaacactcctcgacccctcgacccgattctcacgcctccctccgttcggggacaaagctcgcctgacactgtctggtgtcgcgacgccgtggacggacgaggcgtcgacttattactcgtcctacttcttacgtttggtggtgtcgtgtgtcttagtcgggcggacggacaacgtcgtacgtaccgttacgttaacgtcgacgaccgaacggcctccgtccccgtccggtcctacgtccgttccgtcccctaccccc

SEQ ID NO: 133938 - DNA, 604 bp, Homo sapiens
  misc_feature: GYAE6OF02JMDYX.17.33.C11.1.454.CMB.1.raw
  modified_base (249)..(249): a, c, t, g, unknown or other
  misc_feature (249)..(249): n is a, c, g, or t
  modified_base (326)..(326): a, c, t, g, unknown or other
  misc_feature (326)..(326): n is a, c, g, or t
  modified_base (453)..(453): a, c, t, g, unknown or other
  misc_feature (453)..(453): n is a, c, g, or t
  modified_base (553)..(553): a, c, t, g, unknown or other
  misc_feature (553)..(553): n is a, c, g, or t
tcagcgtagactagcacgaccggtgctcgatttagagtgagctcgttgggtttggggggtcggccgaggggtcccgttccgaatatcagcaccatggcctggacgtcctctctttctgttcctcctcacttgctgcccagggtccaattctcagactgtggtgactcaggagccctcactgacctgtgtaccccagggagggacagtcactctcacctgtgcttccaacactggagcagtcaccagtcnctttacatcccaaaatgttccagcagaacctggacagcaccaggcactacattatacgtaacaaacaacaaacaccncctacggacccctcgcccgtacttcaccacggccttaccctcgtacggggacaaaggcctgccctgactactacgtcgtaggttcgtcgactagccctaggacggacgaggctagacgtattaccgntccgttacgtcttaacgttgtcgtgcgttgtcgtcttacgtcggccggggagtacccgaagtccgcggaccgttacctagttccgacggtcccgaagtcncccggtccctacggtcctacgttccgtccgttccccgtcctccccgttccg

SEQ ID NO: 133939 - DNA, 561 bp, Homo sapiens
  misc_feature: GYAE6OF02F1HVW.17.33.C11.1.454.CMB.1.raw
  modified_base (299)..(299): a, c, t, g, unknown or other
  misc_feature (299)..(299): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttcaacactggagcagtcaccagtgcttactatccaaactggttccagcagaaacctggacaagcacccagggcactcatttanagtaacaaacaacaaacactcctggacccctgcccgatctcaggctcctcgttggggcaaagctgccctgacactgtctggtgtgcagcgtgaggacgagctgactattactgcctactctactttggtggtgtctgtcgtctcgttcggccgggtaggacccgaagccgtacgtacccggttacttaaggtccaacggaccccgtaaggtcccgtacgcccccgttcggtcctacctccgttaccggttcccctacccccg

SEQ ID NO: 133940 - DNA, 821 bp, Homo sapiens
  misc_feature: GYAE6OF02JJKAQ.17.33.C11.1.454.CMB.1.raw
  modified_base (176)..(176): a, c, t, g, unknown or other
  misc_feature (176)..(176): n is a, c, g, or t
  modified_base (225)..(225): a, c, t, g, unknown or other
  misc_feature (225)..(225): n is a, c, g, or t
tcagcgtagactagcacgaccggtgctcgatttagagtgagctcgttgggtttggggggtcggccgaggggtcccgttccgaatatcagcaccatggcctggactcctctctttctgttcctcctcacttgctgcccagggtccaattctcagactgtggtgactcaggagccctnactgactgtgtccccaggagggacagtcactctcacctgtgcttccaanactggagcagtcaccagtcgcttacatccaaactggttcagcagaactgacaagcaccaggcactacattatacgtaacaaacaacaaacaactacctacggacccctcgtacccgtaacttccgtacacggtcctaccccgttacccgttacggggggtacaaaccggtcctacgaccccgttaggaccctaacgtcgttccggttacggttacggtcggtaccgtaacgtcccggttacggacggggtaaccgggtacgggtaccgtacgggtaaccgttaacgtttaaccgtaccgtacccggttaacctttaccgtttaacccgttttggggttcgggtttcggccgtttacggttacgggtaccgtttaacggtttccgggggtacccggggtaacggggtaacccgtaaagggtcccgttaacgggtacccggtttaaccgtttaacggtaccggtaaccggtaaccccccggtaagggtaccccggttcccgggtaaccccccccgtttaccggggttaccccctaaccgttacccggttaccccggggtttccccccgttacccccggttcccccctttaaccccggg

SEQ ID NO: 133941 - DNA, 523 bp, Homo sapiens
  misc_feature: GYAE6OF02GAA39.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggcctccctccttgggggcaaagctgccctgacactgtctggtgtgcagcctgaggacgaggctgactatactgcctactctactttggtgtgctgtgctagttcggcggagggaccaagctgaccgtcttagtcagcccaaggcctcgcccctggtccactcctcgttccccaccctcctccc

SEQ ID NO: 133942 - DNA, 568 bp, Homo sapiens
  misc_feature: GYAE6OF02GEZDL.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagcacccaggcactcatttatagtacaaacaacaaacactcctacggacccctgcccgattctcacggcctccctccgttcggggacaaagctacgccctagaccactgtcgtggtgtcgcagcctggacggacgaggctagacttacttactgacccttactcttacgtttggtcggttgtctagtgtcttagttcgggacggacggaccaagctcgaccgttctaacgtcacgacccgaacgtccgtcgcccccgttcggtcctaccgtcgttccgtccccgtcccc

SEQ ID NO: 133943 - DNA, 535 bp, Homo sapiens
  misc_feature: GYAE6OF02I197H.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctgacaagcacccagggcactcattatagtacaaacaacaaacactcctgacccctgcccgattctcagctccctcttggggcaagctgccctgacactgtctggtgtgcagctgaggacgaggctgactatactgcctactcttactttgtggtgtcgtgtgtcttagtcggacgggtagggacctaagctgacccgtattagtcaggcccaagggcctcggtccccctggtcctacctccgtcgttccccgccctcccttacccg

SEQ ID NO: 133944 - DNA, 589 bp, Homo sapiens
  misc_feature: GYAE6OF02GQNAQ.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcacggctccctcttcgggggcaaagctgccctgacactgtctggtgtgcagcctgaggacgaggctgactattacgtcgccttactccttactttgggtggtcgtcgttggtcgtcgtagttcgggacgggagggtacccaaggtcctacggacccgttactttaacggtccaacggccccgaaggtcccgttccggccccccgttaccgggttccctaaccgttccttaccggttccccctacccccg

SEQ ID NO: 133945 - DNA, 529 bp, Homo sapiens
  misc_feature: GYAE6OF02HST57.17.33.C11.1.454.CMB.1.raw
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccaggcactcatttatagtaacaaacaacaaacactccnggacccctgcccgatcncagctccctctggggcaaagctgccctgacactgtcgtcggtgtgcagcctgaggacgaggctgactattactgtcctactctacttggtagtgtctgtgctagttcggcggaggaccaagtctagaccgttcttaacgcaacggcccaaggcctacgcccctcggtccaccgtctccgtcccgtcccc

SEQ ID NO: 133946 - DNA, 527 bp, Homo sapiens
  misc_feature: GYAE6OF02HR7Z8.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcacccaggcactcatttatagtacaaacaacaaacactcctcgaccctgcccgattctcacggctccctccttgggggcaaagctgccctgacactcgtctggtgtgcagcctgaggacgagctgactatactgcctactctacttggtggtgctgtgctagttcggcggtagggaccaagctgaccgttcttaagtcacgcccaaggcctcgcccccgtcggtccaccgtctccgttccctaccccg

SEQ ID NO: 133947 - DNA, 548 bp, Homo sapiens
  misc_feature: GYAE6OF02HKA83.17.33.C11.1.454.CMB.1.raw
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccaggcactcatttatagtacaaacaacaaacactcctggacccctgcccgatctcagctcctcttggggcaagctncctgacactgtctggtntgcagcctgaggacgaggctaggactatactgtacctacttctacgtttggtggttgcgtgtcgcttagttcggcgggagggaccaaaggctacggaccgttacgtttaacgtctacggccctaaggcctcgccccgtacggtcctccgtaccttccgttcccctacccccg

SEQ ID NO: 133948 - DNA, 619 bp, Homo sapiens
  misc_feature: GYAE6OF02IMWWS.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgtcttactactccaaactggttccagcaagaaacctgacaagcacccgaggcactcatttatagtaacaaacaacaaacactcctacgaccctcgcccgtattctcacggcctccctccgttggggacaaagctcgcctgacactgtctggtgtcgcagcgtggacggacgaggctagacttattacgtgtcctacttcttacgtttggtcgtgtcgttgtgtcgttacgtccgggtacgggaacgggtaaccaacggtccgtacgtacccgtttacttaacgtccgtaccggacccgtaacgggtcctcccggtacccccgttaccggtcctacccgtttccgttcccggttccccccgtccccgttcccctttacccgg

SEQ ID NO: 133949 - DNA, 517 bp, Homo sapiens
  misc_feature: GYAE6OF02G6UXA.17.33.C11.1.454.CMB.1.raw
  modified_base (300)..(300): a, c, t, g, unknown or other
  misc_feature (300)..(300): n is a, c, g, or t
  modified_base (462)..(462): a, c, t, g, unknown or other
  misc_feature (462)..(462): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggacccctgcccgattctcagctccctccttgggggcaaagctgccctgacactgtctggtgtgcagcctgaggacgaggctgactattactgcctactctactttggtgtgctgtgtctgttcggcggaggaccaagcngaccgtcttaagtcacgccaaggctcgccccgtggtccactctcgtccctacccg

SEQ ID NO: 133950 - DNA, 536 bp, Homo sapiens
  misc_feature: GYAE6OF02GBV6K.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcaccagggcactcatttatagtacaaacaacaaacactcctggacccctgcccgatctcagctccctcttggggcaaagctgcctgacactgtctggtgtgcagcctgaggacgaggctgactattactgcctactcttactttggtggtgcgttgtgcttagttcggcggagggaccaagctgaccgtcttagtcgacgcccaaggtcctacgccccctcgggtccacgttcctcgttcccctacccgtcccttacccg

SEQ ID NO: 133951 - DNA, 561 bp, Homo sapiens
  misc_feature: GYAE6OF02F27NO.17.33.C11.1.454.CMB.1.raw
  modified_base (479)..(479): a, c, t, g, unknown or other
  misc_feature (479)..(479): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccgaggcactcatttatagtacaaacaacaaacactcctggacccctgccccgattcctcacggccttccccgtccgttcgggggaccaaaggcctacgcccctgaacactcgtcctgggtgtgcacgcctagaggacgaggctacgactattactgccttacttcttacgtttggtgtgctgtgcttagttcggnggacgggaaccaaggtcctgtaccgtactaaggtcacgacccgaaggtcctcgcccctcggtccactcttccgtccctaccc

SEQ ID NO: 133952 - DNA, 657 bp, Homo sapiens
  misc_feature: GYAE6OF02HW92K.17.33.C11.1.454.CMB.1.raw
  modified_base (343)..(343): a, c, t, g, unknown or other
  misc_feature (343)..(343): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaacgaaacctggacaagcacccagggcactctatttatagtacaaacaacaaacactcctacgacccctgcccattcncagcctccctccgttggggcaaagctcgccctagacactcgtctggtcgtgcagcctaggacggacggacggcgtacgtacttatttactcgtacccttacttacctttacgttttgggtacggttggtccgttggttcgtacgtttacggttcgggtaccgggacggggtaaaccaacgggtaccgtacggtacccggtttacgtttaacggtacgtaaccggtacccggtaaacgggtcccgttccggtccccccggttccggttacccgttaacccgttccgtttaccccggttaccccccttaccccccg

SEQ ID NO: 133953 - DNA, 536 bp, Homo sapiens
  misc_feature: GYAE6OF02G56ID.17.33.C11.1.454.CMB.1.raw
  modified_base (299)..(299): a, c, t, g, unknown or other
  misc_feature (299)..(299): n is a, c, g, or t
  modified_base (399)..(399): a, c, t, g, unknown or other
  misc_feature (399)..(399): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctaggacccctgcccgattctcaggctccctcttggggcaaagctgccctgacactgtctggtgtgcagcctgaggacgnggctgactatactgcctactctacgtttggtggtgcgtgtgctagttcggcggacgggaccaagctgaccgttcgttaagtcacgcccaaggtcctcggcccccgttcggtccaccgtcttccgttccccgtccccg

SEQ ID NO: 133954 - DNA, 594 bp, Homo sapiens
  misc_feature: GYAE6OF02GUZGR.17.33.C11.1.454.CMB.1.raw
  modified_base (412)..(412): a, c, t, g, unknown or other
  misc_feature (412)..(412): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactatccaaactggttccagcagaaacctggacaagcaccagggcactcatttatagtacaaacaacaaacactcctcgacccctgcccgattctcacggcctccctccgttcgggggacaaacgtctcgccctgacctactcgtcgtggtgtgcagcctggaggacgnggctgacttatactcgccttactcttacgtttggtcggtgtcgttgtgtcttagttcggcgggacggaccgaacgtcgtacgtaccgtacgttaacgtcgtacgaccccgtaaggtccgtccggtcccccgtcggtcctacccgttccgttcccgttacccctaccccgttcccttaccccg

SEQ ID NO: 133955 - DNA, 607 bp, Homo sapiens
  misc_feature: GYAE6OF02GVCHC.17.33.C11.1.454.CMB.1.raw
  modified_base (303)..(303): a, c, t, g, unknown or other
  misc_feature (303)..(303): n is a, c, g, or t
  modified_base (326)..(326): a, c, t, g, unknown or other
  misc_feature (326)..(326): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactcggttccagcaagaaacctggacaagcacccagggcactcatttanagtaacaaacaacaaacactccncggaccctcgccgtatctcacgctcctcgtcgggacaagctcgccctgacactgtcgtggtgtgcacgccgtaggaggacgacgctagacttattacttcgtaccttactcttacgtttggtgtcgtcgttgttcgtcttacgttccgggtcgggacgggtaccgacgggtctacggtacccgttacgttaacgtacgaccgtaacccgaacggtccgtacccggtacccccggttccggttacctacccgtttccttacccggttaccccccgtaccccg

SEQ ID NO: 133956 - DNA, 560 bp, Homo sapiens
  misc_feature: GYAE6OF02HFM73.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgttcccaggagggacagtcactctcacctgtgcttccaacactggagcagtcaccagtgcttactatccaaactggttccagcagaaacctggaacaagcacccaggcactcatttatagtaacaaacaacaaacactacctacggacccctcgcccgattctcacggcctccctccgttggggacaaacgctcgccctgacactcgtctggtgtgcagccgtgacggacgaggctgactattactcgacctactcttactttggtgtgtctgtgtctagtcgggcggagggaccagcgtcgaccgttcgttaacgtcgaacgtcccgaaggtccgtacgtcccccgtcggtcctaccgtccttccgttcccctaccc

SEQ ID NO: 133957 - DNA, 538 bp, Homo sapiens
  misc_feature: GYAE6OF02GRB04.17.33.C11.1.454.CMB.1.raw
  modified_base (458)..(458): a, c, t, g, unknown or other
  misc_feature (458)..(458): n is a, c, g, or t
  modified_base (473)..(473): a, c, t, g, unknown or other
  misc_feature (473)..(473): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactatccaaaactggttccagcagaaacctggacaagcacccagggcactcatttatagtacaaacaacaaacactcctcggacccctacgcccgattctcaggctccctccgttggggcaaagctgccctcgacactgtcgtgtgtgcagcgtgaggacgaggctgactattactcgcctactctacgttggtgtgcgtgtgctagttcggnggtacgggacaagcngtaccgtacgttacgtcgagcccgaagtccgtcgccccgtcggtccacgtcttcgtcccgtcccc

SEQ ID NO: 133958 - DNA, 542 bp, Homo sapiens
  misc_feature: GYAE6OF02HM86O.17.33.C11.1.454.CMB.1.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
  modified_base (411)..(411): a, c, t, g, unknown or other
  misc_feature (411)..(411): n is a, c, g, or t
  modified_base (445)..(445): a, c, t, g, unknown or other
  misc_feature (445)..(445): n is a, c, g, or t
  modified_base (478)..(478): a, c, t, g, unknown or other
  misc_feature (478)..(478): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggancagtcaccagtgcttactatccaaactggttccagctaagaacctggaacaagccaccaggcactctatttanagtaacaaacaacaaacactccacggacccctcgcccgattctcgacgctccctcgttggggacaaagctcgcctgacactcgtctgtgtgcgacgtgaggacgaggnagtctatctgcctactcttacttggtgtgctgtncgtagttcggcgtaggaccgagcctgtaccgtnttaacgcacgacccgagtccgtaccgccccgtcggtccacgttcctcgttccccacccttcccg

SEQ ID NO: 133959 - DNA, 560 bp, Homo sapiens
  misc_feature: GYAE6OF02HN21W.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcattatagtacaaacaacaaacactcctggacccctcgcccgattctcaggctccctccgttgggggcaaagctgccctgacactgtctggtgtgcagccgtgaggacgaggctgactagttactgtccttactctactttgggtcgtgtctgtcgtcttagttcgggcggtagggaccgaacggcgtcgtaccgtcttaacgtctacggcccaacggtcctcggccccctggtccacgttccttcttccccctacccttcccgttaccc

SEQ ID NO: 133960 - DNA, 546 bp, Homo sapiens
  misc_feature: GYAE6OF02H6B3D.17.33.C11.1.454.CMB.1.raw
  modified_base (476)..(476): a, c, t, g, unknown or other
  misc_feature (476)..(476): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcaagaacctggacaagcaccagggcactcatttatagtacaaacaacaaacactcctggacccctgcccgtattctcaggctccctccgttggggcaaagctcgcctgacactgtctggtgtgcagccgtgaggacgaggctagactattactgtcctactcttacgtttggtgtgtctgtgctagtcggcggaggaccaagcgtcgtaccgtnttacgtccacgaccgaacgccgtccgtcccccgtcggtcacctccttccgttaccctccctccttacccg

SEQ ID NO: 133961 - DNA, 527 bp, Homo sapiens
  misc_feature: GYAE6OF02HQUP5.17.33.C11.1.454.CMB.1.raw
  modified_base (296)..(296): a, c, t, g, unknown or other
  misc_feature (296)..(296): n is a, c, g, or t
  modified_base (387)..(387): a, c, t, g, unknown or other
  misc_feature (387)..(387): n is a, c, g, or t
  modified_base (468)..(468): a, c, t, g, unknown or other
  misc_feature (468)..(468): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttanagtacaaacaacaaacactcctaggacccctgcccgattcctcacggctacccctcgttcgggggcaaacgctgccctgacactgtctggngtgcagctgaggacgagctgactatactgtctactctactttgtgtgctgtgtctagtcggcggaggacagctcgaccgtnttacgtcacgaccacggctcgacccctggtaactcgtcgttacccaccctcctcctacg

SEQ ID NO: 133962 - DNA, 604 bp, Homo sapiens
  misc_feature: GYAE6OF02GU5B2.17.33.C11.1.454.CMB.1.raw
tcagcgtagactagcacgaccggtgctcgatttagagtgagctcgttgggtttggggtcgtggcgccaggggtcccgttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtcaaccagtgcttactatccaaactcgttcagcagaaacctggacaagcaccagggcactcattatagtaacaaacaaacaaacaactcctacggaccctcgaccatctcacgctcctcgtcggggacaaacggctcgcctagacctacgtgtacgtcggtgtcgcgacgtccgtaggaggacggaggcgttacgaacgtactttaactcggtacccttacgtactttacgtttggtcgggtgtcgtcgtagtcgttaagttccggacggggacgtacgaagtcgtagaccttacgtaagtcgacgtaccgaacggcttccggacccccggttgacccgtacgtcccgttaccgttcccctaaccccg

SEQ ID NO: 133963 - DNA, 633 bp, Homo sapiens
  misc_feature: GYAE6OF02HUV5S.17.33.C11.1.454.CMB.1.raw
  modified_base (171)..(171): a, c, t, g, unknown or other
  misc_feature (171)..(171): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccaacactggagcagtcaccagtgcttactatccaaactggttccagcagaacctggacaagcacccaggcactcattatagtacaaacaacaaacactcctacggaccctcgacccgacttcctcgacggcctccctccgttcgggggacaaagaccgtcgccctgaccacgtcgtcgtggtgtgcagccgtgacggacgaggctgtactacttacgtcgtaccttacttccttacgtttgggtgtcggtcttcggttcgtacgtttacgttccggggtaccgggaacggggtaacctaaggtccgtacggtacccgttacgttacgttacgaccggacccgtaacggtccctccggtccccccgtcggtcctaacccggttccttcccggttcccctccccgttcccttaccccgg

SEQ ID NO: 133964 - DNA, 547 bp, Homo sapiens
  misc_feature: GYAE6OF02GGP7E.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcattatagtacaaacaacaaacactcctggacccctgcccgattctcacgctccctcttggggcaaagctgccctgacactgtctggtgtgcagcctgaggacgaggctgactattactgccttactctactttggtgtgctgtgcttagtcggcgggacgggaccaagctggtaccgtcgttacgtcgacgcccgaaggcctcggtcccccgtcggtacctcctccgttcgttcccctacccttcccttacccg

SEQ ID NO: 133965 - DNA, 559 bp, Homo sapiens
  misc_feature: GYAE6OF02IV7UB.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcagaaacctggacaagcacccagggcactcatttatagtaacaaacaacaaacactcctaggacccctgcccattctaccaggctccctccgtgggggaccaaagctcgccctgacactgtctggtgtgcagcctgacggacgaggctgactattactgccttactcttacgtttggtgtgcttgtgcttagttcgggcggagggaccagtctacgaccgttcttagtcacgcccaacggctccggcccccgtggtccctacttccgtccggttccccgtcccttccccttacccg

SEQ ID NO: 133966 - DNA, 254 bp, Homo sapiens
  misc_feature: GYAE6OF02IBCL5.17.33.C11.1.454.CMB.1.raw
  modified_base (251)..(254): a, c, t, g, unknown or other
  misc_feature (251)..(254): n is a, c, g, or t
tcagcgtagactagcacgaccggtgctcgatttagagtgagctcgttgggtttggggagttattagtccctactttgactactggggccagggaactctggtcaccgtctccgcagcctccaccaagggcccatcggtcttccccctggcaccctcctccaagagcacctccgagagcacagccgccctgggctgcctggtcaaggactacttccctagtctacgctgagcgggctggcaaggcgcatagnnnn

SEQ ID NO: 133967 - DNA, 617 bp, Homo sapiens
  misc_feature: GYAE6OF02JB0BS.17.33.C11.1.454.CMB.1.raw
  modified_base (298)..(298): a, c, t, g, unknown or other
  misc_feature (298)..(298): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactcggttccagcagaaacctggacaagcaccaggcactcattanagtacaaacaacaacactcctcgacccctgcccgattctcacggtcctccctccgttcggggacaaagtctcgaccctgacactacgtcgtaggtcgtcgcagccgttaggacggacgaggtctacgactacttactcgtccttactccttacgttttggtcggtagtcgtagtggtcttacggttcgggacgggaacgggtaccgtaagtccgtacgtacccgttcgttaaccggtccgtaaccggcccgtaaacggccgtcccggtacccccgttacgggtaccctacgttcccttaccggttccccctaacccccg

SEQ ID NO: 133968 - DNA, 549 bp, Homo sapiens
  misc_feature: GYAE6OF02F4R0V.17.33.C11.1.454.CMB.1.raw
  modified_base (297)..(297): a, c, t, g, unknown or other
  misc_feature (297)..(297): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactcctggacccctgcccgattctcaggctccctcctggggcaaagctgccctgacactgtctggtgtgcagcctgaggacgaggctgactattactgcctactcttacgtttggtgtgcttgtgctagttcgggcggagggaccaagctgaccgttcttacgtcacgacccaaggtcctccgcccccgtcggtcctaccttccgttacgttcccccgtcccttcccgttaccccg

SEQ ID NO: 133969 - DNA, 567 bp, Homo sapiens
  misc_feature: GYAE6OF02I5NU4.17.33.C11.1.454.CMB.1.raw
  modified_base (399)..(399): a, c, t, g, unknown or other
  misc_feature (399)..(399): n is a, c, g, or t
  modified_base (413)..(414): a, c, t, g, unknown or other
  misc_feature (413)..(414): n is a, c, g, or t
  modified_base (481)..(481): a, c, t, g, unknown or other
  misc_feature (481)..(481): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggcctccctccttgggggcaaagctcgccctgacactgctggtgtgcagcctgaggacgnggctgactattacnncctactcttacgtttggtgtgcttgtgcttagttcgggcggtacgggaccaaggctacgtaccgttnttaacggtcacggccccgaaggtcctccgcccccgttggtacctaccgttccgttacggttcccccgccccgttcccttaacccgg

SEQ ID NO: 133970 - DNA, 517 bp, Homo sapiens
  misc_feature: GYAE6OF02H5R3J.17.33.C11.1.454.CMB.1.raw
  modified_base (380)..(380): a, c, t, g, unknown or other
  misc_feature (380)..(380): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
tcagcgtagactagcacgaccggtgctcgatttagagtgagctcgttgggtttggggctggcgccaggggtcccttcaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaaggcactcatttatagtacaaacaacaaacactcctggacccctgcccgatctcagctcctctggggcaaagctagccctagacactgtctggtntgcagcctgaggacaggctgactattacngctacnctatttggngtnctgtgctattcggcgagggaccaaggctgaccgtcttaacggctagcccaaggtctggaccccctcggtccactcgttcgtccccgtccc

SEQ ID NO: 133971 - DNA, 574 bp, Homo sapiens
  misc_feature: GYAE6OF02JDC9U.17.33.C11.1.454.CMB.1.raw
  modified_base (338)..(338): a, c, t, g, unknown or other
  misc_feature (338)..(338): n is a, c, g, or t
  modified_base (384)..(384): a, c, t, g, unknown or other
  misc_feature (384)..(384): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtcgcttacatccaaactggttccagcagaaacctggacaagcaccagggcactcatttatagtacaaacaacaaacactcctcgaccctgcccgattcncagctccctcgttggggcaagctgccctgacactgtctggtgtgcncgctggaggacgaggctggactattacgtcgccttactcctacgtttggtggtgcgttgtgtcgttagttccgggcggtaacgggaccaaggtcctcgtaccgttacgtaacgtcgtaacgcccgtaacggtccgtaccgcccccgttccggtacctaccgttaccgttcccgtttcccccccttacccg

SEQ ID NO: 133972 - DNA, 852 bp, Homo sapiens
  misc_feature: GYAE6OF02FN3Z1.17.33.C11.1.454.CMB.1.raw
tcagcgtagactagcacgaccggtgctcgatttagagtgagctcgttgggtttgggggctggcggccagggtcccgttccaataatcaggcaccatcggcctggacctccgtctcctttctgttcctccctcacttgctgccaggtccaagttctcagacgtcgtcggtgacgtcgaggacgccctcacctcgacgtgtcgtccccaggacgggacgagtcgacgtcctacgacctgtcgcttccaacacgtggagcagttcgaccaagtagcttacgtatcctaaacgtcggttccaggacacgaaaaccgtcggaacgaaccgcgtaccccgtagggtactaacgttacaaatttaataaggtaacaaaaccgaacccaaaacgactccctaggaacccctgaccccgtatttccgtcgacggtccctacccgttcccgtttacggggggaccaaaacggtacctacggtaccccttaacggaacccttaccgttacgttaccgttcgggttaggttcggtaccgtacggacccgttagggaacgggaacggaacggggacgttacggtaaccgttaacgtttaaaccgttcggtacccgtttaaccttaccgtttaccgtttttacggggtaccgggttcgtaccgttacggttaggttccgtttacggtttcccgggacgggttaacggggtaaacccgtaaacgggtccggtaccgggtacccggttaaccgttaaacggttcccgaaccggtacccccgtaaagggtcccgttacccggtacccccccgttcgggttaaccctacccgtttcccccgttttaccccccgaaccccgtttccccccg

SEQ ID NO: 133973 - DNA, 610 bp, Homo sapiens
  misc_feature: GYAE6OF02HZMVW.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgacttactatccaaactggttaccagcagaacctggacaagcacccaggcactcatttatagtaacaaaacaacaaactaccacctcggacccctgcccgattctcacggcctccctcgttcgggggaccaaagcgtcgccctgactactgtcgttggtgtcgcgtagccgtgagggacgacggctacgactacttactgacccttacttcttacgtttggtgtgcttgtgcgttacgtcggacgggacggaccgacggtctacggtaccgttacgttacgtacgtacggcccgtaacggtccgtacccgtcccccgtaccggttcctaaccgttcccgttccggtttaccccacccccttcccttaaccccg

SEQ ID NO: 133974 - DNA, 642 bp, Homo sapiens
  misc_feature: GYAE6OF02HWVLI.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactgttccagacagaaacctggacaagaccacccaggctactcattatagtacaaacaacaaacactcctcgacccctcgccgattcacacggcctcctccgttggggacaaagctacgccctgacacttgtcgtggttgtcgcgtagcccgtaggacggtaacggacggtacgtcgtaacttacgttacgtacgtacccttaccttaccttacgttttgggttgggttgtcgttgttgtcgttacgtcgggacgggaacgggtaccgaacggtctacggtaccgttcgtttaacggtccaacggcccgtaaccgggcctcccggtcccccgttaccggtcccgaccgtttaccgttcccggtttacccccgttccccttccgttaccccg

SEQ ID NO: 133975 - DNA, 600 bp, Homo sapiens
  misc_feature: GYAE6OF02IEY27.17.33.C11.1.454.CMB.1.raw
  modified_base (420)..(420): a, c, t, g, unknown or other
  misc_feature (420)..(420): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactacctcgaccctcgcccgattctcacggcctccctccgttcgggggacaaagctgccctgacactgtctggtgtgcacgctgaggacgaggctgactattacncgtctactctactttggtggtgcgttgtcgtctacgttcggacgggacgggaaccgaacgtcgtacggtaccgttaccgttttaacggtcctaccggacccgtaaaccgggtccgttacccggtccccccgtttacggtacccgtaccctccggtttccccggttccccgttaccccccg

SEQ ID NO: 133976 - DNA, 776 bp, Homo sapiens
  misc_feature: GYAE6OF02JZITJ.17.33.C11.1.454.CMB.1.raw
tcagcgtagactagcacgaccggtgctcgatttagagtgagctcgttgggtttgggggtctggcgccagggtcccttccaatatcagcaccatggcctggactcctctctttctgttcctcctcacttgctgcccagggtccaattctcagactgtgtgactcaggagccctcactgactgtgtccccaggagggacagtcactctcacctgtgcttccacactggagcagtcacctaggtcgtctttaactactaccaaacgttcggttaccagcaacgaaaccctggaacaacgccacccgtagggacctacttcgtaactttaagtacggtaacaaaaccaactaaaccaccgtaccgtacggtaccccctaggtcccgtaacttccgtaccgacggtcccgttccccttacgggttacgggggaaccaaacggtcctaccgccccgtaggtacctaaccgttcggtacgttcgggtacggtacgacgtaccggtccgttaagggaacgggtacggacggttaccgttaacggtaaccttagtttaccgacgtaccctttaacgttacgtttacgttttagggtcggttacgtccgttcggttacgttacgtttacgggttcccggggaacggggaccgtaaaccgacggttccgtaccggtacccgtttacgttaaccggtaccgaccggtaacccggaacggttcccgttacccggtcccccgttacgggtaccttaccgtttcccgtacccgtttacccccttaaccccg

SEQ ID NO: 133977 - DNA, 536 bp, Homo sapiens
  misc_feature: GYAE6OF02ILJWM.17.33.C11.1.454.CMB.1.raw
  modified_base (395)..(395): a, c, t, g, unknown or other
  misc_feature (395)..(395): n is a, c, g, or t
  modified_base (451)..(451): a, c, t, g, unknown or other
  misc_feature (451)..(451): n is a, c, g, or t
  modified_base (486)..(486): a, c, t, g, unknown or other
  misc_feature (486)..(486): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgcttactatccaaactggttccagcagaaacctggacaagcacccagggcactcatttatagtaacaaacaacaaacactcctagaccccctgcccgattcctcaggcctcccgtccgttgggggaccaaagctacgccctgaccactgtactggtntcgctagcctaggaggacgaggctagactattactcgtcctactcttattggtgtntctgtgctgtcggcggtacggacagctcgaccgtntacgcacgccagctccgccctcgtccactcctcgtccctaccctcctacc

SEQ ID NO: 133978 - DNA, 528 bp, Homo sapiens
  misc_feature: GYAE6OF02HRWIM.17.33.C11.1.454.CMB.1.raw
  modified_base (131)..(131): a, c, t, g, unknown or other
  misc_feature (131)..(131): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctncccgggaggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaacaacaaacactcctgaccctgcccgatctcacgctccctccttggggcaaagctagccctgacactgtctggtgtgcagcctgaggacgagctgactatactgcctactctactttggtggtgctgtgctagttcggcggagggacaagtctacgaccgtcttaacgcacgcccgaaggcctcgcccccgtcggtccacgtcctcgttcccctaccccg

SEQ ID NO: 133979 - DNA, 721 bp, Homo sapiens
  misc_feature: GYAE6OF02JZJ5S.17.33.C11.1.454.CMB.1.raw
  modified_base (361)..(361): a, c, t, g, unknown or other
  misc_feature (361)..(361): n is a, c, g, or t
tcagcgtagactagcacgaccggtgctcgatttagagtgagctcgttgggtttggggggcggccgaggggtcccgttccaatatcagcaccatggcctggactcctctctttctgttcctcctcacttgctgcccagggtccaattctcagactgtggtgactcaggagccctcactgactgtcgtccccaggagggcagtcactctcacctgtgccttccaacacgtggacgcagtcaccagttcgcttactactaccaaacgttggttccagcaagaacctggacaagccaaccgagggtccactctattataacgtaacaaacaaacaacaccgtccgtacggacccctggacccgtnttaccgtaccgacggtccctcccgttccggttacggggggaactaaacggtcctcggtaccctggaacctacgttcggtccgttagggtgtacgtccgacggcctaggacgggtacgacgggtactcgaacttacgttaccgtacgtccggttaaccttaccgttacggttttacggtcgggttcttcggttacgttcgttaccgttaaggttcccggggtacggggaaccgggtaaccgtaacggtccggtaacggttaaccgttcgttaaacggcgtaaccgggaccgtaacgggtctccccgtcccggttacggtccttaccgtcctttaccggtccccctacccgttacccttccg

SEQ ID NO: 133980 - DNA, 632 bp, Homo sapiens
  misc_feature: GYAE6OF02HE0BA.17.33.C11.1.454.CMB.1.raw
  modified_base (227)..(227): a, c, t, g, unknown or other
  misc_feature (227)..(227): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactataccaaactggttccagcaagaacctggacaacgcaccgaggcactcattatagtaacaaacaacaaacactacctcgaccctcgccgattctacacgcctccctaccgtggggacaagctacgccctgacacgtcgtcgtggtgtcgcgagccgtaggacggacgaggctgtactatactcgtccttactcttacgtttgggtcgtcgtcttgtcgtcgttacgtcgggacgggtaacgggaaccgtaaggtccgtcggtaccgttaccgtttaacgtacgtaccggtaacccgaacggtccgtccccggtcccccgttacgggttcccttaaccggttcccgttcccgggtttaccccccgtcccctttaccccgttaccccgg

SEQ ID NO: 133981 - DNA, 533 bp, Homo sapiens
  misc_feature: GYAE6OF02H7HGX.17.33.C11.1.454.CMB.1.raw
  modified_base (341)..(341): a, c, t, g, unknown or other
  misc_feature (341)..(341): n is a, c, g, or t
  modified_base (419)..(419): a, c, t, g, unknown or other
  misc_feature (419)..(419): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagcacccagggcactcatttatagtacaaacaacaaacactcctggacccctgcccgattcncaggcctccctcttggggacaaagctcgccctgacactcgtctggtgtgcagccgtgaggacgaggctgactattacngcctactcttattggtgtgcttgtgcgttagttcggcggtacggaccaagcctgaccgttcttaagcacgacccaaggcctccgccccgtcggtccactctccgtcccgtcccc

SEQ ID NO: 133982 - DNA, 563 bp, Homo sapiens
  misc_feature: GYAE6OF02HANFR.17.33.C11.1.454.CMB.1.raw
  modified_base (340)..(340): a, c, t, g, unknown or other
  misc_feature (340)..(340): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattcncacggctccctcgttcggggcaaagctcgccctgacactgtcgtggtgtgcagcctggaggacgaggctgactattactgtccttactcttacgtttggtggtgcgttgtgtcgttagttcgggacgggtacgggaccaagcgtacgaccgttacgttaacgtcacggacccgaacggtcctcgcccccgttcggtccaccgttcgttccgttccccgtcccc

SEQ ID NO: 133983 - DNA, 737 bp, Homo sapiens
  misc_feature: GYAE6OF02JF1AF.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcaagaaacctggacaagcacccaggcactctattatagtaacaaaccaacaaaccacctccgtacgaaccccctgaccccgtattcctacgacggtcctcccgtccggttcgggggacaaacggtcctcgccccgttaggaacctaccgttcggtaccgttgggttcgtcggaccgtaacggtccgtagggaacgggaaccggtaacggccgttagtaaccgttaacgtttaccgtcgtacccttacttccgttaacgtttcggggttcggttccggtccgttcgttacggtacgtttacgttcggggtaccggacgggtaaccgaacggtccgtaccggtaccgttaccgttacggtaccgtaaccggtcccggaacggtcccggtacccgtaccccccggttacggttacccgtacccgtttacccggttccccggtttacccccccgttcccgttccccccgtttaacccg

SEQ ID NO: 133984 - DNA, 585 bp, Homo sapiens
  misc_feature: GYAE6OF02J00P4.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcacccagggcactcattatagtacaaacaacaacactcctacggacccctcgcccgattcctacacggtcctccctccgttgggggacaaacgctcgccctcgacactgtctggtgtcgcacgctgaggacgagctgacttatactcgacttactcttacgttggtgtgcgttgtgtcgttagttcgggcgggtaacggaccgacggtcgacggtaccgttacgttacgtcgaccggtacccgacggtcctccggtacccccgtcggtacctaccgtccgttccgtccccgtcccttcccgttacccg

SEQ ID NO: 133985 - DNA, 625 bp, Homo sapiens
  misc_feature: GYAE6OF02GLFXS.17.33.C11.1.454.CMB.1.raw
  modified_base (383)..(383): a, c, t, g, unknown or other
  misc_feature (383)..(383): n is a, c, g, or t
tcagcgtagactagcacgaccggtgctcgatttagagtgagctcggttaggggtttggggctggcggccaggggtcccttccaatatcagcgaccatggccctggactcctctcctttctgttcctcctcacttgctgcccagggttccaattctcagactgtggtgactcaggagccctcactcgactgtgtccccaggagggacagtcactctcacctgtgcttccaacactggagacgaagtccaaccagtgacttaactactacctaaaactgggttaccaaggtcaacggaaaaccgtgggaacaaagaccaaccccgagggaccacctcgatttatagtaacaaacaacaaacactacctcggaccctcgccgatcncacggcctcctcgtcggggcaagctgcctgacacgtgtctaggtcgtcgctacgccgtggacgggacgaggacgtacgacgtacgttactcggaccttacgtcttacgtttcggtaggtcgtcgtcgtgtcgtacggttcgggacggtaacggtacgaaggtcgtcggtaccgtcgtacggtacgacgacccgaaggtcctaccggccccgtggtccctacgtccgtccgtcccctaccccg

SEQ ID NO: 133986 - DNA, 542 bp, Homo sapiens
  misc_feature: GYAE6OF02H4MW3.17.33.C11.1.454.CMB.1.raw
  modified_base (296)..(296): a, c, t, g, unknown or other
  misc_feature (296)..(296): n is a, c, g, or t
  modified_base (436)..(436): a, c, t, g, unknown or other
  misc_feature (436)..(436): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatcaaactggttccagcagaaacctggacaagcacccaggcactcatttanagtacaaacaacaaacactctcggaccctgcccgattctcagctccctccgttggggcaaagctcgccctgacactgtctggtgtgcagcctgacggacgaggctagacttattactcgccttactcttagtttggtgtncgtgtgcttagttcgggcggagggaccaaggctacgtaccgtacttagcgacgcccgaacggctaccgtccccgtcgtcactcgttccgtcccgccctcctacccg

SEQ ID NO: 133987 - DNA, 515 bp, Homo sapiens
  misc_feature: GYAE6OF02IJ1K8.17.33.C11.1.454.CMB.1.raw
  modified_base (465)..(465): a, c, t, g, unknown or other
  misc_feature (465)..(465): n is a, c, g, or t
  modified_base (491)..(491): a, c, t, g, unknown or other
  misc_feature (491)..(491): n is a, c, g, or t
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaaacaacaaacactcctgaccctgcccgattctcaggcctcctccgtggggacaaagctgcctgacactgtctggtgtgcagcctgaggacgaggctgactatactgcctactctacgtttggtgtgcgtgtgctagttcggcggaggaccaagctgaccgtntagcagccgaagctcgcccctggtcncttcgtcgtcccaccctcctaccg

SEQ ID NO: 133988 - DNA, 706 bp, Homo sapiens
  misc_feature: GYAE6OF02I398V.17.33.C11.1.454.CMB.1.raw
  modified_base (174)..(174): a, c, t, g, unknown or other
  misc_feature (174)..(174): n is a, c, g, or t
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
tcagcgtagactagcacgaccggtgctcgatttagagtgagctcgttgggtttggggcgtggcgccaggggtcccttccaatatcagcaccatggcctggactcctctctttctgttcctcctcacttgctgcccagggtccaattctcagactgtggtgactcaggagccctnactgactgtgtccccaggagggcagtcactctcacctgtgcttccaacactggagcagtcaccagtgcttactatccaaactggttccagcacgaaactggacaagccaccaggcactcatttanagtacaaacaacaaacactccacgaccctgcccattcncacgctccctcgtaggggacaagctcgccctgacctacgtcgtactgggtcgtcgacgacgtccgtaggaggaccggaggccgtagaaccgtttaagttacctacggtcccttaaccgttccgtttaaccgttttgggtacgggttccgtacgttcgttacggtacctttaacggtttccggggtaaccggggtaacgggtaacccgtaaagggtacccgttccggggttaaccccgtttacggttaaccggtcccggtaaaccggtaccccgtaaccggggttacccttcccccgggttaccccccgttccgggttacccgtaaccccgttttcccggtaccccggttttcccccccggtaccccccg

SEQ ID NO: 133989 - DNA, 631 bp, Homo sapiens
  misc_feature: GYAE6OF02HL8Q1.17.33.C11.1.454.CMB.1.raw
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
  modified_base (450)..(450): a, c, t, g, unknown or other
  misc_feature (450)..(450): n is a, c, g, or t
  modified_base (466)..(466): a, c, t, g, unknown or other
  misc_feature (466)..(466): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtcgcttactatccaaactggttccagcagaaacctggacaagcacccaggcactcattatagtacaaacaacaaacactacctcgaccctgcccgattctcaggcctcctccgttggggacaaagctgcctgacactgtactggtgtcgcacgcctgaggacgnggctgactacttacncgtccttactcttacgtttggtgtacgtcgttgtntcgttacgttccgggngggtaacggggacctaaacggtccgtacgggtacccgttacgtttaacgccgtaaccggtacccggaacggttccctacccgggtcccccccgttaccgggttaccctaccgttacccgtttcccggtttaccccccgtaacccccgtttcccgttaacccccgg

SEQ ID NO: 133990 - DNA, 596 bp, Homo sapiens
  misc_feature: GYAE6OF02F2C2W.17.33.C11.1.454.CMB.1.raw
  modified_base (423)..(423): a, c, t, g, unknown or other
  misc_feature (423)..(423): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactaccaaactcggttccagcaagaaacctggaacaagcacccaggcactcatttatacgtaacaaacaacaaacacctcctacgacccctgcccgattcctcacgcctccctcgtcggggacaagctcgcctgacactgtctggtgtgcagctgaggacggagctgactattacncgtacctctcttacgtttggtggtgtcgtgtcgtcgttacgttcgggacggtacgggaccaaacgtcgtacgtaccgttacgttaacgtccgaacgtacccgaacggtccgtcccggtacccccgttcggttacccgtaccgtccgtttacccggttccccccgttacccccg

SEQ ID NO: 133991 - DNA, 601 bp, Homo sapiens
  misc_feature: GYAE6OF02GTT84.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggccactcattatagtacaaacaacaaacactcctcggacccctgcccgatctcacggcctccctccgttcggggacaaacggcgtcgccctgacctacgtcgtctgggttcgtcgacgagtccgtggtacggacgagggctggaacttattactcgtcccttacgtccttacgtttcgggttgttcgtcgttgttcgtcgttacgttcgggtcgggaacggaccaacgtccgtcgtaccgttacgttaagtcgaacgcccaaggtccgtacgtcccccgtcggtacctaccgtccgttccgttaccccgtccccg

SEQ ID NO: 133992 - DNA, 589 bp, Homo sapiens
  misc_feature: GYAE6OF02FWFTK.17.33.C11.1.454.CMB.1.raw
  modified_base (229)..(229): a, c, t, g, unknown or other
  misc_feature (229)..(229): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagcacccaggcactcatttatagtaacaaacaacaaacactcctggacccctgccccgattctcaggcctccctccgttgggggcaaagctcgccctgacactcgtctggtgtcgcacgcctggaggacgagggctgactattactcgacctactcttacgtttggtggttagccttggtcgtcgttacgttcgggacgggtaacgggaccgaaggtccgtagtacccgttcttaacggtcgaacggtacccgaaaggtccgtccggtcccccgttcggtacccaccttccttccgttacccctacccccg

SEQ ID NO: 133993 - DNA, 546 bp, Homo sapiens
  misc_feature: GYAE6OF02HC0A3.17.33.C11.1.454.CMB.1.raw
  modified_base (459)..(459): a, c, t, g, unknown or other
  misc_feature (459)..(459): n is a, c, g, or t
  modified_base (530)..(530): a, c, t, g, unknown or other
  misc_feature (530)..(530): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcattatagtacaaacaacaaacactcctcggacccctgcccgattctcaggcctccctccgttggggacaaagctcgccctgacactgtctggtgtgcacgctggaggacgaggctacgacttattactcgccttactccttacgtttggtggttcgcgttgtgtnttagttcgggcggacgggaccaagcgtcgaccgttcttaacgtcgacgccgaagctccgccccgtcgtccnctctcgtccctacccc

SEQ ID NO: 133994 - DNA, 604 bp, Homo sapiens
  misc_feature: GYAE6OF02FV8NW.17.33.C11.1.454.CMB.1.raw
  modified_base (448)..(448): a, c, t, g, unknown or other
  misc_feature (448)..(448): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccgagtgcttactatccaaactggttccagcagaaacctgacaagcaccagggcactcatttatagtacaaacaacaacactcctgaccctgaccattctcagctacccgtccttggggcaagctcgcctgaccactcgtctggtgtgcagcctaggacggacgaggtactcgactagttacctgcccttactccgttactttgggtcggttntccgttagttcggtacttacgttcgggaccgggtacgggtaacccgtaaggtccgtacggtacccggttacttaacggtccgacggaccccgtaagggcccgttaccggcccccgttcggtaccctaccgttccttacccggttccccgtaccccg

SEQ ID NO: 133995 - DNA, 618 bp, Homo sapiens
  misc_feature: GYAE6OF02F8LRA.17.33.C11.1.454.CMB.1.raw
  modified_base (299)..(299): a, c, t, g, unknown or other
  misc_feature (299)..(299): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaacctggacaagcacccagggcactcatttanagtacaaacaacaaacactcctcgacccctgcccgattctcacggcctccctcttcgggggcaaagctcgccctgacactgtctggtgtgcagcctgaggacgaggctgactattactgtcctactcttacgtttggtgttcgcttggttgcgttacgttcggggacgggtaacgggaccgaagtccgtacggtaacccgttaccgtttaacgtccgtaaccggtaccccggtaaagggtccctacccgggtccccccgttacgggtacccgtaacccttccggttacgtttcccggttcccgtccccctttacccccg

SEQ ID NO: 133996 - DNA, 521 bp, Homo sapiens
  misc_feature: GYAE6OF02FR442.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctgacccctgcccgattctcaggctccctcttggggcaaagctgccctgacactgtctggtgtgcagcctgaggacgacggctagactattactgccttactctacgtttggtggtgtctgtgtactagttcggcgggacggaccaagctgaccgtctaagtcagcccaagctcgccctcggtccactcgtcgtccctcccc

SEQ ID NO: 133997 - DNA, 518 bp, Homo sapiens
  misc_feature: GYAE6OF02IF6ND.17.33.C11.1.454.CMB.1.raw
  modified_base (434)..(434): a, c, t, g, unknown or other
  misc_feature (434)..(434): n is a, c, g, or t
  modified_base (471)..(471): a, c, t, g, unknown or other
  misc_feature (471)..(471): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccaggcactcatttatagtacaaacaacaaacactcctggaccctgcccgattctcaggctcctcttggggcaaagctgccctgacactgtctggtgtgcacgcctgaggacgaggctagactattactgcctactctactttggtggtnctgtgctagttcggcggagggaccaagcgtgaccgtnttaagtcagcccaaggctcgcccctggtccactctcgtcccgtcccc

SEQ ID NO: 133998 - DNA, 778 bp, Homo sapiens
  misc_feature: GYAE6OF02JN4VW.17.33.C11.1.454.CMB.1.raw
  modified_base (185)..(185): a, c, t, g, unknown or other
  misc_feature (185)..(185): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (339)..(339): a, c, t, g, unknown or other
  misc_feature (339)..(339): n is a, c, g, or t
  modified_base (398)..(398): a, c, t, g, unknown or other
  misc_feature (398)..(398): n is a, c, g, or t
tcagcgtagactagcacgaccggtgctcgatttagagtgagctcgttgggtttggggggtcggccgaggggtcccgttccaactatcagcaccatggcctggactcctctctttctgttcctcctcacttgctgcccaggtccaattctcagactgtggtgactcaggagccctcactgactgtntccccagggagggcagtcactctcacctgtgccttccaaacnctgggacncagtccaccaggtcgcttaacacttacccaaaagtcgtttaccagtccaagaaacccgttaggaccaaagcgaaccccaacgggggcaacctacgaacttttanaacgttaacaaaaccaaacaaaccaatacctcggaacccctcgacccgtacttcctacncggccttcccctacctggggggaccaaacggtcctaggtcccctagtaacccgacttccggttccgtaggggtttcgtacggtcctaacggtccccgtacgtacggggaaaccggtaacggggcctaacggaaccgttaacgttacgttaccggccttaaccgtttccgtttaacgttttcgggggttacggtttcggtacggtttacggttggaccttttaacggtttccggggacggtaccggggggtaacctaacggggtcctacggtacccggttagtttacccggtcgaaccgtcccgggaaacgttccggaccgtccccggtacccggtaccggtccttaccgttccgtacccccgttaccctccgttaccccg

SEQ ID NO: 133999 - DNA, 615 bp, Homo sapiens
  misc_feature: GYAE6OF02JUMHB.17.33.C11.1.454.CMB.1.raw
  modified_base (318)..(318): a, c, t, g, unknown or other
  misc_feature (318)..(318): n is a, c, g, or t
  modified_base (347)..(347): a, c, t, g, unknown or other
  misc_feature (347)..(347): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggaacaagcacccgaggcactcaattacagtaacaaacaacaaacnccgtccacggacccctgacccgtattccncgacgcctcccgtccgttaggggacaagcctacgccctgactactcgtcgtggtntacgcagcctggacgggtacgnggctacgtacttattacgacgtccttacgttccgttacgtttgggtcgtcgtacgttgtcgtacgttcgttcgggacgggtacggactaacggcgtacgtacgtacgttacgtacgaccgaccgaggtcctaccgtccccgtggtaccctaccgttccgttacccgttccccggtacccttcccgtaaccg

SEQ ID NO: 134000 - DNA, 532 bp, Homo sapiens
  misc_feature: GYAE6OF02GU0NG.17.33.C11.1.454.CMB.1.raw
  modified_base (430)..(430): a, c, t, g, unknown or other
  misc_feature (430)..(430): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgacccctgcccgattctcaggctccctcgttggggcaaagctgccctgacactgtctggtgtgcagctgaggacgaggctgactattactgcctactctactttggtgtgntgtgctagttcggcggagggaccaaggctgaccgtcttagtcacgcccaaggcctcgcccccgtcggtcaccgttctccgttcccgtcccctcccttacccg

SEQ ID NO: 134001 - DNA, 620 bp, Homo sapiens
  misc_feature: GYAE6OF02H07ND.17.33.C11.1.454.CMB.1.raw
  modified_base (300)..(300): a, c, t, g, unknown or other
  misc_feature (300)..(300): n is a, c, g, or t
  modified_base (378)..(378): a, c, t, g, unknown or other
  misc_feature (378)..(378): n is a, c, g, or t
  modified_base (494)..(494): a, c, t, g, unknown or other
  misc_feature (494)..(494): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactcggttccagcagaaacctggacaagcaccgaggcactcatttanagtaacaaacaacaaacactacctcggaacccctgacccgattcctcacgcctcctccgtaggggacaaagcacgccngacactgtctggtgtcgcacgcctggacggacgtaggctagtactacgttacgcgaccttacttcctttaacgtttgggtgttacgtccgttggttcgtacgtttacgttccgggngggaacggggtacaaacgtcgtcggtaaccgtttcttaacggctaaccggacccgtaagggtcccgtaccggtccccccggttacggtccctacccgttccgttacccgttcccccttaacccccg

SEQ ID NO: 134002 - DNA, 663 bp, Homo sapiens
  misc_feature: GYAE6OF02GXCWJ.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacactggagcacgtacaccagtgcttactataccaactggttccagcaagaaacctggaacaagcacccagggcactctattatagtacaaacaacaaacactaccacgaccctcgacccgactctcgacgtcctcccgttccgttcggggactaaacgcgtaccgacctcgacctacgttcgtacgttgggtacgttcgacgtacgtcccgtaggacgggacggacggtcgtacgtaacgttaactttaaccgttcgtacccttaccttaccgtttaacgtttgggttcggtgtcgttagttcgtacgttagttccggggcggtaacgggactaacggtacgtccggtaccgttacgttaacggtaccgaccggtaccgtaacggtcccgtcgtcccccgtcggtcccgtaccgttccgttacccgtacccctacccccg

SEQ ID NO: 134003 - DNA, 628 bp, Homo sapiens
  misc_feature: GYAE6OF02HD1NK.17.33.C11.1.454.CMB.1.raw
  modified_base (337)..(337): a, c, t, g, unknown or other
  misc_feature (337)..(337): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagcaccagggcactcatttatagtacaaacaacaaacactcctgaccctgccgattcncacggcctcctcgttcggggcaaagctcgcctgaccactgtctggtgtgcagtccgtgacggacgaggctcggtaactagttactcgtacccttactccttacttttgggtcggttgtcgttgtcgtcttacggttcggacgggtaacgggacctaacgtccgttcggtacccggtttacgtttaacggtcgtaaccggacccgtaaacgggtcccgttacccggtaccccccggttaccggttacccgtacccgtttcccgttacccgtttccccccgttaacccccccg

SEQ ID NO: 134004 - DNA, 637 bp, Homo sapiens
  misc_feature: GYAE6OF02GQRMT.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgacttactatccaaactcggttccagcagaaacctgaacaagccaccaggcactcattatagtaacaaacaacaaacactacctcgacccctgcccgattctcacggctccctccgttaggggacaaacgctcgccctgacactgtctggtgtgcgacgtcctggacggtacgacggtctagaacttattactcgtacctaccttcttacgtttggttgggtcgttcgtacggttcgtacgttacggtttcgggaccggggtaaccgggaccgtaacggtcgttacggtacccggttacgtttaacggtccaaccgtaccccgaacggtaccgtcccgtacccccggttcgggttaccctacccggttccgtttcccgtacccccgttaacccccg

SEQ ID NO: 134005 - DNA, 520 bp, Homo sapiens
  misc_feature: GYAE6OF02FM1GT.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctgaccctgcccgatctcagctccctcttggggcaagctgcctgacactgtctggtgtgcagctgaggacgaggctgactattactgcctactctactttggtggtgctgtgtctagttcggcggaggaccaagctagaccgtattacgtcacgcccgaaggcctcgcccccgtcggtccacgttcctcgtccccgtccccg

SEQ ID NO: 134006 - DNA, 609 bp, Homo sapiens
  misc_feature: GYAE6OF02I8S50.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtccaccagtgccttactatccaaacttggttccagcaacgaaacctggaacaagccacccgagggcactctaatttatacgtaacaaacaacaaacactcctacggaccctcgcccgtattcctcacggcctcccgtcggttggggacaacgcctcgccctgactacgtcgtcgtggtcgtcgcgacgccgtggacggacggcggtctagtacttattactcgtccttacttacgttacgtttggtcggtgtcgttgtcgtacgttcggtcgggacgggacgggaaccacgtcgtacgtacgttacttacgtcgacgccgaacgtccgtccgtcccgttcgacctaccgttccgttaccggtcccgtcccttccgtaccg

SEQ ID NO: 134007 - DNA, 597 bp, Homo sapiens
  misc_feature: GYAE6OF02IDL20.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtaacaaaacaacaaacactcctacggacccctgcccgtattctcacggctccctccgttgggggaccaaacgctgccctgacactgtctggtgtgcagctgaggtacgaggctgacttatactgcctactcttacgtttggtggtgcttgtcgtcgttacgttcgggacgggacgggtaccgaacggtctacggtaccgttacgttaacggtccacggacccgaaggtccgtacccgtccccccgtcggtccctaccgttccgttcccgtttcccccggtccccttccccttaccccg

SEQ ID NO: 134008 - DNA, 565 bp, Homo sapiens
  misc_feature: GYAE6OF02G72GI.17.33.C11.1.454.CMB.1.raw
  modified_base (324)..(324): a, c, t, g, unknown or other
  misc_feature (324)..(324): n is a, c, g, or t
  modified_base (343)..(343): a, c, t, g, unknown or other
  misc_feature (343)..(343): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagcacccagggcactcatttatagtacaaacaacaaacactaccncgacccctcgcccgattcncacggcctcctccgttggggcaaagctcgcctgacactgtctggtagtgcacgccgtgaggacgagctgacttatctgcctactctagtttggtgtgctgtgcgttgttcggcgagggaccaaggcctaggacccgttacgttaacgtccgtaacgacccgaacggcctacccggcccccgtcgggttccaaccgttccgttcccgttaccccgttaccccc

SEQ ID NO: 134009 - DNA, 654 bp, Homo sapiens
  misc_feature: GYAE6OF02F08I0.17.33.C11.1.454.CMB.1.raw
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactatccaaactggttccagcaagaaacctggacaagcacccagggcactcatttatagtacaaacaacaaacactcctaggacccctgcccgattctcacgctccctccgttgggggaccaaagctgccctgacacgtcgtctcggtgtgcagccgtggacgggacggagggtcctaggtaccttagttaccgttcgacccttaccttaccgttacgttttgggtgggttcgtcgttggtcgtcgttacggttccggggtcggggtaacgggtaaccggtaacgtcgttaccggtaccgttacgttaaacggtccgtaacggaccccgtaacgggtcccgttacccggtcccccccgttcgggtacccctccgttacccgttcccgtttacccccttacccccccgg

SEQ ID NO: 134010 - DNA, 565 bp, Homo sapiens
  misc_feature: GYAE6OF02G805R.17.33.C11.1.454.CMB.1.raw
  modified_base (298)..(298): a, c, t, g, unknown or other
  misc_feature (298)..(298): n is a, c, g, or t
  modified_base (336)..(336): a, c, t, g, unknown or other
  misc_feature (336)..(336): n is a, c, g, or t
tcagcgtagactagcacgaccggtgctcgatttagagtgagctcgttgggttttgggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccgaggcactcattanagtaacaaacaacaaacactcacgaccctgcccattcncacgctcctcgtgggacaagctcgcctgacactgtcgtggtgtcgcacgcgtgacggacgaggtctagactattacgtcgtacctacttcttacgtttggtggtcgtcgtgtgtcttacgtcgggacgggacgggaccagtcgtacgtaccgttacgttaacgtcgacgtacccgaacggtcctccgtccccgtcggtacctaccgttcttacccgttcccctaccccg

SEQ ID NO: 134011 - DNA, 593 bp, Homo sapiens
  misc_feature: GYAE6OF02ILSV7.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcgaccctgcccgattctcagctcctccttggggacaaagctcgccctgacactgtctggtgtgcagcctgaggacgaggctgactattactgccttactcttacgtttggtggtcgtcgttggtgtcttacgtttccgggacgggtaacgggacccaaaggccgttaggtacccgttcgtttaaacggtccgtaacggaccccgtaaacgggccgttaccggccccccgttcgggtaccctaccgttccgttccgttccccctaacccccg

SEQ ID NO: 134012 - DNA, 577 bp, Homo sapiens
  misc_feature: GYAE6OF02GX9WK.17.33.C11.1.454.CMB.1.raw
  modified_base (397)..(397): a, c, t, g, unknown or other
  misc_feature (397)..(397): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactcctacggacccctgccccgattctcacggcctccctccgttgggggacaaagctcgccctgacactgtctggtgtgcngcctgaggacgaggctgactattactgcctactctacgtttggtggtgtctgtgtcttagttcgggcggacgggaccaagctaggaccgttcgttaaggtccgaacggtacccgaagggtccctaccggtccccccgttacgggttcccaccgtttccgttccgtttccccctacccccg

SEQ ID NO: 134013 - DNA, 794 bp, Homo sapiens
  misc_feature: GYAE6OF02INQ6V.17.33.C11.1.454.CMB.1.raw
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttaccaactaccgtggagcacgtccaccagtcgacttactaatacccaaaacgtggttacccaagccgaaacgtaaaacccgttgggaaaccaaacgcccgaaccccgaaggggtaccaccgttacctaattttaactaacggttaaaccaaaaccaaaacctaaaaaccgaacctttaccccgtacgggttaacccccctaccggtaccccgttaatttcccgacctaacgggtcccttaccccgttccgggttaggggggaacctaaacggccttcggacccctaggtaacctacgttcgttccgtggtacggtcgaccacgtccgtagaacgggtacggaggtactagtaccgtaacttaccgtcgtaccttacttaccgtttagtttgggtacggttcgtcttcggttagtcctttacgggttagggaccggggtaacggtaaccgtaacggtcgtaacggtaccgtttagttaacgtcgaacccgtacccgtaaacggtccgtaacccgtccccggtaccgtaccgtaaccttcccgttaccggtttaccccctaccccgttcccttaaccgg

SEQ ID NO: 134014 - DNA, 524 bp, Homo sapiens
  misc_feature: GYAE6OF02HFKRR.17.33.C11.1.454.CMB.1.raw
tcagcgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaacactcctgaccctgcccgattctcacgctccctcctggggacaaagctgccctgacactgtctggtgtgcacgcgtgaggacgaggctgactatactgccttactctactttggtgtgctgtgtctgtcggcgggaggaccaagcgtgaccgtacttagtcacgccgtaacggcctcgcccctggtccacgtcctcgttccccgtccctccgtccc

SEQ ID NO: 134015 - DNA, 722 bp, Homo sapiens
  misc_feature: GYAE6OF02IMHGL.17.33.C11.1.454.CMB.1.raw
  modified_base (229)..(229): a, c, t, g, unknown or other
  misc_feature (229)..(229): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgcttccaacactggancagtcaccagtgcttactactaccaaacttggttccacgacaacgaaaaccgtaggaacaacgaccaccccgacggggacactctatttaactagtaaaccaaaacaaacaaacctactacctaccggtaccctcgacccgtattctcacggtcctcccgtccgttcggggactaaacgtctcgcccgttacgactacgttacgttcgttgggttacggtgacgtacggtccgtaggtaacgggacggtaacgggtccgtacggtaaccgttaacgttaaccgttcgtacccgttactttaccgtttaacgttttcgggttcgggttcgttccgttagggttcgtaccgtttacggtttccggggtaccgggtaacggggaaccgtaacggtcgttacggtacccgttacgtttaacggtctaccgacccgaacggtccgtcccggtcccccgttcggtccttaccgtccgttcccgtaccccgttacccccg

SEQ ID NO: 134016 - DNA, 603 bp, Homo sapiens
  misc_feature: GYAE6OF02FOKL5.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaaacactcctcgacccctgcccgattctcaggctccctcgtggggcaaagctcgcctgacactgtctggtgtgcagcctgaggacgaggctagtactattactgtcctactcttacgtttggtggtcgtcgttgtcgtcgttacgttcgggaccgggtaagggaccaacggtcgttacgaccggttacgttaagtaccgacggtaccccgaagggtcccgttaccgcccccgttacggttccctaaccgttccgttaccggtttcccccgtccccttccccgtttaccccgg

SEQ ID NO: 134017 - DNA, 541 bp, Homo sapiens
  misc_feature: GYAE6OF02F7XFA.17.33.C11.1.454.CMB.1.raw
  modified_base (229)..(229): a, c, t, g, unknown or other
  misc_feature (229)..(229): n is a, c, g, or t
  modified_base (523)..(523): a, c, t, g, unknown or other
  misc_feature (523)..(523): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagcacccaggcactcattatagtacaaacaacaaacactcctacggacccctcgacccgattcctcgacggcctcccctccgttggggggaccaaagctcgccctgacactgtctggtgtgcagcctgaggacgaggctgactattacgtgcctactcttacgtttggtgtgtctgtcgtctagttcggcggaggaccaagcgtcgacgtacgtacgtcgagacccaaggctcgccctcggtccnctacgtccgtccctaccc

SEQ ID NO: 134018 - DNA, 526 bp, Homo sapiens
  misc_feature: GYAE6OF02F31LL.17.33.C11.1.454.CMB.1.raw
  modified_base (413)..(413): a, c, t, g, unknown or other
  misc_feature (413)..(413): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaaactggttccagcagaaacctggacaagcacccagggcactcatttatagtacaaaacaacaaaacactcctggacccctgcccgattctcaggctccctcctgggggcaaagctgccctgacactgtctggtgtgcagcctgaggacgaggctgactattacngcctactcttactttggtgtgctgtgctattcggcggagggaccaagctgaccgtcttagctagcccaaggcctcgcccctggtccacgttcctcgttccccaccctcctccg

SEQ ID NO: 134019 - DNA, 667 bp, Homo sapiens
  misc_feature: GYAE6OF02HCQ2M.17.33.C11.1.454.CMB.1.raw
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
  modified_base (313)..(313): a, c, t, g, unknown or other
  misc_feature (313)..(313): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgngcttaccaacactggancagtcaccagtgcttactactaccaaacttcggttccagacaagaaacctggaacaagccaacccgaggccactcaatttanagtaacaaacaacaaacactcctacggaccctcgacccgtattcctcgacggcctcccgtcggttcggggacaaagtctacgccttagacctacgtggtacttgggtcgtcgcgacgtccgtggaacgggtacgacggtacgtacgtaacttacgttacgtccggtacccttaacttccgtttaacgtttcgggttggtcgtcgttggtcgtacgttacggttccgggacggacgggtaaccgacgtcgtacggtaccgttacgttaacggtcgaaccggtaccgtaaacggtcccgtaccggtcccccggttacggtaccctaaccgtttccgtaccgttccccgtaaccccg

SEQ ID NO: 134020 - DNA, 696 bp, Homo sapiens
  misc_feature: GYAE6OF02ILRPQ.17.33.C11.1.454.CMB.1.raw
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcaagaaacctggacaagcaccaggcactcattatagtaacaaacaacaaacactcctacgacccctgcccgtattctcacgcctccctccgtggggcaaacgctcgcctgacactgtctggtgtgcagcgtggaggacggaggctgacttattactcgtccttacttacttacgtttggtggttgtcgttagtcgtacgttacgttccggggacggggtaacgggacccgtaaacgggtccgttacgggttacccgtttaccgtttaacgggttaccgtacccgggtaaccccggtaaaccggggttcccgttacccgggttacccccccccggtttaccggggtttacccccgtaacccggttttccccgtttacccccgggttttaccccccccgttaacccccccgttccccccgttttaacccccccgg

SEQ ID NO: 134021 - DNA, 632 bp, Homo sapiens
  misc_feature: GYAE6OF02F31TK.17.33.C11.1.454.CMB.1.raw
  modified_base (399)..(399): a, c, t, g, unknown or other
  misc_feature (399)..(399): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactactccaaactggttccagcagaaacctggacaagcaccgaggcactcattatacgtaacaaacaacaaacactacctgacccctgcccgtattctcaggcctccgtcgttcggggacaaagctcgcctgacactcgtctggtgtcgcgacgcngacggacgaggctagactattacgcgccttactaccttacgtttggtaggtcgtacgttggtcgtacgttacggtttccgggacgggtaaccgggtacccgtaaacggtccgttaccgttacccggttacgtttaacggttcccgaaccggtacccgtaacgggtaccgttacccggacccccgttacgggttcccaaccgtttccgttacccgttcccccgttaacccccgg

SEQ ID NO: 134022 - DNA, 785 bp, Homo sapiens
  misc_feature: GYAE6OF02JQMZG.17.33.C11.1.454.CMB.1.raw
  modified_base (172)..(172): a, c, t, g, unknown or other
  misc_feature (172)..(172): n is a, c, g, or t
  modified_base (233)..(233): a, c, t, g, unknown or other
  misc_feature (233)..(233): n is a, c, g, or t
tcagcgtagactagcacgaccggtgctcgatttagagtgagctcgttgggtttgggggtcggccgaggggtcccgttccgaatatcagcaccatggcctggactcctctcttctgttcctcctcacttgctgccaggtcaacttctcagactgtggtgactcaggagccctnactgactgtcgtcccaggagggacagtcactcgtcaccttgcgcttaccaacactcgggancgagtcaccagtcgtcttaacgtatccaaaacgtggttaccacgcacgaacctacggaacaacggacacccgagggccgtactccgtaatttactaacgtaaccaaaactaaaccaaacgaacctaccgttacgggaccccttacacccgaacctttccgtacaaccgggtccctacccgttacccggttcgggggtaaccgtaaaacggtcctaaccggtccccgttaggaacctaaccgttcggtacctcgggttcgttacggacccgtacgtacccgtgggtaaaccgggcggtaaccgggttacgtcggtaacgtaacccgtttaaccgtcgggtaacccttccgtttaccttaacggttttccgggtaggttcggtaccgttgggttccggtaactttcgggttccggtccgggtaacgggtacccgtaaggccgttaccgtaacgtttacgtacggtctaacgggtacccctaaggcccgttacggccccccttaggttacccgcctttccgtacccggtttcccggaccccttccgttaccccgg

SEQ ID NO: 134023 - DNA, 548 bp, Homo sapiens
  misc_feature: GYAE6OF02GCW9K.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactcctcggacccctgacccgattctcacggctccctccgttggggcaaagctcgcctgacactgtctggtcgtgcacgctggacggacgaggctgactattactgccttactcttactttggtggtgcgtgtgtcttagtcgggcgggaggaccaagctcgtaccgttctaagtcgacgcccgaagccgtccgcccccgttcggtccaccttcgtaccgttccctaccccg

SEQ ID NO: 134024 - DNA, 567 bp, Homo sapiens
  misc_feature: GYAE6OF02IMEJG.17.33.C11.1.454.CMB.1.raw
  modified_base (332)..(332): a, c, t, g, unknown or other
  misc_feature (332)..(332): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcatttatagtacaacaacaaacactcctgaccctgccgattcncagctcctcctggggcaagctcgcctgacactgtctggtgtgcagcctgagacgagctgactatactgcctactctacgtttggtgtgcttgtgtcttagttcggcgggtagggaccaagcgtacgacccgttacttaacgtccgacggtaccccgaagggcccttccggtcccccccgttacggttcccgtaccttcccgttaccggtttccccccgtccccttcccttacccg

SEQ ID NO: 134025 - DNA, 671 bp, Homo sapiens
  misc_feature: GYAE6OF02IQUT6.17.33.C11.1.454.CMB.1.raw
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacnctggancagtcaccagtgcttactatccaaactggttccagcagaacctggacaagcaccaggcactcattatagtacaaacaacaaacactcctcggacccctgacccgtattcctacgaacggcctcccgtccgttggggacaaacgcctcgccctgaccacgtcgtcgtggtcgtgccgtaacggtccgtagggaacgggaccggacgggtacgttacgtaacgttacgttacctgtacccttaacgttccgttaaccgtttgggttggttacgtccgttgtgtacgttacggttcgggccgggtaacgggacccgtaaggtaccgtacggtacccgttacgttacggtacctacggtaccccgaacggtcccgtacccggtaccccccgttcggtacccgacgttcccgttcccggttacccccgtccccttccccgttaccccgg

SEQ ID NO: 134026 - DNA, 549 bp, Homo sapiens
  misc_feature: GYAE6OF02FW8DC.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaacaaacactcctggacccctgcccgattctcaggctccctccgttggggcaaagctgccctgacactgtctggtgtgcagcctgaggacgaggctagactattactcgccttactcgttacgtttggtggtgctagtgtctagttcgggcgggagggacccaagcctgaccgttacgttaagtccgacgcccgaaggcctccggcccccgtcggtccaccttcttccgttccccgtcccc

SEQ ID NO: 134027 - DNA, 564 bp, Homo sapiens
  misc_feature: GYAE6OF02HOBIX.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactactccaaactggttccagcaagaaacctggacaagcaccagggcactcatttatagtaacaaacaaacaaacactcctcgacccctgcccgattctcacggcctcccgtccgttcgggggacaaacgctcgcctagacactgtcgtggtgtgcacgcctaggacggacgaggctgactattactcgtaccttacttcttacgtttggtggtgtcgttgtgtctagttcgggacgggacggacgaagtcgtcgaccgttacttaacgcacgccgaaggccgtccgcccctcggtcctctcgtccgtcccctaccccg

SEQ ID NO: 134028 - DNA, 633 bp, Homo sapiens
  misc_feature: GYAE6OF02F6ISF.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactataccaaactcggttccagcaagaaacctggacaagcacccaggcactcattatagtacaaacaacaaacactcctacgaccctgacccgattctcacgcctccctccgtggggacaaacgctcgccctgactacgtgtcgtggtcgtgcgacgcgtagaggacgaggcgtgtaactattactcgtaccttacttcgttacgttttgggtacggttcgtcgttggttcgtacgttacggttaccgggacgggaacgggaccgaacggtccgttacggtaccgtttacgtttaacggtccaacggtcccgtaacggtcccgttacccgcccccgtttaccggtaccgttacccgttccgtttaccccggttccccgttaccccccg

SEQ ID NO: 134029 - DNA, 617 bp, Homo sapiens
  misc_feature: GYAE6OF02GDSGO.17.33.C11.1.454.CMB.1.raw
tcagcgtagactagcacgaccggtgctcgatttagagtgagctcggttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcgactctcacctgtgcttccaacactggagcagtcaccagtgcttactatccaaactggttccagcagaaacctggacaagcaccgagggcactcatttatagtaacaaacaacaaacactcctcggacccctgcccgattcctcgaggcctcccttccgttcgggggactaacgctcgccctgactactgtcgtggtcgtgcacgcctgacggacgacggctgacttacttacgcgtccttactcttacgtttggtggtcgcgtgtcgtcttagtcgggacgggtacggggacctaagtccgtacggtacccgttagtttaacgccgtaacggcccggaagggtccctaccggtaccccccgttcgggtccctaccgttccgttacccggttcccccgtccccgtcccgttaccccg

SEQ ID NO: 134030 - DNA, 550 bp, Homo sapiens
  misc_feature: GYAE6OF02IMQUO.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactgttccagcaacgaacctgacaagcaccaggcactcatttatagtaacaaacaacaaacactcctcggaccctcgacccgattctcacgtcctccctcgttggggacaaagctcgcctagaccactcgtcgtcggtgtcgcgacgcgtggacggacgaggctgtactattactcgtctacttcttagttggtgtgtctgtgctagtcggcggacggacaacgtcgtcgtacgttacgttaacgcacgaccgacggctccgtccccgtcggtaccacctctccgtccctaccccg

SEQ ID NO: 134031 - DNA, 552 bp, Homo sapiens
  misc_feature: GYAE6OF02FUMAK.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcattatagtacaaacaacaaacactcctagacccctgcccgatctcaggctccctccgttggggcaaacgctgccctgacactgtctggtgtgcagcctggacggacgaggctgactattacgtcgccttactcttacgtttggtagttgcttgtgcttagttcgggacggacggaccaagctacgaccgttcgttaacgtcaacggcccaaggtcctccgaccccgttcggtaccaccgttcgtccgttccccgtcccc

SEQ ID NO: 134032 - DNA, 592 bp, Homo sapiens
  misc_feature: GYAE6OF02F8DI2.17.33.C11.1.454.CMB.1.raw
  modified_base (321)..(321): a, c, t, g, unknown or other
  misc_feature (321)..(321): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcattatagtaacaaacaacaaacactccncggaccctgccgatctcagcctccctccgtggggcaaagctcgcctgacactgtcgtggtgtgcagcctggaggacggaggctgacttattactcgccttactccttacgtttgggtggtgtcgttgtgtcgttagttccgggacgggacgggtaccgaagcgtacggtaccgttcgttaagtccgaacgccccggaaggtcccgtccgtacccccgttacggtacctaccgttccgttaccgttaccccctaccccttccccgttacccg

SEQ ID NO: 134033 - DNA, 625 bp, Homo sapiens
  misc_feature: GYAE6OF02FEHA3.17.33.C11.1.454.CMB.1.raw
tcagcgtagactagcacgaccggtgctcgatttagagtgagctcgttgggtttggggctggcgccagggtcccttccaatatcagcaccatggcctggactcctctctttctgttcctcctcacttgctgcccagggtccaattctcagactgtggtgactcaggagccctcactgactgtcgtccccagggagggacagtcactctcacctgtgccttccaacactggagcagtcaccagtcgcttactactaccaaactcggttaccacgacaacgtaaaccgtggaacaacgccacccgaggcactactaattaataagtaacaaaacaacaaacgtacctccgtacgacccctcgaccgtattccacgacgcctcccgtcggtcggggacaacgctcgcctagacctactcggtcgtggtcgtcgcacgtccgtaggacggacgtacggtctacgtaactacgttaccgtcgtaccctttacttcgtttacggtttgggtcggtcgtcgtggtcgtacgttacggttcgggacgggacgactagtccgtacgtaccgtagtacgcgaccgacccgtacgtccgtccgtcccgtcgtcctaccgtccttccgtcccgtcccc

SEQ ID NO: 134034 - DNA, 840 bp, Homo sapiens
  misc_feature: GYAE6OF02JQ0PF.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtcgtcctaccaactcgtggacgactacgtaccaaccgtggtactaccttactacctaacctaacgttccgtacgacgacgaacgtaaccgtacgaacacgacccaccggacggtaccaccgttactaacgtttaacgtaaacgtaaaaccaaaaccaaaacctaaaccgtaaccgttcccggtaacccgtacccctaccggtacccttaaccgttccgtaaccggtacggttaccccttaccccggttaccgggtacggggtaacctaaaccgtccgtaccgtaccctacggaactaccgttcgttaacggtgggtacgtacgtaccgtaccggccggtaggaacgggacggtaaccgtgttaaccgtaaacgttacttaccgtaccgttaccttacgtttaccgtttacgggtttaccgggttgtccggttacggtttcggtacgttaaccgtttacgggtaccgggggtaaccggggtaacggtaaaccctacggttacggttaacccgggtaaccgtttacggtaacgtccggtacccggaaaccggttcggtaccggtcccccgtacccggttaccgtccttccgttaccccggtcccggtcccccttacccgtccgttaaccgg

SEQ ID NO: 134035 - DNA, 664 bp, Homo sapiens
  misc_feature: GYAE6OF02GENRR.17.33.C11.1.454.CMB.1.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacnctggancagtcacagtgcttactatccaaactcggttccagcaacgaaacctggaacaagccacccgagggccactctattatacgtaacaaacaacaaacactacctcggaacccctgaccccgtattccacacggtcctccctcgtggggaccaagctcgcctgactactgtcgtggtgtcgacgcgccgtaggacgggacgaggtctagtacctacgttactcgtacccttagttaccttacgtttgggtcggttcgtacgttggtcgtacgttacggttccgggtacgggtaaccggaacgtaacgccgttacggtacccgtttacgttaacggttccgaaccggtaccccgtaacggttcccgttacccgtccccccgggttacggttccccggtaacccgtttccgtttaccccggttccccttaacccccccgg

SEQ ID NO: 134036 - DNA, 683 bp, Homo sapiens
  misc_feature: GYAE6OF02GOHMB.17.33.C11.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (305)..(305): a, c, t, g, unknown or other
  misc_feature (305)..(305): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggancagtccaccagtncttactataccaaactggttaccagacaagaaaccgtggacaagccaccgaggcactcatttanagtaacaaacaacaaacactctacggaccctcgccgtactctcagtcctccctcgtggggacaagctcgcctgacacgtctcgtggtcgtgcgagccgtaggacgggacggacggtactacgtaacttaacttacgtacgtaccttacgttaccgtttacgtttcggggtcgttacgtccgttggttcgtacgtttaccggttccggggtaccggggaacgggtaaccgtaacggccgttaaccggtacccgttacgtttaacgtcccgtaacggtaccccggtaaaccggttccgtaccccggtacccccggttaccggtaccctacccggttccgttaccccgtttacccccgtacccccgtttcccttaccccgg

SEQ ID NO: 134037 - DNA, 526 bp, Homo sapiens
  misc_feature: GYAE6OF02IK0CH.17.33.C11.1.454.CMB.1.raw
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccgttggggcaaagctgccctgacactgtctggtgtgcagcctgaggacgaggctgactattactgctactctacttggtgtgctgtgctagttcggcggagggaccagctcgacgtcttagtcagcccaaggcctcgcccccgtcggtcacttctccgtccctaccctcctacccg

SEQ ID NO: 134038 - DNA, 664 bp, Homo sapiens
  misc_feature: GYAE6OF02HZ9O1.17.33.C11.1.454.CMB.1.raw
  modified_base (297)..(297): a, c, t, g, unknown or other
  misc_feature (297)..(297): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaaacactggagcagtccaccagtgcttactatccaaactggttccagcagaaacctgacaagcaccaggcactcatttanagtacaaacaacaaacactcctggacccctcgacccgtattcacgacgcctcccgtcgttcggggacaacgctcgcctagactacgtgtcgtggtgtgacacgtccgtaggacgggacggaggtctacggtaacttacgtttaccgtcgtacccttaacgttccgtttacgtttgggtacggttcggtcttggtcgtacgttacggttccggggacgggtaaccgggaccgaacggtctccgggtaaccgtttaccgttacgttaccgaccgtacccggaacggtccgtccccggtaccccccgttcgggtacccttacccggttccgtttaccccggttaccccctaccccttaccccgttacccg

SEQ ID NO: 134039 - DNA, 553 bp, Homo sapiens
  misc_feature: GYAE6OF02FMLOQ.17.33.C11.1.454.CMB.1.raw
  modified_base (448)..(448): a, c, t, g, unknown or other
  misc_feature (448)..(448): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactgttccagcagaaacctggacaagcacccagggcactcatttatagtacaaaacaacaaacaactcctacggacccctgcccgacttctcacggcctccctccttgggggcaaagctgccctgacactcgtcgtggtgtgcagcctgaggacgaggctgactatactgccttactcttacgtttggtgtgctgtntcgtagttcggcgggtaggaccgaagcgttgaccgttacttacgtcagcccaaggcctcgcccccgttcggtccacgttcctccgttcccctaccctccctcccg

SEQ ID NO: 134040 - DNA, 526 bp, Homo sapiens
  misc_feature: GYAE6OF02FFFW4.17.33.C11.1.454.CMB.1.raw
  modified_base (378)..(378): a, c, t, g, unknown or other
  misc_feature (378)..(378): n is a, c, g, or t
  modified_base (511)..(511): a, c, t, g, unknown or other
  misc_feature (511)..(511): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcatttatagtacaaacaacaaacacctcctggacccctgccccgattctcagctccctcttggggcaaagctgcctgacactgtcngtgtgcagcctgacgggacgaggctgactattactgaccttactctacgtttggtggtgtctgtgcttagttcggcgggaggaccagctgtaccgtctaacgtcacgcccgagtcctcgccccttcggtaccnctcgtgttcctaccc

SEQ ID NO: 134041 - DNA, 549 bp, Homo sapiens
  misc_feature: GYAE6OF02HO7F7.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgttcccaggagggacagtcactctcacctgtgcttccaacactggagcagtcaccagtgcttacatccaaactggttccagcagaaacctgacaagcacccagggcactcatttatagtacaaacaacaaacactcctggaccctcgcccgattcctcacggcctccctccgttcgggggcaaacgctcgccctgacactacgtctggtgtgccagcctggacggacgaggctgactattactgcctacttctactttggtgtgctgtgctagttcggcggacgggaccaagcgtcgaccgttacgttaacgtcgacgaccgaacggcctcggcccctcggtccaccgtctcgttacccctaccccg

SEQ ID NO: 134042 - DNA, 574 bp, Homo sapiens
  misc_feature: GYAE6OF02IDWGI.17.33.C11.1.454.CMB.1.raw
  modified_base (193)..(193): a, c, t, g, unknown or other
  misc_feature (193)..(193): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (463)..(463): a, c, t, g, unknown or other
  misc_feature (463)..(463): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtgtccccaggngggacagtcactctcacctgtcgcttccaacactggagcagtcaccagtgcttactatccaaactggttccagcaacgaaacctaggacaacgcaccgaggcactctatttatagtaacaaacaacaaacactacctcgaccctcgccgtatcncacgcctccgtcgtggggacaagcncgcctnactactgtcgtggtgtgcacgccgtgacggacgagcgtagacttatacgttctacctacttcgttacgtttggtgtgtcgtcgtntcgttaggtcggacgggacggaccaagtcgtacggtaccgttacgttaacgtccgacgtccgaacggtcctccgtcccgtacggtcctaccgtcttcccgtccctaccccg

SEQ ID NO: 134043 - DNA, 555 bp, Homo sapiens
  misc_feature: GYAE6OF02IOLY9.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccggggtccaattctcagactgtggtgactcaggagccctcactgactgtgtccccaggagggacagtcactctcacctgtgcttccaacactggagcagtcaccagtgcttactatccaaactggttccagcagaaacctggacaagcaccaggcactcattatagtacaaacaacaaacactcctgacccctgcccgattctcaggcctccctccgttggggcaagctgccctgacactgtctggtgtgcacgcctgacggacgaggctgactattacgtgcctactcttacgtttggtggtgcgtgtcgtctagttcgggcgggagggaccaaggcgtacgaccgttcgttaacgtcgaacggcccgaaggtcctcgcccccgtcggtcctaccgttcgtccggttccccgcccttcccg

SEQ ID NO: 134044 - DNA, 534 bp, Homo sapiens
  misc_feature: GYAE6OF02FHKU5.17.33.C11.1.454.CMB.1.raw
  modified_base (507)..(507): a, c, t, g, unknown or other
  misc_feature (507)..(507): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcacggctccctcgttgggggcaaagctgccctgacactgtctggtgtgcagctgaggacgaggctgacttatactgccttactcttactttggtgtgcttgtgcttagttcggcggaggaccagctgaccgtcttacgtcacgccaggtccgtccgccccgtcggtccncctcgtcgttccccgccctccttaccg

SEQ ID NO: 134045 - DNA, 771 bp, Homo sapiens
  misc_feature: GYAE6OF02JOLED.17.33.C11.1.454.CMB.1.raw
  modified_base (213)..(213): a, c, t, g, unknown or other
  misc_feature (213)..(213): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtgtccccaggagggacagtcactctcaccttgngcttccaacactggagtcagtccaccagtgccttaactatacccaaaacttcgggttacctacgcgacgtaaaacccgtggaacgaacgcaaccccgaggggccacctacgatttatagtaacaaaacaaaccaaaactacctaccgtacgaacccccgtcgaccccgtattcctacgacggtaccttaccccgttacccggttacgggggggaacccaaacggtcccgtaaccgtccccgtacgtaacccgtaacgttccggttcgttgggtcgttacggccgtaacgggtacccgtaggggtaacgggaaccggtaacgggtcccgttaggtaaccttaacgtttaccgtcgtaccgtttacccgttactttaacggttttcgggtagggttcgtcgttcgtcgttcgttacgggtttaccggacgggggaaccgttaccgaacggtcgttaaccggttaccgttccgtttaacgtccgacggacccgtaagttcccggtccgccccgttacgtccgtaccttcccgttaccgtcccccgttacctccccgttacg

SEQ ID NO: 134046 - DNA, 621 bp, Homo sapiens
  misc_feature: GYAE6OF02HK39N.17.33.C11.1.454.CMB.1.raw
  modified_base (301)..(301): a, c, t, g, unknown or other
  misc_feature (301)..(301): n is a, c, g, or t
  modified_base (425)..(425): a, c, t, g, unknown or other
  misc_feature (425)..(425): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgctttacatccaaactggttccagcagaaacctggacaagcacccgagggcactcatttanagtaacaaacaacaaacactccgtcggacccctgacccgtattctacacggcctcccttccgtgggggacaaagctcgccctgaaccactgtcgttggtcgtagcgacgcctggacgggacggnggctaggacttagttacgtcgaccttacttcgttagtttggtggttacgcgttaggtcgtcgttgttccgggagggacggaaccgaagtccgtacgtacccgttacgttaacgtcaaccggacccggtaacggcccgttaccggtcccccgttaccggttccgtacccgtttccgttccggtttccccctaccccg

SEQ ID NO: 134047 - DNA, 624 bp, Homo sapiens
  misc_feature: GYAE6OF02IO1FA.17.33.C11.1.454.CMB.1.raw
  modified_base (341)..(341): a, c, t, g, unknown or other
  misc_feature (341)..(341): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcaagaaacctggacaagcaccgaggcactcatttatagtaacaaacaacaaacactcctcgaccctgcccgattcncacgcctccctcgtcggggacaacgctcgccctgactacgtgtcgtggtgtgcgagccgtggacgggacgaggctagactattacgtcgtacctacttcttacgtttggtgtgtcgtgtcgtcgtagttcgggcggtaacgggaccgaaacgtcgttacggtacccgttacgtttaacggtccgtaaccggtacccgtaaacgggtcccgttaacccggtcccccccggttaccgggttccctacccggttcccgtttacccggttacccccgtaaccccccg

SEQ ID NO: 134048 - DNA, 560 bp, Homo sapiens
  misc_feature: GYAE6OF02H82L9.17.33.C11.1.454.CMB.1.raw
  modified_base (302)..(302): a, c, t, g, unknown or other
  misc_feature (302)..(302): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactaccaaactcggttccagcagaaacctggacaagcaccgaggcactcatttanagtacaaacaacaaacactcctcgacccctgcccgatctcacgcctcctccgttggggacaaacgctcgccctagacacgtcgtcgttggtagtcgcacgccgtggacggacgaggctagacttagttactcgtacctactcttacgtttggtggtgtctgtcgcttagttcgggacggacggaccaagtctcgaccgttacttagtcacgacccaaggtcctcgccccgttggcctacctcttccgtccctaccccg

SEQ ID NO: 134049 - DNA, 651 bp, Homo sapiens
  misc_feature: GYAE6OF02JHPQ2.17.33.C11.1.454.CMB.1.raw
  modified_base (315)..(315): a, c, t, g, unknown or other
  misc_feature (315)..(315): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttaccaacacgtggagcagtcaccagtcgcttactactaccaaacttcggttaccagtacaacgaaacctggacaagccaccgaggccactctattanacgtacaaacaacaacactcgtacgaccctgccgtatctcacgcctcccgtcgtcggggacaagtctcgccctgacactgtccgtaggtcgtcgacacgtccgtaggacggaacgagggtcctaggtaaccttattaccgtacggtaccttaaccgttacttacgttttcggcggttcgtacgttcggtagtaccttacggttccgggaccgggtaacggaaccacggtccgttacgacccgtttacgtacggtaccgaacgtacccggtaaggtccgttacccggtccccgtcggttacccgaccgttacccgtttaccgtccccttaacccccg

SEQ ID NO: 134050 - DNA, 632 bp, Homo sapiens
  misc_feature: GYAE6OF02JF06G.17.33.C11.1.454.CMB.1.raw
  modified_base (330)..(330): a, c, t, g, unknown or other
  misc_feature (330)..(330): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgcccctcactgactgtcgtccccgagggagggacagtcactctcacctgtcgcttaccaacactgggagcagtccaccagtcgtaccttaactactaccctaaaacgttcgttaccacgacaacgaaaccgtacggaacaaggcacccagggcaactcatttanagtacaaacaacaaacactacctgacccctgccccattcctcacggctcccgtccttcgggggcctaaaggcctaggccctggaccactcgtactggtgtcgcagcctgacggacgaggctagactatactgcctactcttacttggtgtgtcgtgtgtcgttacgtcggacggtacgggaccgtaaggccgtacggtaccgttacgttacgtaccgtaacggtacccgaacggtccgtaccggtcccccgtcggtcccgtaccgttcccgttccggttccccgtcccgttccccgtacccg

SEQ ID NO: 134051 - DNA, 724 bp, Homo sapiens
  misc_feature: GYAE6OF02JOZ9R.17.33.C11.1.454.CMB.1.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
tcagcgtagactagcacgaccggtgctcgatttagagtgagctcgttgggtttgggggcggccgaggggtcccgttccaactatcagcaccatggcctggactcctctcttctgttctcctcacttgctgcccagggtccaattctcagactgtggtgactcaggagccctacactgactgtcgtcccaggagggacagtcactctcaccgtgtnccttccaacnctgggancagtccaaccngtcgacttactactaccaaaattcggttaccagacaacggaaaacctggaacaacgacaacccgagggccacttacaattttaacgacgtaacaaaacaacaaaacgaccttaccaccggaccctacggaccccgtactttctaccgacggtcccttcccgtaccggtttcgggggaacaaaccgcgttcccgacccggttcaaccgtaccttcgggtacctagggttcgtacgaccgacgttccgtagggtaacgggaacgcggtacgtagtaaccgttagttaaccgttcggtacccttacgttaccgtttagtttcgggtgttcggtcttagtcggtcttacgggttcgggacgggtacgggaacctaaggccgttaggacccgttcggttaacgtcgtaccggaacccgaggttcccgtccgtccccggtacgtcctaaccgttcccgttaccgtcccccgtcccttaccttacccg

SEQ ID NO: 134052 - DNA, 753 bp, Homo sapiens
  misc_feature: GYAE6OF02GSF6T.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttaccaacacgtggacgcagtccaccgagtcgacttactactacctaaactcgggttaccagacaacgtaaaccgtggaacaacgcccgaacccgagggaccacgttactaatttacgtaacgtaaaccaaaaacctaaaccaaactacccgttaccgtaccggtaccccctacggacccgtacttccgtacgaccggtcccttcccgttcggggttacggggaactaacggtccgtcgacccgtacgacctacgtcgtcggtaggtcgtcgacgtacgtaccggtaggaacgggagtaccggtcgttacgtaaccgttaacttcggtccctttaaccgttaccgtttcgtttaaccggtttgggtcggttccgtcgtttcggtcgttacgtttacgggcccgggtaacgggtaaccggaacgtaactcggttaccgtaacgtttacgtacgtcctaaccggcccggtaacgtcccgtacccgtccccgttagtcccttccgttacccgttcccctacccttcccgtaccttacccgg

SEQ ID NO: 134053 - DNA, 581 bp, Homo sapiens
  misc_feature: GYAE6OF02IP2F9.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtaacaaacaacaaacactcctcgacccctgccgattctcacgctccctcgttcggggacaaagctcgccctgactactgtcgtggtgtgcagccgtgacggacgaggctgacttattacgtgccttacttcttacgtttggttgtgcttgtcgtcttagtcgggacggtacgggaccaaggctacgtaccgttacgttacgtcgacgtcccgacggtccgtccgcccccgttacggtcctaccgttccgtttacccgttcccctaccccgttcccttacccg

SEQ ID NO: 134054 - DNA, 668 bp, Homo sapiens
  misc_feature: GYAE6OF02IE6DZ.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacacgtggagcagtcaccagtgcttactataccaaactcggttccagcaacgaaaccgtggaacaacgaccaccgaggcactactatttaataagtaacaaacaaacaaacacctacctacgacccctcgacccgtattcctacgacggcccttcccgttccggttacgggggacctaaacggtccgtaccgcccgtacgtacctaccgttcgtcgttcggttcgtacgcgacgtccgtaggaacgggagtacggtcgtacgtacttacttacgtcgtaccttacgttccgttacgtttggtcggttagtcgttggtcgtacgttcggtcgggaccggtacggaaccgagtccgtacggtaccgttacgttacgtaccgacgtaccgtaacggtccgtacccgtccccgttacggtcctccgttccttcccgttacccctaccccg

SEQ ID NO: 134055 - DNA, 671 bp, Homo sapiens
  misc_feature: GYAE6OF02JD8U5.17.33.C11.1.454.CMB.1.raw
  modified_base (302)..(302): a, c, t, g, unknown or other
  misc_feature (302)..(302): n is a, c, g, or t
tcagcgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacacgtggagcagtcaccagtgcttactatcctaaactcggttccagcaacgaaacctggaacaagcaccgaggcactcatttanagtacaaacaacaaacactcctaggacccctgacccgtaacttcgtacgacggtcctacccgtccgttcggggacaaacggctcgccctagacctacgtgtctggttcgtgacgacgcctggaacggacggtacggctcgaacttacgttactacgtccttacgttcttaacgtttcgggttcggttgccgtgtcggtcgttaacgtcgggtaccgggacgggtaccgaaggtcgtacgtaccgttaccgttaacggtaccgaaccggtacccggtaaacggtcccgttaaccggtcccccccgttacggttcccgtaaccgttcccgttacccggtttccccccgtcccgtttaccccgttaccccgg

SEQ ID NO: 134056 - DNA, 719 bp, Homo sapiens
  misc_feature: GYAE6OF02IZYR7.17.33.C11.1.454.CMB.1.raw
  modified_base (176)..(176): a, c, t, g, unknown or other
  misc_feature (176)..(176): n is a, c, g, or t
tcagcgtagactagcacgaccggtgctcgatttagagtgagctcgttgggtttggggctggcgccgaggggtcccttccaatatcagcaccatggcctggactcctctctttctgttcctcctcacttgctcgcccagggtccaattctcagactgtggtgactcaggacgccctnactgactgtcgtccccagggagggacagtcactctcacctgtgccttaccaacacgtggagcagtccaaccagtcgactttactactaccaaacgtcggttaccagacaacgaaacctggaacaagaccaaccgagggccactactaatttaataagtaacaaaacaaacaaaccactaccgtacggaacccctcgtacccgtaacttctacgacggtcctcccgttccggttacgggggaacctaaaacggccgttacgacccgtacgtaaccgtaccgttacggtcgttacgggtcggtcgaccgacgtccgtacggaacgggacggacggacgtacgtaacgtaacgttaacgttacgtaccgttacttaccgttacgtttcggttcggttcgtcgttcgtcggtcgttacgttccgggtacgggaacgggtaaccggaacgtacgtacggtaccgttacgttaacggtacgacgtaccgtacggaccgtccgtcccgtaaaaaccggtccgtaccttccgttaccgtccccgttacccc

SEQ ID NO: 134057 - DNA, 577 bp, Homo sapiens
  misc_feature: GYAE6OF02G8THF.17.33.C11.1.454.CMB.1.raw
  modified_base (301)..(301): a, c, t, g, unknown or other
  misc_feature (301)..(301): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaacgcacccgaggcactcatttanagtaacaaacaacaaacactacctacggaccctcgcccgtatcctcacgctccctcgttggggacaagctcgcctacgactactcgtctggtgtcgcacgctggacggacgaggcgtgactattacgtcgtccttactcttacgtttggtgtgtcgtgtcgtctgttcggacggtaacgggaccaagtcgtacgtacgttacgtaagtaccgaccgaccgtaacggccgtccgacccccgttcggtcctaccgttcgttccggtaccccgtccccg

SEQ ID NO: 134058 - DNA, 590 bp, Homo sapiens
  misc_feature: GYAE6OF02IKCYD.17.33.C11.1.454.CMB.1.raw
  modified_base (300)..(300): a, c, t, g, unknown or other
  misc_feature (300)..(300): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgccttactatccaaactggttccagcagaaacctggacaagcaccagggcactcatttanagtaacaaacaacaaacactcctcggacccctcgcccgtattcctcgacggcctccctccgttcgggggacaaagctgccctgacactgtctggtgtgcagcctaggacggacgaggctgacttattacctcgtccctacttcttacgtttggtggttgcgttagtcgtcttagtcgggtacggacgggaccaacgtctcgtaccgttacgttacgtcgaccgacccgaacggtcctaccggtcccccgttaccgggtcctaccgttccttccggttaccccgtcccccg

SEQ ID NO: 134059 - DNA, 795 bp, Homo sapiens
  misc_feature: GYAE6OF02F0P0N.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtcccgagggagggacagtcactctccacctgtcgtccttaccaacacgtggacgacacgtccaaccgtaggtcgtaccttaactactaccctaaacgttcggttaccagaccaacggtaaacccgtacgggaacaaacgacccaaccccgaggggaccaaccttactaattttaagtaacgtaaacaaaacaaaccaaaactacctaccgtaccggacccctacggaccccgtaattcctacgtacggtcccttccccgttccgggtttacggggggacctaaaacggtccgtaccggtaccccgtacgtaacccgtaaccggttcggttccggttggggttcggttccggaccgtaccggtcccgttaggggaaacgggtaccgggacgggtccgttaacgggtaacttaacgtttaccgtacgtacccgtttaacttccgtttaacgttttcgggtacggttcgtacgttggtacgtacgtttacggttccgggacgggtaccgggacctaacggtcgtacgtaccgttagttacggtcaccggtaccggtaacgtccgtacccgtcccgtcgtaaccgtccgtccgttcccgtaccccttaccccg

SEQ ID NO: 134060 - DNA, 566 bp, Homo sapiens
  misc_feature: GYAE6OF02GG8ED.17.33.C11.1.454.CMB.1.raw
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
  modified_base (544)..(544): a, c, t, g, unknown or other
  misc_feature (544)..(544): n is a, c, g, or t
  modified_base (556)..(556): a, c, t, g, unknown or other
  misc_feature (556)..(556): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcagggacgccctcactgactgtcgtccccagggagggacagtcactctcacctgtgccttccaacactggagcagtcaccgagtcgacttactataccaaacttcggttaccagcaacgaaaccgtggaacaagccacccgacgggcactctatttatacgtaacaaacaacaaacactccgacgaccctcgccacttctcngcctcctcgtcggggacaagctcgcctgacnctgtctggtgtcgcacgtcctggacggacgacgctagacttatacgtcgtacctacgtcttacgtttggtgtcgtcgtgtcgtcttagtcgggacgggacggaccaagcgtacgacttacgttagcacgaccgagtctccgcccgtcgtcnctcgtcctcccnccctctaccg

SEQ ID NO: 134061 - DNA, 580 bp, Homo sapiens
  misc_feature: GYAE6OF02F8QH7.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctggacaagcacccagggcactcatttatagtacaaacaacaaacactcctggacccctgcccgattcctcaggctccctcgtggggacaagctgccctgacactgtctggtgtgcagcctgacggacgaggctgactattactcgaccttactcttactttcgggtgtcgcgttggttagtcttagtttccggggcgggtaacggggacctaacggcgttagtacccgttacgtttaacgactacgacccgaacggtcctccgtcccccgtcggtccaccttccgtccgttcccctacccctcccttacccg

SEQ ID NO: 134062 - DNA, 617 bp, Homo sapiens
  misc_feature: GYAE6OF02IX8YJ.17.33.C11.1.454.CMB.1.raw
  modified_base (204)..(204): a, c, t, g, unknown or other
  misc_feature (204)..(204): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (558)..(558): a, c, t, g, unknown or other
  misc_feature (558)..(558): n is a, c, g, or t
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtcccaggagggacagtcactcncactgtgcttaccaacactggagcagtcaccagtgtcttaactataccaaactcggttaccagcagaaacctggacaaggcaccaggcactctattatagtacaaaacaacaaacactcctacgacccctcgcccggattcacgacgcctcccgtacgttcgggggaactaacgcctacgccctagacactgtctggtacggtcgcgacgtcctaggaggacgaggctanacgttatacgtntacctactcttacgttcggtggtgcgttgtcgtacgttacgtacgggcgggtaacggaccgtaacggtcgtacggtaccgttacgttaacgtcgaacgtacccggaacggtntaccccggtcccgttacgtcctaccgttcgttaccggttcccctaccccttcttacccg

SEQ ID NO: 134063 - DNA, 693 bp, Homo sapiens
  misc_feature: GYAE6OF02I416G.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcgaggacgccctcactgactgtcgtcccgagggagggacagtcactctcacctgtcgcttaccaacacgtggacgcacgtcaaccagtcgtcttactactacctaaacgtcggttaccaagctaacgaaaaccgtggaacaaacgccaaccgacgggacctactactatttaacgtaacgtaaaaccaaaactaaacaaaccactccgtaccggaccctcgaccctaacttcgtacaccggtcctcccgttacggtacggggaaccaacgtccgtacgtaccctacgaaccgtaacgttcgttcgtcggttacggtcgtacgtacggccgtacgggaacggaggacggtcaacgtaacgttactacgtacgtccttaacgttacgttcgtttaggtggtcgtcgttcgtacgtcgttaacgttcgggacgggtaggaaccgacgtacgtacgtacgttacttaacggcgtaaccgacggtaacgtccgtcccgtaccgtcggtacctaccgtccgttccgtaccctaccccg

SEQ ID NO: 134064 - DNA, 705 bp, Homo sapiens
  misc_feature: GYAE6OF02H9QWA.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcacagtgcttactactccaaactggtccagcagaactggacaagcaccgaggcactcatttatagtacaaacaacaaacactacctacggacccctcgccgtactctacacggccttccgttccgtcgggggactaaacgctacgcccgtagaccacgttcgtcgttagggtgtacgccgtacggacccgttgggaacgggaacggtagggccgtacggaacgtttacgttaaccgttacgtacccgttaacctttccgtttaacgtttcgggttacgggttcggtccgtttggttacgtccgtttaacgggtttccggggacggggtaacgggtaacccggaaaggtcccgttacgggtaacccggttaccggtttaaacggtccggtaaccggacccgtaacgggtcccgtacccggtcccccggtacgggtaccctacccgtccgttttacccgtaccccctacccccg

SEQ ID NO: 134065 - DNA, 592 bp, Homo sapiens
  misc_feature: GYAE6OF02HESXJ.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcaccagggcactcattatagtacaaacaacaaacactcctggaccctgccgatctcaggctccctcgttggggacaacgctgcctgacactgtctggtgtgcagcctgaggacgaggctgacttagtactcgtccttactcttacgtttgggtgtgcgttgtcgtacgttagttccgggacgggtaacgggaccgtaaggtcgttacgtaccgttacgttacgtacgtacggacccgtaacggtcctacccggtcccccgttacgggtcctaccgttccgttccgttaccccctaccccgttcccttaccccg

SEQ ID NO: 134066 - DNA, 521 bp, Homo sapiens
  misc_feature: GYAE6OF02FFWNL.17.33.C11.1.454.CMB.1.raw
  modified_base (432)..(432): a, c, t, g, unknown or other
  misc_feature (432)..(432): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacagcacccagggcactcatttatagtacaaacaacaaacactcctggacccctgccccgattcctcaggctccctccttgggggcaaagctgccctgacactgtctggtgtgcagcctgaggacgaggctgactatactgccttactcttactttggngtgtctgtgctagtcggcggaggacagctgacctgttagcacgtcccaggcctcgcccctggtcactccgtcgtccccgtcctcctccg

SEQ ID NO: 134067 - DNA, 562 bp, Homo sapiens
  misc_feature: GYAE6OF02HEPXM.17.33.C11.1.454.CMB.1.raw
  modified_base (445)..(445): a, c, t, g, unknown or other
  misc_feature (445)..(445): n is a, c, g, or t
  modified_base (524)..(524): a, c, t, g, unknown or other
  misc_feature (524)..(524): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattcctcaggcctccctccgttcgggggcaaagctgccctgacactgtctggtgtgcagcctgaggacgaggctgactattactgccttactcttactttggtgtgctgtgnttagtcgggcggacgggacctaaggctcgacccgttcgttacgtcacggcccgaaggccctcggcccccgttcggtccnccttaccgttccgttcccctaccccgttcccttacccg

SEQ ID NO: 134068 - DNA, 535 bp, Homo sapiens
  misc_feature: GYAE6OF02F7IZH.17.33.C11.1.454.CMB.1.raw
  modified_base (399)..(399): a, c, t, g, unknown or other
  misc_feature (399)..(399): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtcccccaggagggacagtcactctcacctgtgcttccaacactggagcagtcaccagtgcttactatccaaactggttccagcagaaacctggacaagcacccaggcactcatttatagtacaaacaacaaacactacctgacccctgcccgattctcaggctccctccttggggcaaagctgccctgacactgtctgtgtgcagcctgaggacgnggctgactattactgcctactctactttggtgtgctgtgctagttcggcggtaagggaccaaaggctgaccgtcttaaaggtccaaggtccccaaaggcctcggccccctcggtccactcctgttccccctacccc

SEQ ID NO: 134069 - DNA, 620 bp, Homo sapiens
  misc_feature: GYAE6OF02IELTK.17.33.C11.1.454.CMB.1.raw
  modified_base (344)..(344): a, c, t, g, unknown or other
  misc_feature (344)..(344): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttaactactaccaaacttggttccagcaagaaacctggacaagcaccgaggcactatattatagtaacaaacaacaaacactcctcggaccctcgcccgtatcncgacgctccctcgtggggcaagctcgcctcgacactgtcgtggtcgtcgcgacgctaggacggacgacgtcgtagtactagttacgtcgaccttaccttacgttacggtttggttacgggtcgtcgttggtgtaccgttagttcgggacggggtacggacgaacggtcgtacgtaccgttacgttacgtaccgtaccggtacccaaggtcccgtacccggtcccccttcgggtacctaccgttccgttcccttccccgtacccctccgtttacccg

SEQ ID NO: 134070 - DNA, 600 bp, Homo sapiens
  misc_feature: GYAE6OF02JXP06.17.33.C11.1.454.CMB.1.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
tcagcgtagactagcacgaccggtgctcgatttagagtgagctcgttgggtttggggggtcggccaggggtcccttccgaatatcagcaccatggcctggactcctctctttctgttcctcctcacttgctgcccagggtccaattctcagactgtggtgactcaggagccctcactgactgtgtccccaggagggacagtcactctcacctgtncttaccanactggancagtcacngtncttactntaccaaactgttccagcagaactgacacgcaccaggcactcattatagtaacaacaacaaacactcctgaccctgcccgtatctcagcctaccctcgttcggggacaacgctgccctgactacgtcnccgtggtcgtncgacgctcggtaggacgacggcgtnaaccgtattacgtgaccgttactacttagtttcgggagttgctgtagcttagtccgggagggtcgtaaccgacgtcgtacgtacccgttattacgcctaacggcccgtaaggttcccgtaccggacccccgtttacggtaccgttaccgtcccgttaccggtttcccccacccgttccccgttaacccg

SEQ ID NO: 134071 - DNA, 666 bp, Homo sapiens
  misc_feature: GYAE6OF02IJCK8.17.33.C11.1.454.CMB.1.raw
  modified_base (343)..(343): a, c, t, g, unknown or other
  misc_feature (343)..(343): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaaactggttaccagcaacgaaacctggacaagcaccagggcactcatttatagtacaaacaaacaaacactcctcgaccctgcccgtattcncacgcctcctccgtggggacaaacgctcgcctgacactgtctggtgtcgcacgccgtgacgggacgaggctagaacgttaacttacgtcgtaccttaacttccgtttacgttttgggttcggttcggtcgttacggtgtaccgttagttccggggacgggtacgggaacccgtaacgcgttaccggtaaccgttaccgtttaacgtccgtaacggtaccccgaaacgggtcccgtcccggttaccccccgttaccggttacccgttaacccgtttcccgtttacccgttaccccccttacccccgttaccccgtttaccccgg

SEQ ID NO: 134072 - DNA, 669 bp, Homo sapiens
  misc_feature: GYAE6OF02HJN6J.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtcgcttactataccaaactggttccagcaagaaacctggacaacgcaccagggcactcattatagtaacaaacaacaaacactcctacggacccctgacccgtattcctacgacggtcctcccgtcgttcgggggacaacgctcgcctagacactcgtcgtggtgtcgcacgtccgtggacggacgacggctagtacttattacgtacgtccttacgttcttacgttttcgggtaggttcgtcgttaggttcgtaccgtttacggtttccggggacgggtaacgggtaccgtaaacggtcgttaccggtacccgttacgttacggtccgtaaccggtacccgaacggttcccgtacccggttacccccgttacggtaccctacccgttccgtttaccccggtttaccccctaccccgttcccgttaacccgg

SEQ ID NO: 134073 - DNA, 584 bp, Homo sapiens
  misc_feature: GYAE6OF02GBPPX.17.33.C11.1.454.CMB.1.raw
  modified_base (171)..(171): a, c, t, g, unknown or other
  misc_feature (171)..(171): n is a, c, g, or t
  modified_base (396)..(396): a, c, t, g, unknown or other
  misc_feature (396)..(396): n is a, c, g, or t
  modified_base (466)..(466): a, c, t, g, unknown or other
  misc_feature (466)..(466): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccaaacactggagcagtcaccagtgcttactatccaaaactggttccagacagaaaacctggacaagccaccagggcactcatttatagtacaaaacaacaaacactcctacggacccctgcccgattctcacggcctccctccgttggggcaaagctgccctgacactgtctggtgtcgnacgctgaggacgaggctagactattactcgacctactcttacgtttggtgtgtctgtgcttagtccgggnggtacgggacctaaggctagaccgttacttaacgtcgacgaccgaacggtccgtaccgcccccgtttacggtaccctaccgtttccgttaccgttccccctacccttcccgttacccg

SEQ ID NO: 134074 - DNA, 596 bp, Homo sapiens
  misc_feature: GYAE6OF02HH9P5.17.33.C11.1.454.CMB.1.raw
  modified_base (304)..(304): a, c, t, g, unknown or other
  misc_feature (304)..(304): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttaccaacactggagcagtcaccagtgcttactatccaaactggttccagcaagaaacctggacaagacacccagggcactctatttanagtaacaaacaaacaaacactcctacggaccctcgccgtacttctcaacgcctccctcgttacgggggacaaagctcgccctagacactcgtacgtggtacgtgacgacgtcgtgaacgggcgaaggtctacgaacgttacttacgttcgtaccttacttcgttacgtttgggtcgttgcgttgtcgtcttaacgtcgggacgggtaacggaccgaggtacctcggtacgttacgttaacgcaacgaccaacggcctcggcccctcggtccacttcgtccgttccctacccg

SEQ ID NO: 134075 - DNA, 611 bp, Homo sapiens
  misc_feature: GYAE6OF02G8PWX.17.33.C11.1.454.CMB.1.raw
  modified_base (420)..(420): a, c, t, g, unknown or other
  misc_feature (420)..(420): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtccaccagtgcttactatccaaactggttccagcaagaacctggacaagcaccagggcactcattatacgtacaaacaaacaaacactccgtacggacccctgaccccgtattctcaggtccctcccttccgttgggggacaaacgctcgccctgacctactgtctggtgtcgcagcctgaggacgnggctagacctattactcgccttacttcgtactttgggtgtgtctgtcgtacttacggtccgggtcgggaacgggaccgaacgcttacggtaccgttccggttaaggtccctaacgggaccctaagggtcccttaccggtaccccccgttccgggtaccctaccgttacccgttccgtacccccttaccccg

SEQ ID NO: 134076 - DNA, 570 bp, Homo sapiens
  misc_feature: GYAE6OF02I51QT.17.33.C11.1.454.CMB.1.raw
  modified_base (263)..(263): a, c, t, g, unknown or other
  misc_feature (263)..(263): n is a, c, g, or t
  modified_base (340)..(340): a, c, t, g, unknown or other
  misc_feature (340)..(340): n is a, c, g, or t
  modified_base (536)..(536): a, c, t, g, unknown or other
  misc_feature (536)..(536): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttaccaacactggagcagtcaccagtgcttactataccaactggttccancagaaacctgacaagcaccagggcactcatttatacgtacaaacaacaaacactcctacgacccctcgcccgattcncacgctccctccgtggggacaacgctcgcctgactactgtcgtggtgtcgctacgcgtgacggacggaggctgactattactcgtccttactcgttacgtttggtgtcgtcgttgtgtcttagtcggcgggtacggactacggcgtacgtacgtacgttacgctacggacccgaaggcctccgtccccgtggtccnccttcgttcccgtccccgtccctcccgttacccg

SEQ ID NO: 134077 - DNA, 695 bp, Homo sapiens
  misc_feature: GYAE6OF02GJ02I.17.33.C11.1.454.CMB.1.raw
  modified_base (108)..(108): a, c, t, g, unknown or other
  misc_feature (108)..(108): n is a, c, g, or t
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
tcagcgtagactagcacgaccggtgctcgatttagagtgagctcgttgggtttgggggcgccaggggtccttccaatatcagcaccatggcctggactcctctcttcngttcctcctcacttgctgcccagggtccaattctcagactgtggtgactcaggagccctcactgactgtcgtccccaggacgggacagtcactctcacctgtcgccttccaacncgtggacncagtccaccagtcgccttacactccgaaacgtcgtacacgacgtaacgtaacgtcggacacgccaccggacggtacctactacgtaacttacgtacgtaacaaactaacctaacctaccgttccgtaccgtacccgtacgtacccgtacgttccgtacgtaccgtccgtaccgttaccggtacggggtacaacggtcgtcgtaccgtacgtacgtacgtacgtcgtacggtcgtacgtacgtacgtcgtacggacgtacggtacgtcgtacgtacgtacgtacgtacgtaccgttacgttcgttacgttcggtacggtcgtcgttcgtcgtacgttacgtaccggtacggtacggtacgtacgtcgtacgtacgtacgttacgccgtacgtaccggtacggtccgtacccgtacccgttacgtccgtaccgttaccgtacccgttacccgtaccgttccgttacg

SEQ ID NO: 134078 - DNA, 544 bp, Homo sapiens
  misc_feature: GYAE6OF02HXUAN.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaaacactggagcagtcaccagtgcttactatccaaactggttccagcagaacctggacaagcaccaggcactcatttatagtaacaaacaacaaacactcctgacccctgcccgattctcacggcttaccctccgttggggcaaagctcgccctagacactgtctggtgtgcagcctggacggacgaggtctagtactagttactgccttactctacgtttgtgtgcgtgtgtctagtcggcggaggaccagctagtaccgttacttaacgtcacgccaaggcctccgccccgtcgtcacgttccttaccgtccctaccctcctacc

SEQ ID NO: 134079 - DNA, 787 bp, Homo sapiens
  misc_feature: GYAE6OF02GZ2J3.17.33.C11.1.454.CMB.1.raw
tcagcgtagactagcacgaccggtgctcgatttagagtgagctcgttgggtttggggcgtggcgccgacggggtcccttccaatatcagcaccatggcctggactcctctctttctgttcctcctctacttgctcgcccgacgggtccaattctcagactgtggtgactcaggacgccctcactgactgtcgtcccgaggagggacagtcactctcaccgtgctcttccaacactggagcacgtcaccagtgctttacataccaaactggtaccagacaagaactgacaagccaccaggcactctactttatacgtaacaaacaaacctaaacacgtacctaccggtaacccctcgaccccgtaattcctcgaacgccttccccgtccggttacggggggaccaaaacgtccgtaccgtcccctacggtacctaaccgttgttcccggttggtcggtcgtcgtaacgtccgttacggaacggtacggaaacggtcctacgggtaccttaaccgttacttacgtacccttaccgttccttaacggtttcggtttcgggttactcgggttcgttacggtaccttacgggttaccgggtaccggggtaaacgggtaacccggtaacggtacgttacccggttacccggttaccggtttaaacggttaccggtaacccggtaaccccggtaacccgggttacccttaccccgggtacccccccggttacgggtttacccccgaacccggttttcccggttaccccggttttacccccgttaacccccccgg

SEQ ID NO: 134080 - DNA, 577 bp, Homo sapiens
  misc_feature: GYAE6OF02I0O4U.17.33.C11.1.454.CMB.1.raw
  modified_base (301)..(301): a, c, t, g, unknown or other
  misc_feature (301)..(301): n is a, c, g, or t
  modified_base (428)..(428): a, c, t, g, unknown or other
  misc_feature (428)..(428): n is a, c, g, or t
  modified_base (451)..(451): a, c, t, g, unknown or other
  misc_feature (451)..(451): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcacgtcaccagtgcttactactaccaaactggttccagcagaaacctggaacagcaccaggcactcattanagtaacaaacaacaaacactcctacgacccctgacccgtattcctcgacgcctcccgtccgttcgggggaccaaacgtctcgacccgtagacctcttcgtactggtcgtcgcagccgtggaggacgnggctacggtactacgttacgtcnccttactcttacgtttggagtgtactgtctatcgtcggcgacggacaagtcgtgaccgttagtaagtcgaccgtcgaacggtcctcccgtaccccgtcgtacaccgttctccgttcccctaccccg

SEQ ID NO: 134081 - DNA, 603 bp, Homo sapiens
  misc_feature: GYAE6OF02G1751.17.33.C11.1.454.CMB.1.raw
  modified_base (229)..(229): a, c, t, g, unknown or other
  misc_feature (229)..(229): n is a, c, g, or t
  modified_base (393)..(393): a, c, t, g, unknown or other
  misc_feature (393)..(393): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactactccaaactggttccagcagaaacctggacaagcaccaggcactcatttatagtaacaaacaaacaaacactcctcggaccctgccccgattctcacgcctcccgtcgttcggggacaagctcgcctgacactgtctggtgtgcngcctggacggacgagcgtagtactattactcgtcctacttcgttacgtttgggtggttgtcgttgtcgtacgttgttcgggccgggaacgggtacccgaaggtccgtacggtacccgttacgttaacggtccaaccggtacccgaacggtcccgtaccggtcccccgttcggttccgtacccttcccgttcccgttccccctaacccccg

SEQ ID NO: 134082 - DNA, 621 bp, Homo sapiens
  misc_feature: GYAE6OF02GVYZY.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactgttccagcagaacctggacaagcaccaggcactcatttatagtacaaacaacaaacactccacggaccctcgccgtacttctcagcctccctccgttggggacaagctacgccgtgacacgtcgtcgtggtgtcgcgacgtccgtggaacgggacggagggacgtgtaaccgttaattaccgttcgtacccttacttcttacgttttgggtacggtgtcgttggtgtcgttacggttacggcggggacgggacctaaggtccgtcggtaccgttacgttaacggtaccaccggtacccgaaggtcccgtacccggtcccccgttcggtaccctaccgtttcccgttcccgttaccccctaccccg

SEQ ID NO: 134083 - DNA, 903 bp, Homo sapiens
  misc_feature: GYAE6OF02HMZZE.17.33.C11.1.454.CMB.1.raw
  modified_base (243)..(243): a, c, t, g, unknown or other
  misc_feature (243)..(243): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtcccaggacgggacagtcactctcactgtcgcttaccaacactggacgcagtcaccagtncttactactaccaaacttcgttaccagacaacgaaaccgtaggaacaacgccaacccgacgggacaaccttactaagttttaataacgtaaaccaaaaaccaaaacctaaacctaccttaccgtaccggtaccccctacggtacccgtaacttccgtaccgacggtcccgttcccgttacccgggttacggggggaacctaaaacggtccgttacccggtacccgtacggtaccgtaacgtttcggttccgttacggggttacggttcggtaccgtaaccgggtcccggtaagggtaaaccggggaacccgggtaacgggtacccggttaaggtaaccgtttaaacctttaaccggttaccgggttaaccctttaaacgggttttaccgttttaaaccgggtttttcggggtacggttccggtacggttacggtcggtttacgtttaccggggtttaccggggaccggggtaaccggggtaacccgtaaacgggtccgttaaccggttaacccggttacgtttaaccggtaccgaaacccgggttaccgggaacccgggtttacccgtccccggttaacccccggtttacggaccctttaccccggttaccgtttaccccggtttaaccccccttacccccgttaccccgtttaacccgg

SEQ ID NO: 134084 - DNA, 594 bp, Homo sapiens
  misc_feature: GYAE6OF02HJICU.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctcggacccctgcccgattctcacggctccctccgttggggcaaagctcgccctgactactcgtctggtgtgcagcctgaggacgaggctagactattactcgcctactctacgtttggtggttgtctgtcgtcttagttcgggacgggtacgggaaccaagccgtacgacccgttacgtttaacggtccgaaccgacccgaaacggtcccgtaccggtccccccgttacgggtccctaacccgttccgttccggttacccccctaccccccg

SEQ ID NO: 134085 - DNA, 561 bp, Homo sapiens
  misc_feature: GYAE6OF02H3ALR.17.33.C11.1.454.CMB.1.raw
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttccaacactggagcagtcacagtgcttatactccaaactggttccagcaagaacctggacaagcaccgaggcactctatttatagtacaaacaacaaacactcctacggaccctgcctattctcgacgtcctcccgtcgtggggacaagctcgcctnactctgtctggtgtgcngctgagcgngctgactattactcgtactctcttacgttggtcgtcgtcgtgtcgtcttacgtcgggcgggacggacctagtcgtcgtaccgttacgttaacgtcgaccggaccgtaacggtccgtacccgtccccgtgtaccctcctaccgttcccgttacccctaccccg

SEQ ID NO: 134086 - DNA, 686 bp, Homo sapiens
  misc_feature: GYAE6OF02H5FBM.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggaggacacgtcactctcacctgtcgcttaccaacactggagcagtcacagtgcttactactccaaactgtccagacaacgaacctaggacaacgccaccgaacggcacgtactacttataacgtaacaaacaacaaacactccacggaccctacgacccgtatactcgacggtccttcccgtcggttcggggacaaacgtcgtcgtaccctagaccacgttcggtcgtagggttcgaggtaccgtacggtccgtagggaaccgggaacggtaaggtccgttaacgaacgtttaacgttaaccgtccgttacccgttaacgttccgtttacgtttgggtacggttcgttacgttgttcgtcgttacgttccgggagggtaaccgggaaccaacggtccgtacgtaccggttacgtttaaccggcgtacccggtaccgaacggtccctacccggccccgttacggtcctaacctccggtttacccgtcccctccccg

SEQ ID NO: 134087 - DNA, 706 bp, Homo sapiens
  misc_feature: GYAE6OF02IY6GG.17.33.C11.1.454.CMB.1.raw
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacactggagcagtcaccagtgcttactactaccaaactggttccagcaagaacctggacaagcaccaggcactcatttanacgtaacaaacaacaaacactcctacggacccncgtacccgtattcctacgaacggtcctcccgtccgttacggggacaaacgtctcgtacccgtagacctacgtcgtcgttggtcgtcgaccaacggtccgtacggaacgggacggtacggacgtacgtaaccgttaacttaccgtacgtacccttacttaccgttacggttttcgggtacggttcggtcgttacggttcgttaccgttacggtttaccggggaccggggtaacgggtaaccgtaaacgggtccgtaacggtacccgtttacgtttaaccggtaccgaaccggtacccggtaacggtccgtacccggtacccccgttccgggttaccctaccgttcccgttcccggttacccccgttcccccg

SEQ ID NO: 134088 - DNA, 729 bp, Homo sapiens
  misc_feature: GYAE6OF02JC5CE.17.33.C11.1.454.CMB.1.raw
  modified_base (350)..(350): a, c, t, g, unknown or other
  misc_feature (350)..(350): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtccactctcgacctgtgcttaccaacactcggagcagtcaccagtgcttacataccaaatcggttaccagacaagaaacctggaacaacgcaccgaggcactcattatagtacaaacaacaaacactactcggaccctcgacccgattaccncgagcctcccgtccgttacggggacaaacgccgtcgacctacgactaccgtcgtcgtacggtgtacgcgacgtacgtaggtacgggacggaacgtcgtacgaacttacgttacctagttacccgttaacttaccgtttaacgtttcgggttacgggttcggtacttacgggttccggttacgtttaccggttaccggggtacggggtaaccgggttaacccgaaacgggtccctttaaccgggacccggttttaaaccgtttaacggtaccgtaaaccgggtccccgttaaacgggcccgtttccccggaacccccggttccgtaccgttacccgttcccgtttacccggtacccccttaccccgttaccccgttcccg

SEQ ID NO: 134089 - DNA, 581 bp, Homo sapiens
  misc_feature: GYAE6OF02I4G1A.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccaggcactcatttatagtacaaacaaacaaacactcctacggacccctcgccccgattctcgacggtcctacccgtccgttcgggggcaaacggcctgccctgaccactgtctggtgtgcgacgcctggacggacgaggctagactaatactcgtcctacttcttactttggtgttgcgttgtcgctagtttcgggcggacgggtaccaaggctacgaccgttacgttacgtcgacgtcccgaaggtcctccgcccccgttggtacctccgttcttccgttcccctaccctccctacccg

SEQ ID NO: 134090 - DNA, 769 bp, Homo sapiens
  misc_feature: GYAE6OF02J2HBV.17.33.C11.1.454.CMB.1.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (346)..(346): a, c, t, g, unknown or other
  misc_feature (346)..(346): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactcgactgtcgtccccaggagggacagtcactctcacctgtgccttccaacnctggancagtccaccagtcgcttactactacccaaacttcggttaccaggccaacgaaacccgtggaacaacgccacccgaggtccaactctattaagtaacgtaacaaaacaacaaacncgtccctacggaacccctcgacccgttattcctcgacggtcccttaccccgtacgggttacgggggacctaaaaggtccgttaccggacccgtacggtaacctaccgtttcggttaccgggttacggtttcgggccgtaccgtaccggtacccgtacggggaacgggtaaaccggtacgggtccgtaacgttaaccgttaacttaccgttaccgttaccccttaacgttttcccgttaacgtttttcgggtacgggttcgtaccgttggttaccggtacgtttaccggttccggggacggtaccgggaccgtaaggtccgttcggtaccgttacgttaacgtccgtaccgtaccggtaacgtcccgttcccgtacccgttccggttacctacccgttcccgttccccgttccccggttacccc

SEQ ID NO: 134091 - DNA, 572 bp, Homo sapiens
  misc_feature: GYAE6OF02HL2T7.17.33.C11.1.454.CMB.1.raw
  modified_base (229)..(229): a, c, t, g, unknown or other
  misc_feature (229)..(229): n is a, c, g, or t
  modified_base (392)..(392): a, c, t, g, unknown or other
  misc_feature (392)..(392): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagcacccaggcactcatttatagtaacaaacaacaaacactcctcggacccctgcccgattctcacggtcctccctcgttcgggggacaaagctcgccctgacactgtctggtntgcagccgtgaggacgaggctgactattctcgtcctctcttacgtttggtggtgtcgtgtcgtcttagttcggacgggacgggaccgaagcgtcgaccgttacgttaacgtcgaccgacccgaacggtccgtccggtcccccgtcggtcctacccgttccgttccgttccccctaccccg

SEQ ID NO: 134092 - DNA, 706 bp, Homo sapiens
  misc_feature: GYAE6OF02H4PJM.17.33.C11.1.454.CMB.1.raw
tcagcgtagactagcacgaccggtgctcgatttagagtgagctcgttgggttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactataccaaactcggttccagcaagaaaccgtggacaagccaccgagggcactcatttatagtaaccaaacaaacaaacacctaccgtacggacccctcgacccgtaattcctacacggtccctcccgtccggttacgggggacaaacggtcgtcgccctacgacacgtcgtcgttaggtcgtgcacggccgtaggacggacggacggcgtacggtaccttacttaccgttcgttacccttaccttaccgtttacggttttcggggtcggtcgttcgttcgggtttacgcgtttaagggtccgggtacggggaaccgggaaccgtaaacggtcgtacggtacccggttactttaaccggtaccgtaaccgggtccctaaaccggggtcccgttaccccggtcccccgttcgggttacccctaaccgttcccgtttaccccggtttacccccttaccccccg

SEQ ID NO: 134093 - DNA, 613 bp, Homo sapiens
  misc_feature: GYAE6OF02F4CY1.17.33.C11.1.454.CMB.1.raw
  modified_base (389)..(389): a, c, t, g, unknown or other
  misc_feature (389)..(389): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggtccagcagaacctggacaagcaccagggcactcattatagtacaaacaacaaacactcctcggaccctgcccgattcgtacacggcctccctccgttgggggcaaacgctcgcctagaccactgtcgtggtntgcacgccgtaggagacgaggcgtagacttacttactcgtaccttacttaccttacgtttcgggtggttacgcgttggtgtacttacggttcgggcgggaacgggtacccaaaggtccgtgaccgttacttacgtccgacgtcccgaacgggtcctacccggtccccgttccggttccaccgtttaccgttacccgtttccccctacccccttccttaccccgg

SEQ ID NO: 134094 - DNA, 584 bp, Homo sapiens
  misc_feature: GYAE6OF02G45BU.17.33.C11.1.454.CMB.1.raw
  modified_base (227)..(227): a, c, t, g, unknown or other
  misc_feature (227)..(227): n is a, c, g, or t
  modified_base (551)..(551): a, c, t, g, unknown or other
  misc_feature (551)..(551): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactataccaaactggttccagcagaaacctggacaagcacccagggcactcattatagtacaaacaacaaacactcctggacccctcgcccgattcctcaggtcctccctccgttgggggacaaacgctcgccctgaccactgtctggtgtgcacgcctggacggacggaggctgtactatactcgccttacttcttacgtttggtggtgtcgttgtcgtcgttgttcgggcgggtacgggaccgaacgcgttcgaccgttacttacgtccgacgtcccgtaaggtcctccgacccccgttcggtaccnccgttcctccgttcccctacccctccgttcccg

SEQ ID NO: 134095 - DNA, 634 bp, Homo sapiens
  misc_feature: GYAE6OF02F6L5M.17.33.C11.1.454.CMB.1.raw
  modified_base (227)..(227): a, c, t, g, unknown or other
  misc_feature (227)..(227): n is a, c, g, or t
  modified_base (338)..(338): a, c, t, g, unknown or other
  misc_feature (338)..(338): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtccaccagtgcttactactaccaaactggttccagcagaaacctgacaagcacccagggcactcatttatagtacaaacaacaaacactcctcgaccctgcccattcncagctccctccgtggggacaacgctcgcctgacactgtctggtgtcgcacgcctgacggacgaggctagacttattactcgccttactcttacgtttacgggtggtcgtcgttgtcgacgttagttccgggacgggtacgggtaaccaacggtcgttacgtacccgtttacgttaacggttccgtaccggtaccccgaacgggtcccgttacccggtccccccgttacgggtaccctacccggttcccgttaccccggtttacccccctacccccgtttaccccccgttaacccgg

SEQ ID NO: 134096 - DNA, 638 bp, Homo sapiens
  misc_feature: GYAE6OF02JDPIS.17.33.C11.1.454.CMB.1.raw
  modified_base (224)..(224): a, c, t, g, unknown or other
  misc_feature (224)..(224): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacnctggagcagtccaccagtcgcttactactaccaaactggttccagcaagaacctggacaagcaccaggcactcatttatagtacaaacaacaaacactcctcgacccctgcccgattctcacggcctccctcgttcggggacaaacgcgtacgcccgtagaccactgtcgtggtcgtgcacggcctggagggacggaggcgtagtacctacttacgtcgtccttaccgttccgttacgttttcgggtacggttgtcgttgttacgtccgtttacggtttccgggggaccgggtaacgggtacccgaaaggtccgtaccggtaccgttacgttaacggtccgaccggacccgtaacggtccttacccggtccccgttcggtccctaccgttccgttccgttaccccctacccccg

SEQ ID NO: 134097 - DNA, 561 bp, Homo sapiens
  misc_feature: GYAE6OF02F8WD7.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaaacaaacactcctcggacccctgccccgattcctcacggcctccctccgttcgggggacaaagctcgccctgaccactgtcgtggtcgtgcacgcctggaggacgaggctagactattactgccttactcttacgtttggtgtgctgtgtcttagttcggcggacggacagctcggtaccgttcgttaacgtcacgcctaaggtcctaccggtcccctcggttaccacctccgttaccgtccccgtccccg

SEQ ID NO: 134098 - DNA, 668 bp, Homo sapiens
  misc_feature: GYAE6OF02IEZFK.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgccaggtccaattctcagactgtggtgactcgaggtacgccctcactgactcgtactcccgaggaggacagtcactctcactgtgcttaccaactacgtggagcagtccaccagtgacttactactacctaacgtcggttaccagacaacgaacgtgaacaacgcacccgagggacacgtatagtttacagtaacaaactaaccaaacacgtaccgtaccggaccctaccgaccgttacttcctacgaaccggccttacccgttacgggttcggggaacctaaacgtcgttccgccgtaggtactaccgtcggttcgtggttacggacgcgacgcgtggacggtacggaacgtcacgttaacgtattaacgtcgtaccttacgttacgttacgtttgggtacgtcgtacgtcgtccgtagttacgccgggtagggaccgtaacgaacgtcgtacgtaccgtagttaccgacgtaccgaccgtacgtacccgtccggacccgttcgtaccgtaccgtccgttccgtaccccgttccccg

SEQ ID NO: 134099 - DNA, 730 bp, Homo sapiens
  misc_feature: GYAE6OF02G82OM.17.33.C11.1.454.CMB.1.raw
  modified_base (228)..(228): a, c, t, g, unknown or other
  misc_feature (228)..(228): n is a, c, g, or t
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
tcagcgtagactagcacgaccggtgctcgatttagagtgagctcggttgggttgggggcgccaggggtccttccaatatcagcaccatggcctggactcctctctttctcgttcctcctcacttgctgcccagggtccaattctcagactgtggtgactcaggagccctcactgactgtcgtccccaggagggacagtcactctcacctgtgcttccaacactaggancagtcaccagtcgcttactataccaaactggttccagcagaacctggacaagcaccaggcactcattanagtacaaacaacaacactcctacgaccctgacctacttcncacgcctaccgtccgtacggggactaacgccgtcgccgtacgactacgtcggtcgtcgggtcgtacgacgtacggtccgtagggacggacggtacgggtctagtacgttaacgttacctacgtacccttaacgtaccgtttacggtttcgggttcgggtttcgtaccggttcggttcggtaccgttacgggtttaccgggggacgggtaaccggggtaaccgtaacgggtacccggttaccggtacccggtttacggttaaccggtaccgtaaccgggtaccccggtaaaccgggttcccggttaccccggttcccccggttaccggtacccgttacccgttccccgtttaccccggtttccccccggttaccccgttccccgtttaaccccg

SEQ ID NO: 134100 - DNA, 570 bp, Homo sapiens
  misc_feature: GYAE6OF02HAC6P.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggaacaagcacccagggcactctattatagtaacaaacaacaaacactacctcggacccctcgacccgattcctcaacggtcctccctccgttggggacaaagtctcgccctgaaccactgtcgtggtgtcgcgacgctgacggacgaggctagactattactcgtcctactcttacttggtgtgctgtgtctgttcggcggtacggacaagtcgtgtaccgttacgtaacgtcgaacgaccgaacggccgtccgcccccgttcggtacctaccgtcgttccgttcccctaccccg

SEQ ID NO: 134101 - DNA, 639 bp, Homo sapiens
  misc_feature: GYAE6OF02H9TT3.17.33.C11.1.454.CMB.1.raw
  modified_base (396)..(396): a, c, t, g, unknown or other
  misc_feature (396)..(396): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcacctttctctggcttctcactcagaacgagtggaatgggagtgggctggactccgtcacgaccccgaggaacggccctggagtggcttgcgctctatttagtggatgagtagtaagcactacacgtaccgtctcgtagaagacgacggctacaccatccaacgaacggaccacctaccacaaaccgaggtcgtacctanatacgaacaagtactacggacctgtacggacacgacgccaatacttactttaccgttagttaccactctacgttaggttggggttacgggttatttacgttaccgttaccctttaacgtttcgaaccgttacgttacgggggtaccacgggtaccttacggttccggttaccgtaccgttcccgtccgactaccggtaccctacccggaaacccggtaccgggtaccccgtacgttccccggg

SEQ ID NO: 134102 - DNA, 590 bp, Homo sapiens
  misc_feature: GYAE6OF02G1LY1.17.33.C11.1.454.CMB.1.raw
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactccaaactggttccagcaagaaacctggacaagcacccaggcactcattatagtacaaacaacaaacactccncgaccctgccgattcncacgctccctcgttggggcaaagctcgcctgacactgtctggtgcgcgagcctggaggacgaggctgactattactcgtcctactcttactttgggtgtgtcgttgtcgtcgttacggttcgggccgggtaacgggacctaaggtccgtacggtacccgttcttaacggtccgtaacggacccggtaaggtcccgtcccggtacccccgttcgggtccctacccgttccggttcccgttcccccgtcccccg

SEQ ID NO: 134103 - DNA, 643 bp, Homo sapiens
  misc_feature: GYAE6OF02FMEHM.17.33.C11.1.454.CMB.1.raw
  modified_base (228)..(228): a, c, t, g, unknown or other
  misc_feature (228)..(228): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagcacccagggcactcatttatagtacaaacaacaaacactcctggacccctgcccgattctcaggcctcccgtccgttcgggggacaaacgctcgccctgacctacgtgtctggtgtgcagcctgaggacgaggctgactattactcgccttactcttacgtttgggtcggttcgtcttggtcgtacgttacgttccggggcgggacggggtaaccctaaggtccgttacggtacccggttacgtttaacggtccgtaaccgggtaccccgaagggtcccttacccgggtccccccgtttaccgggttaccctaccgtttcccgttacccgtttcccccctacccccgttccccgtttaaccccg

SEQ ID NO: 134104 - DNA, 679 bp, Homo sapiens
  misc_feature: GYAE6OF02GQO0F.17.33.C11.1.454.CMB.1.raw
  modified_base (303)..(303): a, c, t, g, unknown or other
  misc_feature (303)..(303): n is a, c, g, or t
  modified_base (431)..(431): a, c, t, g, unknown or other
  misc_feature (431)..(431): n is a, c, g, or t
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcacagtgcttactatccaaactcggttccagctaagaaacctggaacaagccacccgagggccacctntatttataacgtaacaaacaaaccaaacacctaccgtaccggaacccctgccccgtacttctaccgacggtcctcccgttccggttgggggaacctaaagctcgccctagacctacgtcgtctgggtntacgcgacgtccgtaggaacggacggacggtcgtaacgtacttacttaccgcgtacccttaacgttacgttacgtttggttaggtcgttcgttgttcgtacgtttcggtaccgggtacggtaacgggacctaacggcgttacgtacccgtttaaggtacggtacgtaaccggacccgtaacgggtcccgtacccggtccccgtaccggttacccgtacccttccgtttaccccggttcccctcccccg

SEQ ID NO: 134105 - DNA, 709 bp, Homo sapiens
  misc_feature: GYAE6OF02IXJUH.17.33.C11.1.454.CMB.1.raw
  modified_base (176)..(176): a, c, t, g, unknown or other
  misc_feature (176)..(176): n is a, c, g, or t
  modified_base (203)..(203): a, c, t, g, unknown or other
  misc_feature (203)..(203): n is a, c, g, or t
  modified_base (499)..(499): a, c, t, g, unknown or other
  misc_feature (499)..(499): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcacttngtgtccacgagggacgatctactctcncctcgtgtcgtctaccaactggtgacagtacgtaccacgtagtcttacttactacctaacctaagttccgtacgacacgaaaccgtacgtacgaacgacaccccgacggacgactactacttaattagtaacaaaacaaaccaaaaccaactacctaccggtacccgtaccgtcccgtacttcctaccacggtccgtcccgtttcccggttcggggtacgaaacgcgttcgcccgtccgactacctcgttcgttcggtcggttgccgagtccggacggtagggacggacgtcggtntaaacgttagttaccgtacgcccttacctttacgtttcgtttagggtttcgggtacgtccttgttcgttccgttagggttcgggtaccggacggggtaacctaacgtacgtcgtacccgttacgttactaccgtcgaccgtaaccggacgtcccgtcccgcccggttacgaccttcgttcccgtccccgtcccgttcccaccggttaccg

SEQ ID NO: 134106 - DNA, 729 bp, Homo sapiens
  misc_feature: GYAE6OF02F0BMN.17.33.C11.1.454.CMB.1.raw
  modified_base (629)..(629): a, c, t, g, unknown or other
  misc_feature (629)..(629): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcaccgtgtcgtccttaccaacacgtggacgacacgtaccaccgtaggtcgtaccttaactaactaaccctaaaccgttcggtaccaacgacaacgtaaaaccgtcggaaaccaacgacccaacccggacgggacctactctaatttaataacgtaaaccaaaaccaaaccaaaacctaccctaccgtacccggtacccctccggtaccccgtaacttacctacgaccggtccccttacccggttcgggttacgggggaacaaacggtcctacgtcccgtacgactacgtcgttcgtcggttgcgaccgacggtacctgggaacggacggacggtcgtacgtacgttacttacgccgtaccttactttcgttacgttggtgtcgtcttgtcgtagttacggtcgggacgggtacggaacgacgtntacggttaccgttacgtacgtccgacgtaccgacggtaccctccccggtcccgttacgtacctccgttcccgtacccgttcccctaccctccgttacccg

SEQ ID NO: 134107 - DNA, 645 bp, Homo sapiens
  misc_feature: GYAE6OF02GQSSR.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactcggttccagcacgaaacctggaacaagcacccgagggacactctaatttatagtaacaaaacaacaaacactcctacggacccctcgcccgattctcacggcctccctccgttcggggacaaacgcctacgcccgtagacctactcgtcgtggtgtacgcacgtccgtggacggacggaggtctagtacttattacgtcgtaccttaccttcttacgtttgggtcggttgcgttgtgtcgttacgtccggggacgggtacgggacctaaaggtcgtacggacccgttacgttacgtcgaccggtcccgtaacggtccgtacccggtcccccgtacggttacctacccgtttcccgttacccgttcccccttacccccgttccgttacccg

SEQ ID NO: 134108 - DNA, 631 bp, Homo sapiens
  misc_feature: GYAE6OF02JPMKA.17.33.C11.1.454.CMB.1.raw
  modified_base (222)..(222): a, c, t, g, unknown or other
  misc_feature (222)..(222): n is a, c, g, or t
  modified_base (472)..(472): a, c, t, g, unknown or other
  misc_feature (472)..(472): n is a, c, g, or t
tcagcgtagactagcacgaccggtgctcgatttagagtgagctcgttgggtttggggggtcggccgaggggtcccgttccaactatcagcaccatggcctggactcctctctttctgttcctctcacttgctgcccagggtccaattctcagactgtggtgactcaggagccctcactgactgtcgtacccccgaggagggacaggtcactctcaccgtgtntcttaccaacactggagccagtccaccagtcgcttactctaccaaactggttaccagcagaacctaggaccaagccaccgaggcacgtcattacagtaacaaactaacaaacactcccgtcgaacccctcgaccgaacttcctcgtacgcctaccctccgtcgggggtacaaagccgtacgccctagacctacgtacgtcggtcgtaggtcgcacgtccgtagtacggacgaggctacgactacgttacncgtcctactacgttcgtaggtcgtcgcgttagtcgtactcggtcgggtacggtacgggacctaagggtctacgtaccgttccgttaacgctaccgcccggtaagccctaccgtcccggttactccgtaccttcgtcctcccgtacccttcccgttaccg

SEQ ID NO: 134109 - DNA, 632 bp, Homo sapiens
  misc_feature: GYAE6OF02GFV4R.17.33.C11.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (340)..(340): a, c, t, g, unknown or other
  misc_feature (340)..(340): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (527)..(527): a, c, t, g, unknown or other
  misc_feature (527)..(527): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtncttccaacactggancagtcaccagtgcttactatccaaactggttccagcagaaacctggacaagcaccaggccactcatttatagtacaaaacaacaaacacctcctacgacccctgcccgtattcncgagcctccctcgttgggggacaaagctcgcctagaccacgtcgtcgtaggtgtgacacgtccgtgacgggtacgaggctgattacgttactcgtccttacgtctttacgtttggtaggtcgtntggttntacgttaggtccggagggtacgggaaccgagtcgtaccgtaccgttacggtttaccncgtaaccggtccgtaacggtcccgtacccggtccccccgttaccggtacctacccggtttacccgttcccggtttaccccccgtccccgttcccgttaaccccgg

SEQ ID NO: 134110 - DNA, 528 bp, Homo sapiens
  misc_feature: GYAE6OF02GHB4L.17.33.C11.1.454.CMB.1.raw
  modified_base (452)..(452): a, c, t, g, unknown or other
  misc_feature (452)..(452): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctaactttggtggtgctgtgctattcggnggagggaccaaagctgaccgtcttaagtcagcccaaaggcctcgaccccctcgggtccactctcgttccccacccc

SEQ ID NO: 134111 - DNA, 640 bp, Homo sapiens
  misc_feature: GYAE6OF02H2X8H.17.33.C11.1.454.CMB.1.raw
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacactggagcagtcaccagtcgcttactactaccaaacgtggttccagcacgaaacctggacagcaccaggcactcattatagtaacaaacaacaaacacctcctacggacccctcgacccgtacttccgtacacggcctcccgtccggttagggggacaaacgctcgcccgtagacctacgttgtacgtggtacgtcgcgtacgccgtggacgggacggacggcgtagtactattaccgtcgccttactcttacgtttgggtcgtgtcgttgtcgtacgttagttcggggcggtacgggaccaagtcgtacggtaccgttagttacgtacgtaccggacccgtaacggtccgtccggtcccccgttcgggtacctaccgttccgttcccggtttaccccctaccccgttcccttacccg

SEQ ID NO: 134112 - DNA, 551 bp, Homo sapiens
  misc_feature: GYAE6OF02GOFHN.17.33.C11.1.454.CMB.1.raw
  modified_base (296)..(296): a, c, t, g, unknown or other
  misc_feature (296)..(296): n is a, c, g, or t
  modified_base (338)..(338): a, c, t, g, unknown or other
  misc_feature (338)..(338): n is a, c, g, or t
  modified_base (383)..(383): a, c, t, g, unknown or other
  misc_feature (383)..(383): n is a, c, g, or t
  modified_base (398)..(398): a, c, t, g, unknown or other
  misc_feature (398)..(398): n is a, c, g, or t
  modified_base (439)..(439): a, c, t, g, unknown or other
  misc_feature (439)..(439): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcaccaggcactcattanagtacaaacaacaaacactcctaggacccctgacccgattcncagcctcctcgttggggacaagctcgcctgacactcgtctggtgngcagcctgaggacgnggctgactacttacgtcgccttactcttacgtttggtggtncttgtgtactgttcgggcgagggacaagtcgtacgaccgttagtacgtcgaccgacccgaaggcccttacgccccgtcggtacctacgttccgttcccggttcccctccccc

SEQ ID NO: 134113 - DNA, 578 bp, Homo sapiens
  misc_feature: GYAE6OF02GOEIX.17.33.C11.1.454.CMB.1.raw
  modified_base (342)..(342): a, c, t, g, unknown or other
  misc_feature (342)..(342): n is a, c, g, or t
tcagcgtagactagcacgaccggtgctcgatttagagtgagctcgttgggtttggggctgggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggagcagtcaccagtgcttactatccaaactggttcagcagaaacctggaacaagcacccaggcactcatttatagtaacaaacaacaaacactcctacgaccctgcccgattcncacgctccctccgttcggggacaaagctcgccctgaccactcgtctggtgtcgcagcctgacgggtacgagctgactattactcgccttactcttacgtttggtggtgtcgtgtgtcttgttccggcggacgggaccaaggctcggtaccgttacgttaacggtcgacgtacccgaacggtccgtcccgtacccccgtccggttacctaccgttccgttaccgtccccgttccccc

SEQ ID NO: 134114 - DNA, 712 bp, Homo sapiens
  misc_feature: GYAE6OF02IUJQP.17.33.C11.1.454.CMB.1.raw
  modified_base (234)..(234): a, c, t, g, unknown or other
  misc_feature (234)..(234): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgttcccaggagggacagtccactctcacctgtgccttccaacacgtggacncagtccaccagtcgcttactactaccaaactggttccagcaacgaaacctggaacaacgccacccgagggaccactactaatttataacgtaacaaaacaaaccaaacacctaccgtaccggaccccgtcgaccccgtattccgtacgacgtacctcccttcccgggttacgggggaccaaacggtccgtccgtacccgtacgaaccgtaccgttacggtcgttcgggttgtcgcgacgtccgtacggacgggacggacggtacgtacgtaacgttacttaacgtccgtacccttaaccttccgtttaggtttcggtaggttcgtccgttagtcgttaccgtcggttcggggaccgtaacgggaaccacgggtacgtaccggtacccgttacgtacggtaccgaccggtacccggaagtcccgtaccccggtccccgttcggacccgtacgtcccgttcccgttaccccttacccccg

SEQ ID NO: 134115 - DNA, 902 bp, Homo sapiens
  misc_feature: GYAE6OF02IDCEU.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcgaggacgccctcactgactgtcgtccccgaggaggacagtcactctcactgtcgcttccaacactggagcagtcaccgagtgaccttactactaccaaacgttcggttaccagtacaaacggaaaccgtggaaccaacgaccgaaccccgagggacctaacgttctaatttttaacgtaaacgttaaaccaaaaaacctaaaccaaaactacccgttacccgtaaccgggtaccccctacggaccccgttaagtttccgccgaacgtccttaccccgttcgggttaacgggggaacctaaaggccttacgggccctacggaccttaaccgtcgggttcgttacggggtagtccggtaccgacgtacccgggttacgggaaccgggtaacgggtacgggttacgtaccggttaaacgtttacgtttaaccgtccggttaccctttaacgttttacccgttttaagggttttaaccggggttcgggtttaaccgggtccgttacgggttaccgggtaccgttttaaccggggtacccgggggttaccggggtaaaccggggtaaaccgtaccgggtccgtaaccgggttaaccgtttaccgtttaacggtacccggtaacccggttaaccccgggtaaacggtccccgtaccccgggttaccccccgggttaccggttacccgtaccgtttcccccggttacccggtttccccccggttcccccgtttccgtttaacccccgg

SEQ ID NO: 134116 - DNA, 585 bp, Homo sapiens
  misc_feature: GYAE6OF02GFR1P.17.33.C11.1.454.CMB.1.raw
  modified_base (338)..(338): a, c, t, g, unknown or other
  misc_feature (338)..(338): n is a, c, g, or t
  modified_base (396)..(396): a, c, t, g, unknown or other
  misc_feature (396)..(396): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattcncaggcctccctcgttcgggggcaaagctcgccctgacactgtctggtgtgcagcctgnggacgaggctgacgtacttacgtgccttactcttacgtttcgggtgtgcgtgttgcttagttccgggcgggacggaccgaagcgtcgtaccgtacgttagtcctagacccgaaggtccgtccgtaccccccgttcggtaccctaccgttacccgttccggttacccccgtccccttccccgttaccccg

SEQ ID NO: 134117 - DNA, 585 bp, Homo sapiens
  misc_feature: GYAE6OF02FRPQI.17.33.C11.1.454.CMB.1.raw
  modified_base (396)..(396): a, c, t, g, unknown or other
  misc_feature (396)..(396): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatacaaactggttccagcaagaaacctggacaagcacccaggcactcattatagtaacaaacaacaaacactcctcggacccctgcccgattctcaggtcctcccgtcgttcggggacaaagctcgcctgacactgtcgtggtcgtgcncgctgacggacgaggctgtactacttacgtcgccttactcttacgtttggtggtcgtcgtgtcgtacgttagttcgggacgggacggtaaccgaacgtcgtacgaccgttacgttaacgtcgacggtacccgaacggtccgtccggtccccgttccgggtcctaccgtccgttccgttccccgtccccg

SEQ ID NO: 134118 - DNA, 617 bp, Homo sapiens
  misc_feature: GYAE6OF02GYR38.17.33.C11.1.454.CMB.1.raw
  modified_base (347)..(347): a, c, t, g, unknown or other
  misc_feature (347)..(347): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgcgcttccaacactggagcagtcaccagtgcttactactaccaaactggttccagcaagaaacctggacaagccacccgagggccactctatttatagtaacaaacaacaaacactcctacgaccctcgccgattcncacgcctccctcgtggggacaaacgtctcgccctgacctacgttgtcgttggtcgtcgcgtacgccgtggaagggacggacggtctcgtacttacttaccgtcgtccttacttcttacgtttggtgttgtcgtgttcgtcgttaggttcggcgggtaacggaccgaagtccgtacgtaccgttacgttacgtcgaccggtcccgaacggtcctcccggtccccgtcgtccgtacttccgtccccgttaccccgtcccttaccgttacccg

SEQ ID NO: 134119 - DNA, 527 bp, Homo sapiens
  misc_feature: GYAE6OF02GFYA9.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaatggttccagcagaaacctggacaagcacccagggcactcatttatagtacaaacaacaaacactcctgacccctgcccgattctcagctccctccgttgggggcaaagctgccctgacactgtcctggtgtgcacgcctgaggacgaggcgtgactattactgcctactctactttggtgtcgtctgtgcgtattcggcggagggaccaagcgtgaccgtcttagcagccaagcctcgcccctggtcacttcgtcttccctaccctccttacccg

SEQ ID NO: 134120 - DNA, 652 bp, Homo sapiens
  misc_feature: GYAE6OF02G4EDS.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacacgtggagcagtccacctagtcgtacttaactactacctaaacgttcggttaccagacaacgaaaccgtggaacaacgccaaccgagggcactactaatttataagtaacaaacaaacaaacactaccgtacggaccctcgacccgtattcacgacgtccctcccgttcggtacggggaacaacgtctcgaccctgactacgtgtcgtggtgcgcacgcgtaggacggacgacggtctagtacttacttctcgtacccttacgttcttacgttttggtcggtcgttctaggttcgtacgttacggtcgggtacgggacgggaactaacgtcgtaccggtaccgttagttaacgtccgaaccggtaccgtacggtcccgtcccgtaccccggttcgtaccctacgttcccgttcccgtccccgttcccc

SEQ ID NO: 134121 - DNA, 642 bp, Homo sapiens
  misc_feature: GYAE6OF02FTRPC.17.33.C11.1.454.CMB.1.raw
  modified_base (340)..(340): a, c, t, g, unknown or other
  misc_feature (340)..(340): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactgttccagcagaacctggacaagcacccagggcactcattatagtaacaaacaacaaaccactccacgacccctgcccgtatcncacgcctccctccgttggggacaagctcgccctgactacgtcgtcgtggtgtcgacacgccgtaggacgggacgaggctagaactacttactcgtcccttacttcttacgtttgggtcggtcgtacgttggttcgtacgtttacgttccggggacgggtaaccgggtaaccaacggtcccgttacgggtacccgttacggttaacggtccaaccggtaccccggtaacgggtaccgtcccggtccccccgttccggttaccgtaccgtttcccgtttcccggttaccccccgttaccccccg

SEQ ID NO: 134122 - DNA, 564 bp, Homo sapiens
  misc_feature: GYAE6OF02IRQ6Y.17.33.C11.1.454.CMB.1.raw
  modified_base (303)..(303): a, c, t, g, unknown or other
  misc_feature (303)..(303): n is a, c, g, or t
  modified_base (444)..(444): a, c, t, g, unknown or other
  misc_feature (444)..(444): n is a, c, g, or t
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactatccaaactggttccagcaagaaacctggaacaagcaccagggcactcatttanagtaacaaacaaacaaacactcctggacccctgacccgattctcacggctccctccgtggggcaaagctgcctgacactgtctggtgtgcagcctgacggacgaggctagactattactcgtcctacttcttacgtttggngtgctgtgtctagttcgggcggtagggaccaagcgtacgaccgttacttaacggtcacggacccgaaggtcctaccggtcccccgtcggtccctaccgtccgttccgttccccgtccccg

SEQ ID NO: 134123 - DNA, 667 bp, Homo sapiens
  misc_feature: GYAE6OF02JQ2ZI.17.33.C11.1.454.CMB.1.raw
  modified_base (163)..(163): a, c, t, g, unknown or other
  misc_feature (163)..(163): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (283)..(283): a, c, t, g, unknown or other
  misc_feature (283)..(283): n is a, c, g, or t
  modified_base (334)..(334): a, c, t, g, unknown or other
  misc_feature (334)..(334): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactnacccggagccctcactgactgtgtccccaggagggacagtccactctcacctgtgcttccaanctggagcagtcacngtncttacatcaatcgttcagcagaacctggacaagccaccgnggccacgtcattagtataacaacaacaaccacttccacgaccctcggaccntctcagtcctcctccgtcggggacaaacgtctagtccccagaccacgttcgtctacggtgttcgcacgtctacggacggacggacggtcgtacggtactttaacgtacttacggtcccttagttacccgtttacggtttcggttacgggttcgccgttacggttcgttaccgtttacggttaccgggttacggggaaccggaaaccggacggttaccgttccggtaccgttaaccgttacgtaaccggttaccaccggtaaaccggtccgtacccggtccccgttaccggtaccgttaccgtttccgtttaccccggttccccgttacccccg

SEQ ID NO: 134124 - DNA, 660 bp, Homo sapiens
  misc_feature: GYAE6OF02F4JKL.17.33.C11.1.454.CMB.1.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (369)..(369): a, c, t, g, unknown or other
  misc_feature (369)..(369): n is a, c, g, or t
tcagcgtagactagcacgaccggtgctcgatttagagtgagctcggttggggtttggggctggcgccaggggtcccttccaatatcagcaccatggcctggactcctctctttctgttcctcctcacttgctcgcccagggtccaattctcagactggtggtgactcaggacgccctcactgactgtcgtccccgagggagggacagtccactctccacctgtcgccttccaacactggacgcacgtccaccagtcgccttactactaccaaactcggttccagcaacgaacctggacaagccaccgngcactctattactagtaacaaacaacaaccncctaccgtacggacccctgaccctacttcncgacggtccctcccgtcgtacgggggacaaacgtctcgcctgaccacttggtcgtaggtgtacgcacggtcctagggacggtacggacggtacgtacgtaaccgttaacttacgtcgtacccgtttactaccggtttaacgtttgggtcgggtcgttacggtcggttcgtaccgttacggtcgggacgggacggtaaccgagtaccgtacgttaccgtacgttaacgcgacgaccggtacgtccgtaccgtccccgtcggtacctcgttcccgttaccggtcccctccccg

SEQ ID NO: 134125 - DNA, 592 bp, Homo sapiens
  misc_feature: GYAE6OF02F8L63.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactcatttatagtacaaaacaaacaaacactcctacggacccctcgcccgattctcacggcctccctaccgttgggggacaaagctcgccctgacactgtctggtgtgcagctggaggacgaggctgacttaatactgccttactcttacgtttggtggtgtctgtcgcttagttcggacgggacgggaccaagctcggtaacccgtacgttaacgtcgaacggacccgaaggtcctacccggtcccccgtacggtccctaaccgttccttacccggtttccccgtccccttacccgttaccccg

SEQ ID NO: 134126 - DNA, 660 bp, Homo sapiens
  misc_feature: GYAE6OF02HEDGS.17.33.C11.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (498)..(498): a, c, t, g, unknown or other
  misc_feature (498)..(498): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaaacnctggagctagtcaccagtncttactatccaaactggttccagacaacgaaacctggaacaacgcgacccgagggcactcatttatanaacaaacaacaaacacncctacgacccgtcnccgacttctcgacgcctccctcggttacgggggacaaacgcgtccgaccccgtagaaccgcgtacgttgtcgggttctacggactcggaccgtagaacgggacgtacgggctagactacttacgcgtacctactacttagtttcgggtgtcgtntacgtcgtacgtagttccggggacgggtacgggaaacctaaggtccgtacgtacccgtttagttaaaccggttcaaccgtaacccggtaaccggcgtttaccccggtccccggtaccggtttaccaacccgtttcccgttccgtaacccccccggttccccc

SEQ ID NO: 134127 - DNA, 667 bp, Homo sapiens
  misc_feature: GYAE6OF02HP7W4.17.33.C11.1.454.CMB.1.raw
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
  modified_base (379)..(379): a, c, t, g, unknown or other
  misc_feature (379)..(379): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacatggancagtacaccagtcgcttactactaccaaactcggttccagacaagaacctggacaagcaccaggcactnattatataacaaacaacaacactccacgtacccncaccgattcacgacgcttccctcgtcggggacaaacgctcgcctacgacncgttacgtcgtaggtgtcgcacgtaccgtggaacgggacgaggctacgtaacggttattacgtcgaccttacttacttacgtttggtggttcgtcgttggtacgttacgtacggttaccggggcggtaacgggtaacccgaggacgttacgtaccgtttacgttaacggacgtaaccggaacccggtaaccggtcccgttacccggacccccgtttaccggtacccgttacccggttcccgtttacccggtttaccccccggttacccttacccccgtttaaccccgg

SEQ ID NO: 134128 - DNA, 581 bp, Homo sapiens
  misc_feature: GYAE6OF02FTHA8.17.33.C11.1.454.CMB.1.raw
  modified_base (295)..(295): a, c, t, g, unknown or other
  misc_feature (295)..(295): n is a, c, g, or t
  modified_base (391)..(391): a, c, t, g, unknown or other
  misc_feature (391)..(391): n is a, c, g, or t
tcagcgtagactagcacgaccggtgctcgattagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcacgaacctggaccaagcacccagggcactcattanagtacaacaacaacactcctgaccctgcccgactctcacggctcccgtccttcgggggcaaacgctgccctgacactgtctggtcgtcgcacgccnggtacggacgaggtctgtaccttattactgccttactccttacgttcgtggtcgtcgtgtcgcttagttcggacggtacggaacgaacgtcgtacgacccgttcttacgtcacggccccgtaaggccttcggccccccgtacgggtcctaccgttccgtacggttcccccggtccccttcccgttacccg

SEQ ID NO: 134129 - DNA, 791 bp, Homo sapiens
  misc_feature: GYAE6OF02I2CKI.17.33.C11.1.454.CMB.1.raw
  modified_base (212)..(212): a, c, t, g, unknown or other
  misc_feature (212)..(212): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgngtcttccaacactggagcagtcaccgagtcgtacttaactataccaaacgtcggttaccagtacaacgaaaccgtaggacaagccaccccgagggcaccttcgtaatttaacgtaacgtaaacaaaaccaaaccaaaccacctacctacggaacccctcgacccgtacttcctcgtacggccttccgtttacgttacgggggacctaaacggtctacggtccctacgtaaccgacgtttcgtcgttacgggtcgtacgaccgacgtaccgtaggtaacggtacggtacggtacgtacgtaacgttaattccgtacgtacccttactttacgtttaccggtttaggttacgggtgtaccgtttcggttcgtacgttaacggttcccggggtacggggtaaccgggtaaccgttaacggtaccgtttaaccgggtaccgtttaccggttaacggtcccggtaaacggtaccccggtaaacgggtcccgttacccgggtccccccgtttacgggtacccttaacccggtttcccgttcccccggtttaccccccgttcccccgttccccggttttaccccgg

SEQ ID NO: 134130 - DNA, 644 bp, Homo sapiens
  misc_feature: GYAE6OF02H9VZ3.17.33.C11.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtcccaggagggacngtcactctcacctgtgcttccaacactggagcagtccaccagtgcttactactccaacgtggttccagcagtaaacctggacagccaccnggcactcattatagtaacaacaacaactactccgtacggaccctcacccgattcacgacggcctaccctcggttcggggacaaagctacgcctacgactacgtcgtacgtcggtgtcgtacgacgtccgtggacgggacggacggtcgtacggtaacctattaccgttacggtaccttccttacgttacggttttcgggtggtgtactggttacggtcttacggtcgggcggtacgggaccgtagccgttaggaccgtttacgttaacgtccaacgtaaccccgacggttcccgtacccggttcccccggttcggtaacctcccgtttacgtttaccccggttaccccttacccccg

SEQ ID NO: 134131 - DNA, 543 bp, Homo sapiens
  misc_feature: GYAE6OF02ILSEM.17.33.C11.1.454.CMB.1.raw
  modified_base (167)..(167): a, c, t, g, unknown or other
  misc_feature (167)..(167): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
  modified_base (491)..(491): a, c, t, g, unknown or other
  misc_feature (491)..(491): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggngccctcactgactgtgtccccaggagggacagtcactctcacctgtgcttccaacactggagcagtcaccagtgcttactatccaaactgttccagcagaacctggacaagcacccagggcactcatttatagtacaaacaacaaacactcctacggacccctgcccgattctccaggcctccctcgttcggggcaaagctgccctgacactgtctggtgtgcagcctgaggacgagctgactagttacngtcctactcttactttggngtgctgtgtctnttcggcgacgggacaacggctacgaccgttacgtaagtcgacncccgaaggcctccggccccgtcggtccacctcgttccgtacccctacccccg

SEQ ID NO: 134132 - DNA, 726 bp, Homo sapiens
  misc_feature: GYAE6OF02HZQC3.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcacctgactgtcgtccccaggaggacagtcactctcacctgtcgtcttaccaacaccgtggagcagtcacccgagtgtaccttactactaccaaacgttcggttccagcaacgaacctggacacgcacccaggcactcattatagtaacaactaacaaacactacctacggtacccctcgaccctagttcctaccgacgcctcccgttcccggttacggggaccaaacgcgtacgccctacgtaccacgttagtccgtggtgtcgaccgtacgtccgtaggacgggacgcggctacgtacttactacgtcgtaccttacttcgttacgtttggtacggttgtccgttggtccgttacgttacgggttaccgggccgggtaacgggtaccgtaacgggtcgtaccggtaacccgtttaccgttaacggttccgtacccggtaaccccgaaccgggttcccggtaccccggtaccccccggttaccggttacccgtacccggtttacccgttacccccggtttaccccctaccccccgttaccccggtttaacccccg

SEQ ID NO: 134133 - DNA, 595 bp, Homo sapiens
  misc_feature: GYAE6OF02G5TYC.17.33.C11.1.454.CMB.1.raw
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacacgtggacgcagtcaccagtcgcttacactccaaactcggttccagcaacgaaacctggacaagccaccgaggcactcatttanagtaacaaacaacaaacactcctacggaccctcgcccgtattcncacggtcctccctcgttcggggacaaacgctacgcctgacacttcgtctggttcgtcgcacgtcgtaggaggacggaggtcgtgaacttatacgtcgtaccctactcgttacgtttggtacggtcgtcgtgtgtcttaggttcggacggtacggaccgacgtcgtcgtaccgttagttacggtcgacgacccgtagtccgtaccgtccccgtcggtcctaccgttcgttcccgtcccctacccg

SEQ ID NO: 134134 - DNA, 716 bp, Homo sapiens
  misc_feature: GYAE6OF02G6F7D.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtccaccgatcgcttactaactacctaaaacgttcggttaccagaccaagaaaaccctggaacaagccacccgagggcactctattatagtaacaaaaccaacaaaccactacccgtcggacccctcgacccgtattcctcgacggtcctccccgttccggttcgggggactaaacgcctcggcccttacgaccacgttgtcgtagggtcgtcgcgacggccgtaggaacggacggacggtcgtaagtaccttaacttaccgtcggtacccttaaccttccgtttacggttttgggtcggttcggtcgttcggtacgttcgttacggtttccggggacggggtaaccgggtaaccgtaacggtccttaccggggttaaccgttgttaaccgtcgtaacccggacccgtaccggtcctacccggtcccccgttacggtaccttcccggttacctttcccggtaaccccctcccgttcccgttacccg

SEQ ID NO: 134135 - DNA, 683 bp, Homo sapiens
  misc_feature: GYAE6OF02GZQDL.17.33.C11.1.454.CMB.1.raw
  modified_base (309)..(309): a, c, t, g, unknown or other
  misc_feature (309)..(309): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgcttaccaacacgtggagcagtcaccagtgtcttactactaccaaactcggttccagacaagaaacctggacaagccacccgaggcactcatttanagtaacaaacaacaaacactacctcggaccctgacccgattcctcgacgcctccctcgtcggggacaacgctcgtcccagacctacgtcgttaccgtggttcggtcgtacgcgtccgtaggacggacggacggaccttagtaacttacgttacctcgtacccttaccgttacttcgttttacgggtggtacgtcgttgtccgtacgttacgttaccgggtacggggtaacggacctaacggtccgtaacggtacccgttaacgtttaaccggtcctaacccggaccgtaaaccgggtccccgttacccgtacccccggttcccggtacccttaacccggtttcccgttaccccggttaccccctacccccccgg

SEQ ID NO: 134136 - DNA, 549 bp, Homo sapiens
  misc_feature: GYAE6OF02GBGEE.17.33.C11.1.454.CMB.1.raw
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggacccctgcccgattctcaggctccctccgttggggacaaacgctgccctgacactgtctggtcgtgcngcctgaggacgngctgactatactgcctactcttacttggtgtgctgtgtctagttcggcggagggaccaagcgtagaccgttattacgtcacggtcccgaaggtcctccgtcccccgtcggtcctaccgtcgttccgttccccgtccctccttcccg

SEQ ID NO: 134137 - DNA, 735 bp, Homo sapiens
  misc_feature: GYAE6OF02JVV5X.17.33.C11.1.454.CMB.1.raw
tcagcgtagactagcacgaccggtgctcgatttagagtgagctcgttgggtttggggcgtggcgccaggggtcccttccaatatcagcaccatggcctggactcctctctttctgttcctcctcacttgctgcccagggtccaattctcagactgtggtgactcaggagccctcactgactgtcgtccccgagggagggacagtcactctcacctgtgcttccaacactggagcagtcaccagtgtcttactactccaaactcggttaccagacaacgaaaccgtaggaacaacgaccgacccgagggaccacgtactaatttaactaacgtaaccaaaacaaaccaaacacctaccgtaccggacccctcgcccgtattacctcgacggcccttacccgttccgggttacggggacgtaaacgtcctcgtacccgtacgacctacgtcggttcgtgggttacgtcgcgtacgtaccgtgggaacggacggtgaccgtgacctttataccgtcgtaccctacttccgtttacgttttgggcggttcgtacgttcggttacgtaccgtttacgggttacgggtacggggtaaccggaaaccgtagggttaccgtacggttaccgttacggtttaacggtacccgaccggttaccccggaacgggttccccgacccggttacccccggttccgtacccgttaccccgttccggttaccccggtttccccccgtcccg

SEQ ID NO: 134138 - DNA, 647 bp, Homo sapiens
  misc_feature: GYAE6OF02ILRQJ.17.33.C11.1.454.CMB.1.raw
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggagcagtcaccagtgcttactatccaaactggttccagcagaaacctggacaagcacccaggcactcatttatagtaacaaacaaacaaacaacctacctcggacccctcgtacccgattacctcgacggtcctccccttccgttgggggacctaaagcgtcgccccgtgaaccaccgttacgttcgtcgggttgtcggctaacgcccgtaggacggacggaggtcgtgactattacgtcgtcctacttccttatttcgggtgtacgcttgtcgcttagttcgggacgggtacgggaccgaagtccgtacggtacccgttacgtttaacggcgtaacccggtacccgaaacggtccctacccgggtccccccgttcgggttaccctacccgtttcccgttccggtttcccccgtacccccg

SEQ ID NO: 134139 - DNA, 577 bp, Homo sapiens
  misc_feature: GYAE6OF02I0D60.17.33.C11.1.454.CMB.1.raw
  modified_base (223)..(223): a, c, t, g, unknown or other
  misc_feature (223)..(223): n is a, c, g, or t
  modified_base (343)..(343): a, c, t, g, unknown or other
  misc_feature (343)..(343): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacnctggagcagtcaccagtgcttactatccaaactggttccagcagaactggacagcacccaggccactcattatagtacaaacaacaaacactaccgtcggacccctcgcccgacttcctnacggtcctccctccgttcgggggacaaacgctgccctcgacactgtctggtgtgcacgtcgtaggacggacggaggcgtagacttattaccgtgcctacttctacgtttggtacggtgtctgtcgtcttagttccgggcggacgggaccgaagctgtaccgtacgttaacgtcgacgtacccgacggtcctccggtccccgttcggtacctaccgtcctccgttcccgtccccg

SEQ ID NO: 134140 - DNA, 582 bp, Homo sapiens
  misc_feature: GYAE6OF02ID6SR.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccgaggcactcatttatagtacaaacaacaaacactacctcggaccctgcccgattctcacggcctccctccgttcgggggacaaacgctcgccctgacactgtcgtggtgtgcagccgtggaggacgaggctgtactattacgtgccttactcttacgtttggtggtcgtcgtgtgtcgttacggttcgggacgggtacggaccgaagtctcggtaccgttacgttaacgtcgacgacccgtaacggccgtaccggtccccgtcggtacctaccgttccgttcccgtacccctaccccg

SEQ ID NO: 134141 - DNA, 615 bp, Homo sapiens
  misc_feature: GYAE6OF02HJ5K5.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccaacactggagcagtcaccagtgcttactactccaaacgtggttccagcaagaaacctggacaacgcacccagggcactactaattataacgtaacaaacaacaaacactccctacggaccctcgacccgattctcagcctccctcgttacggggacaaagctcgccctgacacttgcgtagtgtgcacgtccgtagaggacgagtactacggtattacgttactcgtacccttactcttacgttaggttcggtgcgttgtcgtacttacgttcgggacgggaacggacaacgtcgtacggtaccgttacgttaacgtccgtaacgacccgaacggtcctcccggtcccccgttacggcccttaccgttaccgttcccggttcccccgtaccccc

SEQ ID NO: 134142 - DNA, 667 bp, Homo sapiens
  misc_feature: GYAE6OF02GYH24.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctgacaagcaccagggcactcattatagtacaaacaacaaacactacctacgacccctcgcccgattctacacgcctccctccgttacgggggacaaagcgtacgccctacgaccactcggtcgtgggtcgtcgctacgccgtaggacgggacggacggtactaggtactacgttacttacggtaccttacttaccgttacgtttgggtacggtcgtcgttggtcgtacgttcggttacgggtaccgggtaacgggaccgtaaacggtccgttaccggtaccggttaaccgttaacggtaccgtaaccggaccccgtaaacgggtcccgttacccggtaccccccggttcggtacccgttacccgttccgtttacccggttacccccttaacccccg

SEQ ID NO: 134143 - DNA, 660 bp, Homo sapiens
  misc_feature: GYAE6OF02FJN07.17.33.C11.1.454.CMB.1.raw
  modified_base (229)..(229): a, c, t, g, unknown or other
  misc_feature (229)..(229): n is a, c, g, or t
  modified_base (301)..(301): a, c, t, g, unknown or other
  misc_feature (301)..(301): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtcgcttccaactactggancagtcaccagtgcttactatccaaactggttccagcagaaacctggaacaagcacccagggcactcatttanagtacaaacaacaaacactcctcggaccctgcccgattcctcgacgcctccctccggttggggacaaacgctcgccctgacactcgtctggtgtgcacgtccgtaggacggacggtaggtctacgtaccttattaccgtcgtaccttacctcgtttacgttgggttacgttcggtcgttcgtacgtctttaggttccgggtacgggtaacgggtaaccgtaaggtccgtcggtaaccgttaccgttacggtccgtaccgtcccggtaaggtcccgtacccggttccccccgtaccgggttccctacccggtttccgttaccccggttaccccccggttcccctttacccgttacccccg

SEQ ID NO: 134144 - DNA, 776 bp, Homo sapiens
  misc_feature: GYAE6OF02FJ45T.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacacgtggagcagtccaccagtgcttactatccaaactgtccagcagaaactgacaagcacccagggcactcatttatagtacaaacaacaaacactcctacgacccctgcccgtacttacctcacggtcctccccttccgttacggggggaccaaagtccgtacggcccttaggacctaaccgttcggttaccgtggggttcggtcggaccgtaacggtcccgttagggaacgggaaccggacggggtaccgtagggtaaacccttaagtttacccgtaccggtacccttaaccttccttttaccggtttttgggtcgggtttcggtacgttagggtcgttaccgttaacgtttccgggggtaccgggtaacggggtaacccgtaaggtacccgttacgggtaaccccgttacgttttaaacgtcccggtaaccgggtccccaacggggtacccttaccccggttacccccccggttaccgggttaccccttacccgttacccgtttacccccgggtttcccccccgttacccccgtttcccccgtttaaccccgg

SEQ ID NO: 134145 - DNA, 640 bp, Homo sapiens
  misc_feature: GYAE6OF02F9Y5Q.17.33.C11.1.454.CMB.1.raw
  modified_base (232)..(232): a, c, t, g, unknown or other
  misc_feature (232)..(232): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgccttccaacactgggacncacgtcaccgagtgcttaacatcccaaaacgtggttccagcaagtaaaacctggaccaagaccaccgagggtcactcgatttatagtaacaaacaacaaacacctccgtacggtacccctgacccgtaattcaccgacgtcctcccttcggtacggggtaccaaagccgtcgtacccaggacctacgttagtcgttcgggtagtcgacaagtccctagggtacggaccgaggcttacgacttaagtaaccgttcgtaccttactccgttacgtttcggtgggtcgtccgtggtacgtcgtaacggttccggacggtaacggtaccaaggtcgttacgaccgttacgttacgaccacgtccgaacgctaccgcccgttcgtaccgacctcgtttacccgtcccgtaccc

SEQ ID NO: 134146 - DNA, 647 bp, Homo sapiens
  misc_feature: GYAE6OF02I2MXN.17.33.C11.1.454.CMB.1.raw
  modified_base (232)..(232): a, c, t, g, unknown or other
  misc_feature (232)..(232): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtcgcttccaacactggancagtcaccagtgtcttactatccaaactggttccagcagaaacctggacaagcacccagggcactctattatagtaacaaacaaacaaacactaccacggacccctgacccgattcctcacggcctccctccgttgggggaccaaacgcgtgaccctacgacctacgtgtcgttggtgtgccgacggtcctggaacggaccggagggtctacggtaactacgtttaaccgtcgtacccttaccgttcctttaacgtttgggtcgggttagtcgttggttacgtcgttacggttcggggacggtaacgggaaccgtaacgacgtaccgtaccgttacggtaacgtacgaccgtaccggaaccggtccgtaccgccccgttaccggtaccaccgttcgttacccgtcccttaccccg

SEQ ID NO: 134147 - DNA, 820 bp, Homo sapiens
  misc_feature: GYAE6OF02G5WME.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagcccctcactgactgtcgtcccgagggaggacagtcactctcactgtcgtcttaccaactacgtggacgacgacgtacacgtagtcgtacttactactaacctaaacgttcggttaccagacgaaacgtaaaccgtggaaccgaacgaccgaacccggacggacctacgtacttatttaacgtaacgtaaaccaaaacaaacctaaacctaccgtacccgtacccggaaccccgttaccgacccgttacttaccgtaccgaccggtcccttacccgttaccgggttacggggaaccgtaacgtaccgtccgtcccgtacggacctaacggttcgttacgttgggttcgtcgacgtaccgcgtacgggaacgggtacgaggtactacgtacttacttaccgtcgttacccttactttccgtttacggtttgggtacgttcgtcgttcggtacgttacgttacgggttcggggacgggtaaccgggtaaccgtaacggttccgtaaccggggtttaccgttttaaccgttaacgggtacccgtaacccgggtacccggtaacgggttacccccgttccccggtacccccggtttaccgggttccccgtaacccgtttttcccggttacccccgggttaccccccctttcccccgg

SEQ ID NO: 134148 - DNA, 656 bp, Homo sapiens
  misc_feature: GYAE6OF02JOTRX.17.33.C11.1.454.CMB.1.raw
  modified_base (157)..(157): a, c, t, g, unknown or other
  misc_feature (157)..(157): n is a, c, g, or t
  modified_base (172)..(172): a, c, t, g, unknown or other
  misc_feature (172)..(172): n is a, c, g, or t
  modified_base (216)..(216): a, c, t, g, unknown or other
  misc_feature (216)..(216): n is a, c, g, or t
  modified_base (246)..(246): a, c, t, g, unknown or other
  misc_feature (246)..(246): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (579)..(579): a, c, t, g, unknown or other
  misc_feature (579)..(579): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggttccaattctcagactgtggtnactcaggagccctanactgacctgttcaccccgaggagggacagtcacctctcacctgnccttacaagactggagctagtcacctagtncttactactccaaactggttccagacacgaaactggaacanccacacggcactctatttanacgtaactaaaccaaccaaacacctaccgtacgtaaccccctcgacccggactttaccgtaccgaacggtaccctacccgttccggttacgggggtaccaaacgtactcggtacccttaggaactccgtaacgtcgtggtcgtgaccgaacgtccttacgggaggacgacggtacgttaccggacttaacgtttaccgactaccgtaccttcttaccgttcggtgtcgtcgttcgtagtccttcgtcgggacgtaacggggtaccaacggtntaccgggtccgttacgtacgtcgacgacccgtaacgcgtcccgcccgtacgcaccggtctactcccgtcctctaccg

SEQ ID NO: 134149 - DNA, 912 bp, Homo sapiens
  misc_feature: GYAE6OF02G4KAP.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctccctcacttgctcgcccgagggtccaattctcagactggtggtgactcgaggacgccctcactgactgtcgtccccgagggagggacagtcactctcacctgtcgccttaccaacacgtggacgacacgtaccaaccagtcgtcctttaactactacctaaacgttcggttaccacgacaacgaaaccgtaggaacaacgaccaacccggacgggaccaacgtacttaatttaacgtaacgtaaaccaaaaccaaaaccaaaacctaccgttacccgtacccggaccccctccggtaccccgtacttccgtaccgtaccggtccccttccccggtttaccgggttacgggggaaacctaaacggtcccgtaccggtaccccgttacggtaaccctaccggttccggtttccggttacgggttcggtaccgacgtacggtaccggtaacgggaaccggggaaccgggtacgggtacgttaacggttaacctttaaccgtttaccggttaccgttacccgtttaaccgtttccggttttaacggttttcggggtttacggggttccgttacggttcggtttaccggttaccggttttaaccggggttccgggggtaaccggggtaacgggtaaacccgtaaacgggttccgttaaccggttacccgtttaacggtttaacggtacccggtaaccggtaaccccggtaaccgggtacccgttaccccggtaccccccggtttcggttaccccgttacccggtttcccgtttacccccggttccccccgtcccccgg

SEQ ID NO: 134150 - DNA, 780 bp, Homo sapiens
  misc_feature: GYAE6OF02HW3G8.17.33.C11.1.454.CMB.1.raw
  modified_base (601)..(601): a, c, t, g, unknown or other
  misc_feature (601)..(601): n is a, c, g, or t
tcagcgtagactagcacgaccggtgctcgatttagagtgagctcgttgggtttggggctggcgccaggggtcccttcaatatcagcaccatggcccggatcctctctttctgttcctcctcacttgctgcccagggtccaattctcagactgtggtgactcaggacgccctcactgactgtcgtcccaggagggacagtcactctcacctgtgcttaccaacactaggagacagtaccaccaggtcgcttactaactaccaaactcgttacaagacaagaaaaccgtcggaacaaacggaccaaccgtaacggggacctaacttacgtaattttaaacgttaacgttaaaaccaaaaacctaaaaccaaaaacctaacgtacccgttaccgaaccccgtacggtaccccgtactttaccaccgtacggtcctccccttccggttacgggggacctaaaaccggtcgttccggaccgtaccgaacgtaccttggtccgttcgggtgtacgtcgaacggtccttacgggagggaaccggtacggacgtacgtaaacctacgtttaacctcgtaacccgttaacttccgtttaacgttttgggnggttacgtcgtagttcgtacgttaccggttcgggtacgggaacgggtaaccgtaaacggtccgtaacgtacccgttacgtttaaggtaccgaacggacccgaacggttccgtaccccggtaccccgttaccggtacgtaaccccgtttctaccccggttttaccccaccccctttaccg

SEQ ID NO: 134151 - DNA, 611 bp, Homo sapiens
  misc_feature: GYAE6OF02GTPPF.17.33.C11.1.454.CMB.1.raw
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (408)..(408): a, c, t, g, unknown or other
  misc_feature (408)..(408): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactcncacctgtgcttccaacnctggacgcagtcaccagtcgcttactactccaaactggttccagacaagaaacctggacaagccaccgaggcactcattanagtacaacaacaaacnctcncgacccncgccgattcncacgctccgtctcgggacaacgctcgcctgacacgtgtcgtggtgtcgacgcgcctggacggacggnggctagtactacttacgtcgaccttactcgttacgttgggttacggtcgtcgttgtcgtcgttaacggttccgggtacgggtaaccgggacgaaacggtccgtacggtaccgttacgttaacggtccgtaccggacccgtaggtcccgttccggacccccgttcggtaccctaccgtttccgttcccgtaccccgttaccccg

SEQ ID NO: 134152 - DNA, 657 bp, Homo sapiens
  misc_feature: GYAE6OF02HH3HH.17.33.C11.1.454.CMB.1.raw
  modified_base (303)..(303): a, c, t, g, unknown or other
  misc_feature (303)..(303): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgtcttccaacactggacgcagtcaccagtgcttactatccaaactggttcctagcagaaaccgtggacaagcaccagggcactcatttanagtacaaacaacaaacactcctacgacccctcgacccgattctcaggtcctcccgtaccgttcgggggacaaacgctcggtaccctacgacactggtcctgggtgtggacgagtaccgtggaacgggacggacggtacgtacgtaacttacgttacgacgttccttaaccgttacgttaccgttttgggtcggttcgtcgttacgtcgtcgtttacgttccggggcggtaacgggaccgttaacgcgtaccggtaccggttacgtttaacggtccgtaccggaacccggtaggtacccgtacccggtccccgttacggtcctaccgttcccgttccggttaccccctacccccg

SEQ ID NO: 134153 - DNA, 629 bp, Homo sapiens
  misc_feature: GYAE6OF02H1B9V.17.33.C11.1.454.CMB.1.raw
  modified_base (227)..(227): a, c, t, g, unknown or other
  misc_feature (227)..(227): n is a, c, g, or t
  modified_base (381)..(381): a, c, t, g, unknown or other
  misc_feature (381)..(381): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactataccaaactggttccagcaacgaaacctggacaagcacccagggcactcatttatagtaacaaacaacaaacactacctacggaccctcgcccgtatctcacgcctccctccgtggggacaaagctcgcctgacnctcgtctggtgtgcagcgaggacggacggaggctgaacttacttacgtcgtccttacgttcttacgtttggtgtgtctgtcgtcttacgttcgggacgggacgggaaccgtaaggccgtacggtaccgttacgttaacgtaccgtacggcccgtaaacggtcccgtacccggttaccccccgtccggttacccgtaccgtttacccgttacccggtttacccccgttcccccttcccgttaaccccgg

SEQ ID NO: 134154 - DNA, 647 bp, Homo sapiens
  misc_feature: GYAE6OF02HEA38.17.33.C11.1.454.CMB.1.raw
  modified_base (305)..(305): a, c, t, g, unknown or other
  misc_feature (305)..(305): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacactggagcagtcaccagtcgcttactataccaaactggttccagcaacgaaacctgacaacgcacccagggcactctatttanaacgtaactaaacaaacaaactacctcctacggaccctcgtccgtaattcctcgacgtcctcccgtaccgttggggaccaacgcgtacgccctgacctacttggtcgtaggtcgtcgactagtcgtagacgggacgtacggctagacgttatacgtacgtccttacttcttacgtttggtaggtcggtacttcggttcgtaccgttacggttacgggcggacgggtaccgtaacgtcgtcgtaccgttacgtttacggaccgtaaccggcccgaaggtcctaccggtccccgttcggtactaccgttccgttacccgtaccccgtcccgtacccgttacccg

SEQ ID NO: 134155 - DNA, 589 bp, Homo sapiens
  misc_feature: GYAE6OF02HNGE5.17.33.C11.1.454.CMB.1.raw
  modified_base (299)..(299): a, c, t, g, unknown or other
  misc_feature (299)..(299): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagccaccaggcactcatttanagtacaaacaacaaacactcctcggacccctgcccgtattctcgacggcctccctcgttcggggacaaacgctcgccctgactactcgtctggtgtgcgacgccgtggaggacgaggctacgactattacgcgtccttactcttacgtttggtggtgtcgtgtgtcgttgttccgggcggtaacgggacctaacgacgtacggtaccgttcgttaacgtcgtaaccgaccgtaaccggccgtcccgtcccccgttccgtaccgtcctaccgttccgttcccctacccccg

SEQ ID NO: 134156 - DNA, 763 bp, Homo sapiens
  misc_feature: GYAE6OF02JUPFC.17.33.C11.1.454.CMB.1.raw
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcacgtctcaccgtgtcgccttaccaacnctaggacncacgtccaccagtcgtaccttactactacctaaactggttaccacgactaacgtaaaccgtggaacaacgccgaacccgagggcctactacgtatttagaacgtaacaaacgaaacaacactaccgtacggaccctacggtacccgtattccgtacacggtccctacccgtacggttacggggaacctaacggccgtttaccgacccgtagaccgtaccgttacggttcgttaacggttcggtacgttacgaccggttaccgtacggtacgggtaccggtacggtacccttaggtaaccgtttaacgttaccggttaccgtacccgtttaccgttaaccgtttccgtttacgggtcggttacggttcgttaacggttaccggtaccgttccgggttacgggaaccgggtacgggaaccgtaacggtcgtacgtaccgtttaacgtacggtaccgtaacgacccgtacgaccgttcccggtacccggtaccgtacctaccgttcccgttcccgtaccccgttccccg

SEQ ID NO: 134157 - DNA, 601 bp, Homo sapiens
  misc_feature: GYAE6OF02IGV6T.17.33.C11.1.454.CMB.1.raw
  modified_base (444)..(444): a, c, t, g, unknown or other
  misc_feature (444)..(444): n is a, c, g, or t
  modified_base (496)..(496): a, c, t, g, unknown or other
  misc_feature (496)..(496): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccagggagggacagtcactctcacctgtcgcttaccaacactggagcacgtccaaccagtgccttactactaccaaacttcggttccagacaacgaaacctggaacaagccaacccgaggcacttcaatttataagtaaccaaaacaaaccaaaacacctacctacccggacccctacggcccgtacttcaccgacgtcctcccgttaccgtcgggggacaaacggctacgccgtcgacacgtcgtcgtggtcgtgcngccgtgaggacgagctagactattactcgcctacttcttacgtttggtgtgnttgtcacgttgtcgggcggtaacggacagcgtctacgtcgttacgcaccgaccacggtacctcccgccccgtcggtacctcgtccgttcccgttcccgtaccccg

SEQ ID NO: 134158 - DNA, 673 bp, Homo sapiens
  misc_feature: GYAE6OF02I864E.17.33.C11.1.454.CMB.1.raw
  modified_base (302)..(302): a, c, t, g, unknown or other
  misc_feature (302)..(302): n is a, c, g, or t
  modified_base (392)..(392): a, c, t, g, unknown or other
  misc_feature (392)..(392): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttcaacactggagcagtcaccgagtgcttactataccaaactggttccagcaacgaacctggacaacgcaccaggcactcatttanacgtaacaaacaacaaacactacctacgccctacgccgattctacaggcccttccctcggttacgggggacctaaacggcctcgtacccncgaaccacgttcgtccgtggttcgtcgacgtacggtccgtaggtaacgggaacggacggtaccgtacggtaacttacgtttacggttcgtaaccctttaacgttccgtttaacgttttcgggtcgggttacgttcgttcggttacgtcgtttacgttaccggggtcggtacgggaacgtaacggccttaggtacccgttagtaaacgtccggtaacgcccggtaaggcctacccggtaccccgtcggtacctacccgttccgttaccgtccccgtaacccg

SEQ ID NO: 134159 - DNA, 557 bp, Homo sapiens
  misc_feature: GYAE6OF02F5VK8.17.33.C11.1.454.CMB.1.raw
  modified_base (338)..(338): a, c, t, g, unknown or other
  misc_feature (338)..(338): n is a, c, g, or t
tcagcgtagactagcacgaccggtgctcgatttagagtgagctcgttgggtttggggctggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtcgcttactatccaaactcggttccagcagaaacctggacaagcacccagggcactcattatagtaacaacaacaaacactcctgaccctgcccgattcncacgcctcctccgttggggacaagctcgccctgaacactgtctggtgtgcagctgacggacgaggctagactattactcgtccttagtccttacgtttggtggtgtcgtgtcgtcgtagttcggcgggacggaccgtaagcgtcggtaccgttcgtaagtcgtacgaccgaacgtccgtaccgccccgtccggtcctccgtccttcgtcccctaccccg

SEQ ID NO: 134160 - DNA, 725 bp, Homo sapiens
  misc_feature: GYAE6OF02JG1T7.17.33.C11.1.454.CMB.1.raw
tcagcgtagactagcacgaccggtgctcgatttagagtgagctcgttgggttggggctggcgccaggggtcccttccaatatcagcaccatggcctggactcctctctttactgttcctcctcacttgctgccctagggtccaattctctagactggtggtgtactcgaggacgccctcgactgactgtcgtccccgagggagggacaggtcacgtctcacctgtggcttaccaacactggacgcagtcaccgagtcgcttactactaccaaacttcggttccaggacaacgaaacctgggaacaacgccaacccggacgggaccaactactaagtttactaacggtaaccaaaacaaacgaaaccgactaccgtacggtacccctcggaccctattaccgacgaacggtccttacccgttacggttacgggggtaacctaaacggtcttacggacccgtacgaaccgtaaccgttcggttcggtggtcggtcgacgtacgtcgtagggacggacgtacggtcgtacgacttacttacgtcgtaccttacgtcctttacgtttaggtcgttacgtcgttcgtcggtacgttacggttaccgggacgggtaacggacctaacgtcgttaacggaccgttacggtacgtaccgaccggaaccgtaccggtccgtcccggtccccgttacggtccgtaccgttccgttaccccgttccccgtaccccg

SEQ ID NO: 134161 - DNA, 792 bp, Homo sapiens
  misc_feature: GYAE6OF02HL53S.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagcctcactgactgtgtcccgaggaggacagtcactctcacctgtcgcttccaacacctggagcagtccaccgagtgcttactactacctaaactcggttaccagcaagaacctggactaacgaccacccgacgggacactactactttaataacggttaacaaaaaccaaactaaaaccaaccttacccgtaccggtaacccctccggtacccgtaatttccgtacgacgggtccccttaccccgttccggttacgggggacctaaacggtcctccgtacccgtcgtaacctccgtttacgtcggttcgggtcgttggaccgtacgtcccgtagggaacgggtacggtacggtcgttacggtaactttaacgttaccttccggtacccttaacgttaccgttttaacgttttcgggttagggttcgtcggttggttaccgtacgtttaacggtttccgggacggggtaaccgggttaaccgaaacgggtacccgttcgggtaacccgtttacgttaacggtaccgtaccgggtaacccggaccggttccgtaaccccgtcccccggttcgggttacccaccgtttcccgttacccggtttacccccgtacccttacccgtttacccg

SEQ ID NO: 134162 - DNA, 668 bp, Homo sapiens
  misc_feature: GYAE6OF02JF84P.17.33.C11.1.454.CMB.1.raw
  modified_base (301)..(301): a, c, t, g, unknown or other
  misc_feature (301)..(301): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactccaaactcggttccagcaagaaacctggaacaagcaccaggcactcattanagtacaaacaacaaacactcctcgacccctcgccgattctcgacgtcctcccgtcgtcggggacaaagtctcgccctgacactgtcgtggtcgtgtcacgcgtaggtacggacgtacgggtctacggtaaccttacgtttaaccgttccggtacccttaaccgttccgtttaacgtttttcgggtacgggttcgtcgttcggttacgtacgttacggttccggggacgggtaacgggaaacccgttaaggtccgtacggtacccgtttacgttaacggtaccgaccgtacccggtaacggtcccgtcccggttacccccgtccgggttacctaccgttcccggttcccgttaccccctaaccccccg

SEQ ID NO: 134163 - DNA, 643 bp, Homo sapiens
  misc_feature: GYAE6OF02H6MU1.17.33.C11.1.454.CMB.1.raw
  modified_base (171)..(171): a, c, t, g, unknown or other
  misc_feature (171)..(171): n is a, c, g, or t
  modified_base (181)..(181): a, c, t, g, unknown or other
  misc_feature (181)..(181): n is a, c, g, or t
  modified_base (267)..(267): a, c, t, g, unknown or other
  misc_feature (267)..(267): n is a, c, g, or t
  modified_base (423)..(423): a, c, t, g, unknown or other
  misc_feature (423)..(423): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggacgccctnactgactgtntcccaggagggacagtcactctcacctgtcgcttccaacactggagcagtcaccagtgcttaacataccaaactggttccagcaanaaacctgacaagcaccaggacactcatttatagtaacaaactaaacaaacactacctcgaccctcgacccgattctcgagcctcctccgtggggcaaaggctgccctgacactgtctggtgtgcagcctagacgacggagctcgacttactacgtnacccgttacctaccgttaacgttttgggtaggttacgtccgttagttgacctttacgttcgggacgggttacgggaaaccgtaaacggtctacgggtaacccgttacgtttaacgtaccggtaacggacccgtaaacgggtccttacccggcccccgtttaaccgggcccttaaccgtccgtttaccccgtaccccttacccccgttcccttaaccccgg

SEQ ID NO: 134164 - DNA, 686 bp, Homo sapiens
  misc_feature: GYAE6OF02HGNJF.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtgggtgactcaggagccctcactgactgtgtccccagggagggacagtcactctcacctgtgcttccaacactggagcagtcaccagtgcttactatccaaactggttccagcagaaacctggacaagcacccgaggcactcatttatagtacaaacaacaaacactacctcggaccctgcccgacttctccacggctaccctccgttcgggggactaaacgcgtcgcccctacggacctactggttaccgtgggttcgtcgccgaaggcccgtaggacgggtaccggagggtaccgttaggaaccgttagtttacctacggtcccttaaccgttacctttaccgttttagggtcggttcggttcgtacggttcgtacgttagtttcgggaccgggtaacgggaccaacggtccgtacggtacccgttaccgtttaacggtccaaccggtacccggtaaacggtcccgtacccggcccccgttccgggttacccgtacccgttcccgttcccggttacccccgttccccccg

SEQ ID NO: 134165 - DNA, 676 bp, Homo sapiens
  misc_feature: GYAE6OF02HD1EK.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgcttccaacacgtggagcagtccaccagtgacttactactaccaaacgttcggtaccagacaacgaaaccgtaggaacaacgccaacccgagggactactactatttaataacgtaacaaaacaaacaaacctactacccgtacggacccctacgacccgtacttctacgacggtcctcccgtacggttcggggacaaacgtctcgccctagaccactcgcgttggtgtcgcgacgcgtaggacggacggacggcgtagtaaccttagttaccgtcgtacccttacttccgtttacggtttcgggtcggttcgtcgttggttcgtcgttacggttccggggacgggtacgggaacgaacgtcgtacgtaccggttacgttaacggtccgtaccggacccgtacggtccgtacccggtccccgtacgttacctacccgtccgttacccgtacccctaccccg

SEQ ID NO: 134166 - DNA, 700 bp, Homo sapiens
  misc_feature: GYAE6OF02GJDUT.17.33.C11.1.454.CMB.1.raw
  modified_base (248)..(248): a, c, t, g, unknown or other
  misc_feature (248)..(248): n is a, c, g, or t
  modified_base (282)..(282): a, c, t, g, unknown or other
  misc_feature (282)..(282): n is a, c, g, or t
  modified_base (414)..(414): a, c, t, g, unknown or other
  misc_feature (414)..(414): n is a, c, g, or t
  modified_base (687)..(687): a, c, t, g, unknown or other
  misc_feature (687)..(687): n is a, c, g, or t
tcagcgtagactagcacgaccggtgctcgatttagagtgagctcgttgggtttggggggtcggccgaggggtcccgttccaactatcagcaccatggcctggactcctctcttctgttcctcctctacttgctgccacggtccattctcagactgtggtagactcaggacgtccctcactgactgtcgtacccaggagggacaggtcactctcacctgtcgcttccaacacgtggagtcagtcaaccngtcgcttactataccaaaattcggtccaacgacncgtaaaaccgtcggaacaacggaccttaccgacgggactactcaattttactaacgaaaacaaaaccaaaaccggaacaaaccttccgggaaccgaacccgttcaccccggacttttcacgaaccggttccnccccgttcgttaccggggggtacaaaaccggcctacccggtcctacggtaacctaaccttgggttcccgttgggttactcggacgaccgtaccggtcgtaggaccgggaggtcctacgggtacttatactacggtctaacgtcctttaacgttgtggtcttgcggtaatctacggtttcgcgggaacggttccgaaagtccgtcgaccgttcgtacgttacgccgtacggactacgcccgttaccgcggttacctcggtacctcggttacccnccgtaccccttcg

SEQ ID NO: 134167 - DNA, 617 bp, Homo sapiens
  misc_feature: GYAE6OF02I2Y3F.17.33.C11.1.454.CMB.1.raw
  modified_base (300)..(300): a, c, t, g, unknown or other
  misc_feature (300)..(300): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtcgcttccaacactggacgcagtcaccagtcgcttactatccaaactggttccagcacgaaacctggacaagcaccgaggcactcattanagtaacaaacaacaaacactctcggaccctgaccgattctcacgcctccctaccgttggggaccaagctcgacctgacactgtctggtcgcgcgacgtcctggaacggacggacggctgactacttacgtcgtaccttactcgttacgtttcgggtggttcgtacgtggttcgtacgttacgtttccgggaccgggtaacgggaaccgtaacggtccgtaacgtaccgtacgtttacgacgtaacgaccgaacggtaccgtccggtccccgtaggtacctaccgttccgtcccgttcccggtcccctccgttacccg

SEQ ID NO: 134168 - DNA, 662 bp, Homo sapiens
  misc_feature: GYAE6OF02G1JNN.17.33.C11.1.454.CMB.1.raw
  modified_base (297)..(297): a, c, t, g, unknown or other
  misc_feature (297)..(297): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactaccaaacttggttccagcaagaaacctggacaagccaccgaggcacncattatagtaacaaacaacaaacactacctcggaccctcgcccgattctcaggcctccctcgttcggggacaaacgctcgccctgacactgtctgggtcgtgcacgccgtaggacgggacggacggcgtcgtaccttaattaccgtcgtacccttaccttccgtttaacgttttgggttagggtttcgtacgttcggttcggtaccgtttaacggttccggggtaccggggtaacgggtaccgtaaacggtccgtacggtacccgtttaacgttaacgtccggtaacgaccccgtaagggtcccttacccggtcccccggttcggttacccaccgtttccgttcccgtttcccccgtaacccccg

SEQ ID NO: 134169 - DNA, 667 bp, Homo sapiens
  misc_feature: GYAE6OF02F9UP6.17.33.C11.1.454.CMB.1.raw
  modified_base (233)..(233): a, c, t, g, unknown or other
  misc_feature (233)..(233): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtcgcttaccaacactggancagtcacagtcgcttactataccaaactcggttccagacaacgaaacctggaacaagaccaccgagggcactctaatttactaagtaaccaaaacaaacaaacacctacctcggaccctcgacctacttctcacggtcctcccgttccggttacgggggacaaacgcgtacgcccgtacgacctaacgttcgtacgttggtgtacgctacggcccgtaggaacgggacgaggactggtaactacgttacgctacccttacttaccgttagtttacgggtgtcggtcgttacgtcgttagtaccggtttcggggacgggtaacggaacgtaacgtcgtacggtaccgttataacggtaccgaacgtaacccggaaggtcccgtccgtaccccgttacggtacccttacgtcccttaccggttccccctaaccccg

SEQ ID NO: 134170 - DNA, 642 bp, Homo sapiens
  misc_feature: GYAE6OF02GGEOD.17.33.C11.1.454.CMB.1.raw
  modified_base (541)..(541): a, c, t, g, unknown or other
  misc_feature (541)..(541): n is a, c, g, or t
tcagcgtagactagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctccgtcccccttcgcagtaacaccaagtacaggaatattaacctgtttcccatcgactacgcctttcggcctcgccttaggggtcacctcaccctcgccccgattaacggttggacaggaacccttggtcttccggcgagccgggtcttttcacccgtctttatcgttacttatgtcagctattcgcactttctgactacctccagcatcgcctcacacgcacctaccttcacacggtcttaacgacgaaccgtccctacccctaacccaaacctaaccgacctaagtaacgccgtaccgccgtcggcccncaacgtccgttccggtacgcgtaccgttcgggtttaccgtacccccggtttaataccgtttccttacccccgtcctacgttcctacggtacttacgtaccg

SEQ ID NO: 134171 - DNA, 659 bp, Homo sapiens
  misc_feature: GYAE6OF02H2A23.17.33.C11.1.454.CMB.1.raw
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
tcagcgtagactagcacgaccggtgctcgatttagagtgagctcgttgggtttggggggcgccaggggtcccttccaatatcagcaccatggcctgggactcctctctttctgttcctcctcacttgctgccagggtccaattctcagactgtggtgactcaggacgccctcactgactgtgtccccaggagggacagtcactctcacctgtgcttccaacactggagcagtccaccagtgaccttactactaccaaacgttcggttccagaccaacgaaaccgtaggacaacggaccaaccccgagggaccaccgtacaattttaataacgtaacaaaacaaccaaaacacctacctacggacccctcgcccgtaattcacgtacggcctcccgttcggttacggggacaaacggctcgacccgtagacacgtgtcgtggtgtgctcgctaggaggacgtaggctanacttagtctntaccttactcttacgtttgtgtagtcttgtcgtgttacggtcgggaacgggtacggaccaaacggtctacgggtaccgtttagttaacgttccgaccggtaacccgtaaccggtcctcccggtaccccgtccgtacctcccgttaccttcccggtttaccccctccccgttcctaccccgg

SEQ ID NO: 134172 - DNA, 603 bp, Homo sapiens
  misc_feature: GYAE6OF02JRVZK.17.33.C11.1.454.CMB.1.raw
  modified_base (169)..(169): a, c, t, g, unknown or other
  misc_feature (169)..(169): n is a, c, g, or t
  modified_base (206)..(206): a, c, t, g, unknown or other
  misc_feature (206)..(206): n is a, c, g, or t
  modified_base (320)..(320): a, c, t, g, unknown or other
  misc_feature (320)..(320): n is a, c, g, or t
  modified_base (451)..(451): a, c, t, g, unknown or other
  misc_feature (451)..(451): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacnccctcactgactgtcgtcccaggaggacagtcactcncacctgtgcttaccaacacgtggagcacgtaccacgagtgtaccttactactcccaaacttcggttccagccaacgaaacctggaacaagccacccgaggcacgtctaatttanagtaacaaacaaacaaacacctccgtacgacccctgacccgtatctcgacggtcctcccgtcgttgggacaacgctacgccgtagacctacgtcgtcgtcggtgtcgcgacgccgtgacggcgtagtcgtnactattacgcgtcctacgttcttacgttggtcgtgtcgttgtcgtcgttacggtcgggcgggaacggacgtacgtcgtaccggtacgttacgtacgtcgaacgccgacggcctcccggcccgttcgtcgaccttccgtcgttacccctcccg

SEQ ID NO: 134173 - DNA, 654 bp, Homo sapiens
  misc_feature: GYAE6OF02IRMLT.17.33.C11.1.454.CMB.1.raw
tcagcgtagactagcacgaccggtgctcgatttagagtgagctcgttgggtttgggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttaccaacactggagcagtcaccagtgcttactataccaaactggttaccagcaagaaacctggaacaacgcaacccgagggtacactactaatttataacgtaacaaacaaacaaaccacctcctacggacccctcgacccgtaattctaccaacggtccctcccgtaccggttacgggggacctaaacgcgtacggtccctacgactaccgttgtccgtggttgtacgcgaacgtccgtaggacggacggacgggctacgtaacttagttaacgtcgtaccttactaccgtttacgtttgggtcggtgtcgtgttcgtcttacggttcgggacgggaccggaacgaacgtcgtcgtaccgttacttaacggctaacggcccgaaggtccgtcccgccccgttcggacctaccgtccgttccggttcccctaccccg

SEQ ID NO: 134174 - DNA, 694 bp, Homo sapiens
  misc_feature: GYAE6OF02H87F2.17.33.C11.1.454.CMB.1.raw
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
  modified_base (389)..(389): a, c, t, g, unknown or other
  misc_feature (389)..(389): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcactgtgcttcaacactggagcagtcaccgagtgcttactatccaaacgttcgttacagacacgaaacctggaacaagcaccgaggcactcatttanagtaacaaacaacaaacncctcagaccctcggacctattcncgacgccttacccgtaccggttaggggacaaacgctcgtccgtanacgacgttcgtacgtcgggtcgtacgactacggtaccgtaggaacggtaaccgggacggtaccgtaacggtaaccgtttaacttacgtacggttaacccttaccgttcctttaacgggtttcgggtacgttcgtacgttacggtacggtcttaacggttccggggtacgggaaacccgggacgtaaacgtccgtaccgttaaccgttacgtttaaccggtaccgaacgtacccggtaacggtccctcccgtacccccggttggtaacccctttaccgtaccgttcccgggttacccccttccccg

SEQ ID NO: 134175 - DNA, 623 bp, Homo sapiens
  misc_feature: GYAE6OF02IOU87.17.33.C11.1.454.CMB.1.raw
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggacgcagtcaccagtgcttactactaccaaactggttccagacaacgaaacctggacaagcacccgaggcactctattatagaacaaacaacaaacactcctacgacccncgaccattcncacgtcctccctcgtcggggacaacgctacgcctgacctacgtcgtcgtgggtgtcgcgtacgccgtaggacgggacgacggtctacgtacttacgttacgtcgtacctacttcttacgtttgggtggtgtcgtgttcgtactacggttcgggacggacgggaccaaggtccgtacggtaccgttacgttaacggtcgaaccggaccggtaacggtccgttacccggtccccgttcggtaccctccgttcccgttcccgttacccccctaaccccg

SEQ ID NO: 134176 - DNA, 576 bp, Homo sapiens
  misc_feature: GYAE6OF02FTJEX.17.33.C11.1.454.CMB.1.raw
  modified_base (298)..(298): a, c, t, g, unknown or other
  misc_feature (298)..(298): n is a, c, g, or t
  modified_base (440)..(440): a, c, t, g, unknown or other
  misc_feature (440)..(440): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttanagtacaaacaacaaacactacctcggacccctgcccgattctcaggcctccctcgttgggggcaaagctgccctgacactgtctggtgtgcacgctggaggacgaggctgactattactgccttactcttactttggtggtntcgtgtgcttagttcggcgggtaggaccgaaggcttcggaccgttacttacggtcacggtcccgaaggccgttaccgcccccgttcggtacctaccgtttacctcccggtttccccgccccttcccgttaccccgg

SEQ ID NO: 134177 - DNA, 710 bp, Homo sapiens
  misc_feature: GYAE6OF02H3I57.17.33.C11.1.454.CMB.1.raw
  modified_base (178)..(178): a, c, t, g, unknown or other
  misc_feature (178)..(178): n is a, c, g, or t
  modified_base (233)..(233): a, c, t, g, unknown or other
  misc_feature (233)..(233): n is a, c, g, or t
tcagcgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgcgtggtacgaaacccanacacgaccctcacgctgacctgcctacctttctctcggcttctcactcagaacgngtaggaagtggggagtggcgtggactccgtacgacgacccccgaggtaaacggcccgtaggtacgtggcttgacgtctctatttagtgggataggagagtacgactactacgtacgtccgtctactagaacgacgagcctacaccacgaccacgaacgaccacctaccgaaaccgtaacgtacgtacgtactaacgtaactacgaacaactacgtacggtaccgtagacgacgacgtacgtaccgaactacgttacttacttacgtacctacgtacctacggttacggttacgggttacgggttaacgttttacgttaccgttacccgtttaacgtttacggtacgttaaccgggtacgggttaacccggtacgggtaccgttcggttaaccggtacccgtacccgtaccggtcccgttacgcccggtacccccgtccggtaaacccggtacccggtaccgttacccggttccccgg

SEQ ID NO: 134178 - DNA, 762 bp, Homo sapiens
  misc_feature: GYAE6OF02G7V1R.17.33.C11.1.454.CMB.1.raw
tcagcgtagactagcacgaccggtgctcgatttagagtgagctcgttgggttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacacgtggagcagtcaccagtgacttactactacctaaactggttaccagcaacgaaaccgtggaacaagccacccgagggccactctatttatacgtaacaaaactaacaacacctcctacggacccctacgccccgtaattcctacacggtccctaccctccggttaggggaccaaagtccgtaccgcccgtacgaactacgtcggtcctggggttcgtggtaccgtaggtcccggtagggtaacgggaccggtaagggaccgtacggtaaccgttacgtttacctcggtacccttaacccgttacgttaccggttttacgggtgggttacgtccgtttaggttacggtaccgttaacggtttcccggggaacgggtaaccgggtaaacccgaggttaccgtaccggttacccgttaacgttaaccggtaccggaaccgtaccccggtaacgggtcccgttaccccggtccccccggtttacggttaccccgtttacccggttttaccccggtttaccccccgtcccctttaacccccgg

SEQ ID NO: 134179 - DNA, 620 bp, Homo sapiens
  misc_feature: GYAE6OF02IQ7YO.17.33.C11.1.454.CMB.1.raw
  modified_base (297)..(297): a, c, t, g, unknown or other
  misc_feature (297)..(297): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcaagaacctggacaagcaccaggcactcatttanagtaacaaacaaacaaactactacctacggacccctgcccgtattctcagcctccctccgttggggacaaacgctcgccctagacactgtcgtggtgtgcagcgtaggacggacgacggctagacttagttaactcgtaccttacgttcttacgtttgggtgtgcttgtcgtgttacgtccgggtacggacggtaacaacggtacgtacggtaccgttagttacgtacgaaccgacccgaacggtcctaacccggtcccccgttaggtacccttaccgttacccgttccccggtttaccccgtccccctttacccgttacccg

SEQ ID NO: 134180 - DNA, 561 bp, Homo sapiens
  misc_feature: GYAE6OF02F7V74.17.33.C11.1.454.CMB.1.raw
  modified_base (347)..(347): a, c, t, g, unknown or other
  misc_feature (347)..(347): n is a, c, g, or t
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
  modified_base (550)..(550): a, c, t, g, unknown or other
  misc_feature (550)..(550): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactccaaactcggttccagcaagaaacctggacaagccaccctagggcactcattataacgtacaaacaacaaacactcctacggacccctgcccgatcncagcctccctcgttggggacaaagctcgccctagaccactgtctggtntgcacgctagacggagacggctgactattactnccttactcttacgtttggtggtgctgtgtcgtagttcggcgggacggaccaagtcgtcgacgttaccttaagttcacgtacccgaacggctccgccccgtacgtccgacctcccttaccccnccccttacccg

SEQ ID NO: 134181 - DNA, 638 bp, Homo sapiens
  misc_feature: GYAE6OF02JNFEO.17.33.C11.1.454.CMB.1.raw
  modified_base (231)..(231): a, c, t, g, unknown or other
  misc_feature (231)..(231): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctggtcgcttccaacacgtggancagtcaccagtgcttactactacctaaactggttccagcaacgaaaccgtggaacaagccacccgagggacactctatttactacgtaacaaacaacaaacacctccgtacggaccctcgaccgacgttctacgacggacctccgttccgtacggggacaaacgtctaccggcctacgactacgtgttcgtggttcgcgacacgcctggacggacgaggctgactacttatcgacctactcgttacttggtgtcgtactcggtctacgtacgttccgggacgggtacggtaccgaagtccgttacggtacccgttacgttacggtccgacgtcccggtaacggtcccgttaccggtcccccgttcggttaccgtaccgttaccggtcccggttacccccttccccgg

SEQ ID NO: 134182 - DNA, 612 bp, Homo sapiens
  misc_feature: GYAE6OF02GWCRR.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcaccagggcactctattatagtacaaacaacaaacactacctcgacccctgccgtacttcctcaggcctcccgtccgttgggggacaaagcctcgccctggacaactgtcgtggtcgttcagtcctagtaggacggaggctagacctattactcgacctacttcttactttggtgtgtcgtgtcgtcgtacgttcgggacggacggacctaaggtctacggtaccgttacttaggtaccgacgtacccgaacggtccgtccggtcccccgttacggttcccgtaacttcccgttaccggttaccccctaccccgttacccgttccttaacccgg

SEQ ID NO: 134183 - DNA, 650 bp, Homo sapiens
  misc_feature: GYAE6OF02H75R7.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactccaaacttggttccagcaagaaacctggacaagcacccgaggcactcatttatagtaacaaaacaacaaacacctccgtacggacccctgcccgtaattccacacggcctccctccggttgggggacaaagcctcgccctagacctacgtcgtcgtcggtagtcgcgacgccgtaggaacggacgacggtctagaacttacttacgtcgtacccttaacgtttcttacgtttggttggtcgtacgttgttcgtacttagtcgggacggtacgggacctaaggtcgtacggtaccgtacgttaacgtcgaaccggcccgtaacggtccgtaccccggtcccccgtacggttaccctccggttaccgtttcccggttccccgttcccccttccgtttaccccgg

SEQ ID NO: 134184 - DNA, 681 bp, Homo sapiens
  misc_feature: GYAE6OF02I6DKP.17.33.C11.1.454.CMB.1.raw
  modified_base (323)..(323): a, c, t, g, unknown or other
  misc_feature (323)..(323): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtcgcttccaacacgtggagcagtccaccagtcgaccttactactaccaaaacgttcggttaccagacaacgaaaccgtgaacaacgaccaacccgaggacacgtctaatttanaacgtaacaaaacaaacaaacacctccacggacccctcgacccgtattcctacgacggtcctcccgtcggttacggggacaaacgtccgtacgcccgtagacctacgttcgtacgtcggtcgtcgacgacgtcgtaggacgggtacgacggtctacgtaacttacttacgtacgtaccttacgttctttaacggttcgggttcgtcgtcgttcggttcgtacgttacgggtacgggacgggtaacggtacgtaacgtcgttaacggtaccgttacgttacgaccgtacggccgtaacggtccgtcccgtacccgttcgtacttcctacggtttcccgtcccgtcccttaccgttaccg

SEQ ID NO: 134185 - DNA, 829 bp, Homo sapiens
  misc_feature: GYAE6OF02HSKL4.17.33.C11.1.454.CMB.1.raw
  modified_base (168)..(168): a, c, t, g, unknown or other
  misc_feature (168)..(168): n is a, c, g, or t
  modified_base (224)..(224): a, c, t, g, unknown or other
  misc_feature (224)..(224): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcagganccctcactgactgtcgtccccaggagggacagtcactctcacctgtgcttccaacncgtgagcagtcacagtgcttactatccaaactcggttccagcaacgaaaccgtcggaacaagccaacccgagggaccactactaatttataacgtaacaaaccaaacaaaccgactaccgtaccggacccctcgaccccgtattcctaccgacggtcctccccgttccggttacggggggacctaaagtccgtcgtcccgtacgacccgtacgttcgttccgttcgggttggtcgtacccgtcggaccccgttagggaaccgggtaacggtacgggacgttacggtaacgtttaagtttaaccgtcgttaaccctttaaccgtttccgtttaacccgtttttggggtttcgggttacgttccggtttacggttacggttacccgtttaagggtttccggggtacccggggtaacggggtaaacccggaaacgggttccgtttaaccgggtacccggttttaccgttttaaaggtacccggttaaccccggaaccccggtaacccgggttacccggttacccccgttacccccccggtttaccgggttacccttaccccggttttaccccgtttaccccggtttacccccccgtttaacccccccg

SEQ ID NO: 134186 - DNA, 886 bp, Homo sapiens
  misc_feature: GYAE6OF02G79YU.17.33.C11.1.454.CMB.1.raw
  modified_base (174)..(174): a, c, t, g, unknown or other
  misc_feature (174)..(174): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctnactgactgtcgtccccagggagggacagtcactctcacctgtcgtcttaccaacacgtggacgcacgtccaccgagtcgaccttacgtactacctaaaacgttcggttaccagacaaacgtaaaccgtcggaacaacgaccaaccccgagggacaccgtctaattttaacgtaacgtaaccaaaaacaaaccaaaacctacctacccgttaccggacccccgttacgaccccggttaactttaccgaccggtaaccggtccccttaccccggtttccggggttaccggggggaaacctaaacgggtccttacccggtaccccgtacgtaaccctacggtttcggttcccggtttggggttcgggtccgtaccgtacggtacccggttagggaaccggggtaacggacgggttaccgtaacgggttaacttaaccgtttaccggttacctaccccgttttaaccgttacgttttaccgggttttaggggtccgggttacgtcggttcggtttacggttccggtttaacgggttcccggggaacggggtaaccgggaacccggtaacgttaccggtaccggttaccggtttaaccgtttaaccggtaaccggtacccgggtacccggtaaccggttccccggttaccccggtccccggttaccgggttacccttaccccggtttcccgttccccggttacccccgttacccccg

SEQ ID NO: 134187 - DNA, 772 bp, Homo sapiens
  misc_feature: GYAE6OF02IUBZ1.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccaggtccaattctcagactgtggtgactcaggagccctcactgactgtgtcccaggagggacagtcactctcgacctgtcgcttaccaacactggagcagtcaaccagtcgacttactacgtaccaaacgttcggttaccaagacctaacgaaaaccgtcggaacaaacggaccaacccgacggggacctaactactaattttaagtaacgtaaccaaaacaaacaaaacctactaccgtacgtaccccgtacgacccgtaacttcctacgacgtccttaccccgtacccggtttagggggaacctaaaaggccttacggacccctgaaccctaacgttcggttacctgggttcgtcgacgtacgccgtaggacgggtaacgacgtacgtataaccgtaactttaccgttcgtacctttaccgttaccgtttaacgtttttcgggtagggttacgtacgtttcggttacgtaccgttaacggtttccggggaaccgggtaaccggggaaccttaaacggtcgttacggtacccgttacgtttaaacggccgtaaaccggacccttaaacgggccgttaccccgacccccgttacgggtaccctaccgtttacccttacccggttaacccctaacccccg

SEQ ID NO: 134188 - DNA, 768 bp, Homo sapiens
  misc_feature: GYAE6OF02HV4E9.17.33.C11.1.454.CMB.1.raw
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (312)..(312): a, c, t, g, unknown or other
  misc_feature (312)..(312): n is a, c, g, or t
  modified_base (330)..(330): a, c, t, g, unknown or other
  misc_feature (330)..(330): n is a, c, g, or t
  modified_base (351)..(351): a, c, t, g, unknown or other
  misc_feature (351)..(351): n is a, c, g, or t
tcagcgtagactagcacgaccggtgctcgatttagagtgagctcgttgggtttggggggcgccaggggtcccttccaatatcagcaccatggcctggactcctctctttctgttcctctcacttgctgcccagggtccaattctcagactgtggtgactcaggacgccctcactgactgtcgtccccaggaggacagtcactcncactgtgcttccaacactggancagtcaccagtgcttactactaccaaacgttggttaccagaccgtaacgaaaccgtaggaacaacgcaccgtaggcactcatttanacgtaacaaacaacaacnctcacgaccctgaccgattcncgacggtcctcccgtccggttaggggacaaagtccgtcgtacccgtacgtacctacgtagttcccggtgggttcgtacgtacgtacggtaccgtagggaacgggtaccggacgggtaccgtacgtaaccgttaacgtttaacgttccgtaacccgttaacctttacggtttaaccgttttcggggtacggttacgtccggttaggttccggtaaccgtttaccgggttacccggggtaaccggggtaaccgggaacccgttaaacgggccgttaccgggttaaccgttaccggttaacggtaccgtaaccgggtacccgtaaccgggtccgttaccccggtacccccgttccgggtaccctacccgttccggtttccccggtttacccccggtcccccgttacccgtttaaccccgg

SEQ ID NO: 134189 - DNA, 650 bp, Homo sapiens
  misc_feature: GYAE6OF02GXN52.17.33.C11.1.454.CMB.1.raw
  modified_base (229)..(229): a, c, t, g, unknown or other
  misc_feature (229)..(229): n is a, c, g, or t
tcagcgtagactagcacgaccggtgctcgatttagagtgagctcgttgggtttgggggcgccaggggtcccttcaatatcagcaccatggcctggactcctctctttctgttcctcctcacttgctgcccagggtccaattctcagactgtggtgactcaggacgccctcactgactgtcgtcccgaggagggacagtcactctcacctgtctcttccaacactggacncagtccaccagtgcttactatccaaacgttcggttccagcaacgaaacctggacaagccacccgagggccactactatttagtagtaacaaacaacaaactactcctacgacccctcgccgtactctacacgcctcctcgttggggacaaacgctcgcctgactacctgtcgtggtgtcgcagtccgtaggacggcggacggctagtacttacgttacgcgtccgttacttcgtttacgtttgggtcgttgtcttagtcgtacgttacggttccgggcgggtaacgggaactacggtccgtaacgtaccgttacgttacgtacgtaccgggtccgtaacggtcccgtacccggtacccccggttacggtaccctaccggttcccgttacccggtcccccgttcccgttcccgttaaccccg

SEQ ID NO: 134190 - DNA, 681 bp, Homo sapiens
  misc_feature: GYAE6OF02H3S3N.17.33.C11.1.454.CMB.1.raw
tcagcgtagactagcacgaccggtgctcgatttagagtgagctcgttggggtttggggggcgccaggggtcccttccaatatcagcaccatgggcctggactcctctctttctgttcctcctcacttgctgcccagggtcaattctcagactgtggtgactcaggagccctcactgactgtcgtccccgaggagggacagtcactctcacctgtgcttaccaacactgggagacacgtacaccgagtgcttaactactcctaaaactcggttaccagcaacgaaccgtggaaccaagaccacccgacgggacacctcatttaactagtaacaaaacaacaaacactacctacggaccctacgacccgtacttctacacggtccttaccccgtccggttacggggggacctaaacggtctaccggtccgtacgacgtacttacggtcgtggtcggttacggacgacgtaccgtacggacgggaacggtacgggactaggtaacttacgttacgtacgttacctaccgtttacttacggtttggttacgtgtcgtagttcgtattcggtcggagggacggtacgacgtcgtacgtacgttactacgtacaacggtccgacggtaccgtccgtaccctcgggtaccctaccgttccgttccgtacccctacccgtcccttaccg

SEQ ID NO: 134191 - DNA, 685 bp, Homo sapiens
  misc_feature: GYAE6OF02FHTVP.17.33.C11.1.454.CMB.1.raw
  modified_base (223)..(223): a, c, t, g, unknown or other
  misc_feature (223)..(223): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcactgtgcttccaacnctggagcagtcaccagtgcttactataccaaactcggttccagcagtaaacctggacaagccaccgaggcactctattatagtaacaaacaacaaacacctcctacggacccctcgacccgtattccgtcacggtcctccccgtccggttacgggggaccaaacggtcctacgaccctagacctacgttcgtacgtggtcgtcgcgacgtccgtaggaacggacggacggtactagtaaccttagttaccgtacggtacccttaaccgttcctttaacggttttcgggttacggttcgtcgttacggtcgtcgtttacggttccggggaccgggaagggtaccctaacggcccgttacggtacccgttacgttaaccgtaccgtaaccggtacccggtaaggtcccgtacccggtccccgttacggtcctacccgttccgttcccgttcccccggtaccccc

SEQ ID NO: 134192 - DNA, 677 bp, Homo sapiens
  misc_feature: GYAE6OF02JDU8G.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgctttaccaacactggagacagtccaacctagtcgacttaacctataccaaacttacggttccaagtaccaagaaacctggaacaagaccacccgagggaccactacgtatttataacgtaacaaacaaacaaacactcctacgaccctacgaccccgtatcctacaacggcctaccctccgttacgggggactaaaacgtcgtacgtccctagacccaagttcgtcgtggtcgtgacacgcctaggaacggacgaaggctacgaactacgttaactcggtacctactcgttacgtttaggtcggttcgtcgttgtagtcttaacgttcgggtaccgggagggtaacccgaaagtccgttacggtaccttacgtttaacggaccgtaacgacccgtaacggccttacccgacccccgtttcggtaacccttccttacccgttaccgtttaccccttaaccccg

SEQ ID NO: 134193 - DNA, 778 bp, Homo sapiens
  misc_feature: GYAE6OF02J1U5Y.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggcgccctcactgactgtcgtccccagggagggacagtccactcctccgacctgtcgccttaccaacctcgtgggacacggactaccaccaggttctctttaacctacttacccgaaacgttcggttaccacggacaacggtaaaccgtcggaaacgacgacccacccggacggactacctctaagttttacaacggtaaaccaaaccgaaaccgaaacctccctacccgttacggacccccgtacgtaccccgtaattcccttacggacccggtccctttccccggtccgggttacggggaccgtaaacggtctaccgtccccgttacgaaccttacggtcgttcgtacgggttcggaacgcgtaccgtcggttaccggagggaacggttacggcccttagtaaccgttacgttacgtccggttaccctacgtttcgttaacgggtttcggtaggtttctccggttagtacggttccgttacgggttacgggaaccgggaaccggtaccgtaccggttacgtaccggtacgtttacgttaaccggacctacgacccggtacgtcgccccgttacccggtccgtactccgttaccgttcccggtcccttcccg

SEQ ID NO: 134194 - DNA, 676 bp, Homo sapiens
  misc_feature: GYAE6OF02HHDJ4.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgtcttactactacctaaacttcggttccagacaacgaaaccgtggaacaacgccacccgagggcactactatttataagtaacaaaacaacaaacactaccgtcgaccctcgcccgtatctcgacgcctcccgtcgttggggacaaacgcgtcgcctgacacgtcgtcgtggtcgtgcacgcgtaggacggacgacggcgtacgtaacttattaccgtacgtacctttaccgtctttacgtttggtacggttcggtcgttggttcgttaccgttaacggttccggggacggggtaacgggtaacccgtaacggtccgttaccggtaccgttaacgtttaacggtacccgtaaccggtacccgtaacggtcccgtacccggtcccccggttccggtaccgtacccgtttccgttcccgttacccccgttacccccg

SEQ ID NO: 134195 - DNA, 648 bp, Homo sapiens
  misc_feature: GYAE6OF02FUJ2H.17.33.C11.1.454.CMB.1.raw
  modified_base (226)..(226): a, c, t, g, unknown or other
  misc_feature (226)..(226): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagccaccgagggcactcatttatagtacaaacaacaaacactcctacggacccctgacccgtattctcgacggcctcccgtcggttcggggacaacgactcgccctcgactacgtcgtcctggtcgtagcacgtcctggagggacgcggtctagtacttatactcgtaccttactctttacgtttgggtggtcgtcgtgttcgtacgtacggttcgggacgggtacgggtaaccgaacgtccgttacgtacccgttacgtttaacgtccgaaccggtaacccgtaacgggtcccgttacccgtcccccgttaccgggttaccctaccgtttcccgttacccggttcccccttacccgttccccgtttaccccg

SEQ ID NO: 134196 - DNA, 521 bp, Homo sapiens
  misc_feature: GYAE6OF02JH0PJ.17.33.C11.1.454.CMB.1.raw
  modified_base (330)..(330): a, c, t, g, unknown or other
  misc_feature (330)..(330): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctncccgatctcagctccctccttggggcaaagctgccctgacactgtctggtgtgcagcctgaggacgaggctgactattactgcctactctactttggagtgcttgtgctattcggcggagggtaccaaggctagaccgtcttagtcagcccaaggctcgcccctcgtcactccgtcgtcccaccctcctcc

SEQ ID NO: 134197 - DNA, 663 bp, Homo sapiens
  misc_feature: GYAE6OF02GY4BT.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggacgcagtcaccagtgcttactatccaaactggttccagcacgaactgacaacgcacccagggcactctattatagtacaaacaaacaaacactacctcggaccctcgcccgattctcacgcctccctcgttcggggacaaagctcgcctgacactcgtctgggtgtcgcgagtccgtaggtacgggaccgagggtcctaggaaccgttaacgttaacgttacgtacccgttaccgttcctttacggttttcgggtagggttcggtccgttggttcgtaccgtttacgttccgggtaccggggtaacggggtaacccgaaacggtccgtacggtacccgttacgtttaacgtccggtaacggaccccgtaaacggtcccgtaccgtcccccgtaccgggtaccttaccgtccgtttcccgttacccttaccccccg

SEQ ID NO: 134198 - DNA, 722 bp, Homo sapiens
  misc_feature: GYAE6OF02FQ2TI.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaaattctcagactgtggtgactcaggagccctcactgactgtgtccccaggagggacagtcactctcacctgtcgcttccaacactggagcagtcaccagtgcttactataccaaactgtccagcaacgaaacctggacaagcacccgaggcactctatttatagtaacaaacaacaaactacctcctacggacccctcgacccgtacttctacacggtacctccccgttcggtacgggggacaaacgtcgtcgccctacgaactacgtcgttacgtgggtcgtcgacgtgtcccgtaggtacgggacggacggtcgtacgtaaacctttacgtttaacgtccgtaccgtttaaccgttaccgtttacggttttacgggtcgggttacgtcgttaggttcgcgtttaacgggttccggggacggggtaacgggaacccgtaacggaccgttaccgtaaccgtttacgtttaacggtccgtaccgggtaacccgtaaccgggtcccgttacccggtccccccgttacgggttccctaccggttccgttaccccgttcccccttaccccgttcccttaaccccgg

SEQ ID NO: 134199 - DNA, 649 bp, Homo sapiens
  misc_feature: GYAE6OF02IO1I7.17.33.C11.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (265)..(265): a, c, t, g, unknown or other
  misc_feature (265)..(265): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtnctactatccaaactgttccagcanaacctgacagcaccaggcactcattatagtacaaacaaacaaacactacctcgaccctgcccattctcacggtcctcccgtccgttcgggggacaaacgctagcccgtcgacctacgtcgtcttagggtcgtggtccgacggccgtaggagggtaaccgtaaggctaggaacttacgttactcgtacctaccttcgttaacgtttcggtgggtagtcgttggttcggtacgtttacggttcggggaccgggaacggggtaacccgtaaaggccgttacggacccgttacggtttaaccgttcgaaccggcccgtaaacggtcccgtaccggtccccccgttacggttccctaaccgtttccgttaccccgttccccgtcccccg

SEQ ID NO: 134200 - DNA, 927 bp, Homo sapiens
  misc_feature: GYAE6OF02IYDK9.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgccttccaacactggacgcagtccaccagtcgtacctttaactactaccgtaaacgttcggttccaagaccaacggtaaaacccgttgggaaccaaacggcccaaccccggaacgggggtcctaaccttaccttaattttaacgtaacggttaaaaccaaaaaccaaaacctaaaacctaaccgttacccgtaccgggtaaccccccgtacggtaccccgtaactttcccgtacccgtaacgggtaccccttcccccggttaccggtttacgggggggaccgtaaaaccggtcgttaccggtaccccgtacgtaacccgtaacgttcgggttccgtttaggggttcggtacggtcccgtaaccgggtcccgttaggggaaaccgggggtacgggtaacggggttacccttacgggttaaacctttaaccggtttaacccgttaccgggttaacccctttaaccgtttaccggtttttacccggttttaacggggttcgggtttaacgtcggtttcggttacggttaccgtttacgggttaccggggtacggggaaccgggtaaccgtaacggtacgttaccggtaacccggtttaccgtttaaggcccgtaacccggtccggttaaccggtaccgttcccggtaacccccgttcggtacccgttaccgttccgttaccccgggtttcccccttaccccggtttcccgttaaccccgg

SEQ ID NO: 134201 - DNA, 786 bp, Homo sapiens
  misc_feature: GYAE6OF02HKAQ9.17.33.C11.1.454.CMB.1.raw
  modified_base (173)..(173): a, c, t, g, unknown or other
  misc_feature (173)..(173): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctnactgactgtcgtccccgaggagggacagtcactctcacctgtgccttaccaacacgtggacgcaacgtccaccagtgcttactactccaaactggttaccagcaacgaaaccgtggaacaacgccaccgagggcacgtctattatagtaacaaacaacaaacactacctcgaccctcgacctatctcgacggcctcccgtcgttacggggacaaacgcgtacgccctagaccgtacgtcgtacgtcggtcgtgccgtacggtccgttacggaacgggtaaccggtacggtaccgttacggtaaccgtttaacgtttaaccgttaccggttaccccgtttaaccgtttacccgtttaaacggtttttcggggttacgggtttaccggttaccgtttacgggttcggttaccgtttaacgggttttacccgggggaaccggggttaaccggggtaaacccgaaacggttccggttaaccggtacccggtttaacggtttaaccgggtaaccggtaacccggtaacccggtaaacgggtcccggttacccggtcccccggttaccggttacccgttaacccgtttccgttaccccggttccccccgttacccccgg

SEQ ID NO: 134202 - DNA, 624 bp, Homo sapiens
  misc_feature: GYAE6OF02GP00F.17.33.C11.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (387)..(387): a, c, t, g, unknown or other
  misc_feature (387)..(387): n is a, c, g, or t
  modified_base (413)..(413): a, c, t, g, unknown or other
  misc_feature (413)..(413): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactggtggtcgactcgaggacgccctcactgactggtcgtcccagggagggacngtcactctcactgtcgtccttccaacnctggacgctacgtcaccagtgcctttactatacctaaactcggttaccagtacgaagaaaccgtggaaccgaacgaccgacccgacggggactacgtacttaatttaactaacgtaacaaaacaaactaaacacctaccgtacgaccctcgcctatcncacgctccgtcgtgggacaacgctcncagctactcgtcgtggtcgcgctacgcgtaggacggacgaggctcgtactaattcgacgtacttcgtcttacgtttgtcgtcgtcgtgtcgtcgttcgtcggacggacggaccgacgtctacggtcgttacgttacgcgtaccggaccgacgtccgtaccggcccgttcgtcctacgttccgtttacccggtccctacccgtccttacccg

SEQ ID NO: 134203 - DNA, 634 bp, Homo sapiens
  misc_feature: GYAE6OF02JXSRP.17.33.C11.1.454.CMB.1.raw
  modified_base (215)..(215): a, c, t, g, unknown or other
  misc_feature (215)..(215): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (360)..(360): a, c, t, g, unknown or other
  misc_feature (360)..(360): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccagggaggacagtcactctcacctgngtctccaacactggagcagtccacagtgaccttactactaccaacgtcggtcaacaccgaanaaccgtaggaacagcaacccgnggccactctattaanacgtaaacaaaccaaacaacacctccgacgacccctcgcctatccncacgtcctcccgtcggtcgggacaacgctacgccnctacncgtgtcgtggtcgtgccgtacgcgacggacggtacggcgtacgtacgtactacgtacgttccgtaccttaccgttcgttacgttggtgttcgtcgtcgtagttactcggttcggaccgggtaacggaccgtacgtaccgtacgtaccgttacttacggtccgtaacgtcccgtaacggtccctcccggtaccccgtccgttccgtaccttcgttccccggtaccccgttccccg

SEQ ID NO: 134204 - DNA, 752 bp, Homo sapiens
  misc_feature: GYAE6OF02FK7C3.17.33.C11.1.454.CMB.1.raw
  modified_base (222)..(222): a, c, t, g, unknown or other
  misc_feature (222)..(222): n is a, c, g, or t
tcagcgtagactagcacgaccggtgctcgatttagagtgagctcgttgggtttggggggcgccaggggtcccttccaatatcagcaccatgggcctggactcctctctttctgttcctctcacttgctgcccagggtccaattctcagactgtggtgactcaggagccctcactgactgtgtccccagggagggacagtcactctcacctgtgcttccaacnctggagccagtccacagtgcttacatccaaactggttccagctagaaaccgtggacaaggtcaccgagggcactcgtattatagtacaaacaacaaacactcctacggaccctgaccctatctacgacgtcctaccccgtccggttcgggggaccaaacgtcctacgtaccctgtaccgtaccgttcgtccggttaggttggtacggaccgtacggtacccgtacggtaacggggaaccgggtagggtaccgtacgggtaacgttaacgttacccgttaccgtaccctttaacgttaccctttacggttttacggggtcgggttcggtccggtttcggtcgttacggttacggttccgggggtacggtaccggggaaccgtaacggtccgttaaccggttaccggttacctttaacggccgtaaccgggaccctaaaccgggtccgtaccccgtacccccggttcggtacccttaccggtttacccgttaccccgtttaccccccgttaccccgtcccctttaaccccgg

SEQ ID NO: 134205 - DNA, 631 bp, Homo sapiens
  misc_feature: GYAE6OF02HDJMA.17.33.C11.1.454.CMB.1.raw
  modified_base (230)..(230): a, c, t, g, unknown or other
  misc_feature (230)..(230): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccaggagggacagtcactctcacctgtgcttccaacactggancagtcaccagtgcttactactaccaaacgtggttaccagacaacgaaacctggaacaacgccaccgagggcactctatttanagtaacaaacaacaaacactccgtacgaccctcgaccctattccncgacggcctccctcgttcggggacaacgctcgcctgacactcgtacgtggtcgtgcgacgcgtaggacggacgaggtctagtaacttattacgtcgtaccgttacctacgtttacgtttggtcggttcgtcgttaggttcgtacgttaggttccgggacgggtaacgggacctaacggtcgttacggtaccgttagttaaccgtcgaccggtacccgaacggtccgtaccgtccccgtcggtacctaccgttccgttaccgttcccctaccccg

SEQ ID NO: 134206 - DNA, 698 bp, Homo sapiens
  misc_feature: GYAE6OF02IQ2H8.17.33.C11.1.454.CMB.1.raw
  modified_base (169)..(169): a, c, t, g, unknown or other
  misc_feature (169)..(169): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (672)..(672): a, c, t, g, unknown or other
  misc_feature (672)..(672): n is a, c, g, or t
tcagcgtagactagcacgaccggtgctcgatttagagtgagctcgttgggtttgggggctggcgccaggggtcccttcaatatcagcaccatggcctggactcctctctttctgttcctcctcacttgctgcccagggtccaattctcagactgtggtgactcaggacnccctcactgactggtcgtcccgagggacgggacagtcacttctcacctgtcgcttaccaactcgtggacncagtccacctagtnacttactactaccgaaacttcggttaccagacaacgaaacgtaggacaacgccaaccgaggacactactaatttagtaacgtaacaaaacaaacaaactactaccgtaccggaccctcgacccgtacttcgtacacggtcctcccgtcggttacggggactaaacggctcggcctagacctacgtcgtcggtgtcgtcgctagtccgaggtaggacggtaggtactacgtaacgttactttccgacgttacttaccgtttaccgtttacgtttgggtacggttcgtcggttaggttcgttaccgttacggtttcggggacccggggtaacgggacccggtaagtccggttaccggtacgttacgttaacggacgacccggaccgaaccgttccggtacccgtccccgtacggttacccncgttaccgttccccgtcccgtacccc

SEQ ID NO: 134207 - DNA, 731 bp, Homo sapiens
  misc_feature: GYAE6OF02G42O0.17.33.C11.1.454.CMB.1.raw
  modified_base (143)..(143): a, c, t, g, unknown or other
  misc_feature (143)..(143): n is a, c, g, or t
  modified_base (418)..(418): a, c, t, g, unknown or other
  misc_feature (418)..(418): n is a, c, g, or t
  modified_base (457)..(457): a, c, t, g, unknown or other
  misc_feature (457)..(457): n is a, c, g, or t
  modified_base (681)..(681): a, c, t, g, unknown or other
  misc_feature (681)..(681): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccaggtcaattcncagactggtggtcgactcgagggacgccctcacgtgactgtcgtaccccgagggacggacagtcactcctcaccgtgtacgtccttccaaagttaccgtggacgctacgtaccgaacctagttcgtaccttaactacgtacccgtaaaacgtcggtaccgagacgtaacgaacgtaggacaacgcgaaccggtacggctactacgtatttaacaacgtaaaccaaaacaaaacaacctccgtaccgtaccgaaccccgtcgaccgttacttaccncgtaccggtcctacccgttcggtacggggaacaacgtcnccgactgacctacgtgtcgtggtcgtcgcgacgtcgaggtaacgggcgacgtactagtacgttacgttactcgtaccttaccgtttacgttcggtttcggtacggttgtaccggtgttccggtaacgttttccggggtaccgggtaccgggtaacgggtaacacgggttcgtaccgttacggtacgttacgcgacccgccgtacgtacccgtcccggttacccngttacccggtactttcccgtccccgttaaccccttccgaccccgttacgg

SEQ ID NO: 134208 - DNA, 809 bp, Homo sapiens
  misc_feature: GYAE6OF02IOD0B.17.33.C11.1.454.CMB.1.raw
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcgaggagccctcactgactgtcgtcccaggaggacagtcacgtctcacctgtcgtccttacgaacacgtaggacgctacgtacacctaggtgtaccttactactacctaaacgttcggttaccacgacaacgtaaccgtacggaacaagccaacccgagggaccaccgtacttaacgttttaacgaacgttaaaaccaaaaccaaaaccgaaacgtaacctcccgtacgaaccccgtacgtacctaacgttcctacgaccggtaccttccccgttacgggtacggggactaacgtaccgtccgtacccgtacgaccgtacttcggtcgttgggtacgtacggaccgtaacggtccgtacgggaacggtaccggtaacggttccgtaaccggttaacttaccgtttaccgtaccgtccccgttaacgttttacccgttacgggttttcgggtacggtacggttccggttacggttaccgttaaccggtttcggttacccgggggtaaccggggtaaacggttaaccgaaaccggtcgttaccgtaccggtttacctttacgggaaccgtacggacccgtaacggtccgtacccggtttacccgtcccgtacgttcccggtttaccttaccccgtcccgttaaccccg

SEQ ID NO: 134209 - DNA, 272 bp, Homo sapiens
  misc_feature: GYAE6OF02FHI1X.17.33.C11.1.454.CMB.1.raw
  modified_base (245)..(245): a, c, t, g, unknown or other
  misc_feature (245)..(245): n is a, c, g, or t
  modified_base (250)..(272): a, c, t, g, unknown or other
  misc_feature (250)..(272): n is a, c, g, or t
tcagcgtagactagcacgaccggtgctcgatttagagtgagctcgttgggtttggggagttattagtccctactttgactactgggccagggaactctggtcaccgtctccgcagcctccaccaaggcccatccggtccttcccccctggccacccctcctccaagagcacctcgtggggcacagcggccctggctgcctggtcaaggactactccctagtcctacgctgagcggctggcaggcncatgnnnnnnnnnnnnnnnnnnnnnnn

SEQ ID NO: 134210 - DNA, 878 bp, Homo sapiens
  misc_feature: GYAE6OF02JJJ04.17.33.C11.1.454.CMB.1.raw
  modified_base (220)..(220): a, c, t, g, unknown or other
  misc_feature (220)..(220): n is a, c, g, or t
  modified_base (317)..(317): a, c, t, g, unknown or other
  misc_feature (317)..(317): n is a, c, g, or t
tcagcgtagactagcacgaccggtgctcgatttagagtgagctcgttgggtttgggggcgccaggggtcccttccaatatcagcaccatgggcctggactcctctctttctgttcctcctcacttgctgcccagggtccaattctcagactgtggtgactcaggagccctcactgctgtcgtcccaggaggacagtcactctcacgtgtcgcttaccaanacgtggacgtcagtccaccgagtcgacttaactacgtaccaaacgttcggttccagtacaacgtaaacctggacaagccaccgaggcactctattanacgtaacaacaaaacgtaacacctccgtacggaaccctcgaccgtacttccgtaccgacggtccctaccgttccggttacggggactaaaccgtccgttacggacccgttaggaaccttaccgttggtaccggttcgggttcgacggtacccgtacggtaccggttagggaacgggtaaccgggtacggtaccgttaggttaaccttaacgtttacccgtacgggttacccttaaccgtttaaccggtttacggttttcggggtacggttaaccggttccgttcgggtttaaccggtaccgttttaacggggtttaccgggggtaaccgggggtaaaccgggtaacccggttaaaccgtacccggggttaaccgttaaccccggggttttaaccgtttaaccgggcccggttaaaacccggggtacccccggtttaaacgggtcccggtttacccccggtaaaccccccggtttcgggttaacccccgtttaccgtttacccccgggtttccccggtttaaccccccccgtttaacccggttcccccgtttaaccccgggg

SEQ ID NO: 134211 - DNA, 677 bp, Homo sapiens
  misc_feature: GYAE6OF02HAQ8P.17.33.C11.1.454.CMB.1.raw
  modified_base (311)..(311): a, c, t, g, unknown or other
  misc_feature (311)..(311): n is a, c, g, or t
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgccttaccaacacgtggacgcagtccaccagtgcttactataccaaacgtggttccagcaagaaacctggaacaagccacccagggcactctatttanagtacaaaacaacaaacactcctcggacccctcgacccgtattcctcgacggcctcccgtccggttcgggggacaaacggctcgccctagactacgtgtctggtgtcgccacgcctaggacgggacggaggcctgtaacttattacctcgtacccttacttccgtttacgtttgggttacgtcggtcgttagttcgtaccgtttaggttccgggacgggtacgggaacctaacgggtccgtacggtacccgttacgttacggttaccgtaccggtacccgtaacgggtccgtacccggtcccccgttacggtacccttaccgttcccgtttacccggttcccccttaccccgttcccgttaccccg

SEQ ID NO: 134212 - DNA, 729 bp, Homo sapiens
  misc_feature: GYAE6OF02JCOI6.17.33.C11.1.454.CMB.1.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacncgtggancacgtccaccagtgcttactactccaaactcggttccagccagaaacctggacagcaccgaggcacgtcatttatacgtaacaaacaacaacactacctcggacccctgacccctattctacacggtcctacccgtccggttacggggtacaaacggcctcgtacccctacgacgtactacggtccgtgggttcggtacgtaccgtacgtaccgtacggtaagggtaccggtaacggtccgtaaggtaacctttaacgtttaaccgttacggtcccgttaaccttaccgtttacggtttacgggttcgggttcggtaccgtacgggttcgtaccgttacggtttcggggaaccgggtacgggtaacccgtaaacgtccgtacggttacccgttacgtttaaccggtacgtaaccggtacccgtaacgggtcccgttacccggtaccccccgttaccggttacctaccgtttacccgttccccgttccccgttacccccg

SEQ ID NO: 134213 - DNA, 664 bp, Homo sapiens
  misc_feature: GYAE6OF02FRFCK.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacacgtggagcagtccaccagtgcttactactaccaaactcggttaccagcaacgaaaacctggacaagccaccgagggcactctatttatagtaacaaacaacaaacactacctcgacccctcgccgtacttctacacgcctccctccggttagggggacaaacgtcgtcgtcctcgacctacgtcgtcgtggtacgtcgacgacgccgtaggacgggacgacgggtcgtacgtacgttacttactcggtaccttacgtcctttacgtttcggtggtcgtcgttgtcgtcgttacgttcgggacgggaacgggtacaacgtccgtacggtaccgttacgttaacgtacgacggtacccgtaacggtcccgttcccggtcccccgttaccggtacccgtaccttcccgttacccggtttccccctaccccgttcccgttaccccgg

SEQ ID NO: 134214 - DNA, 725 bp, Homo sapiens
  misc_feature: GYAE6OF02HG7CJ.17.33.C11.1.454.CMB.1.raw
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtcgcttaccaacacgtggagcagtcaccgagtgtacttactactacctaaacgttcggttaccagacaacgaaaccgtacggaacaacgccaacccgacgggcaccgttactatttagtaacgtaaccaaaacaaaccaaaacctacctaccgtaccggaccctcgaccccgtacttcctcgacgtccctcccgttccggttcggggacaaacgtcgtccgccctacgaccgtacgttcgtacgttcggtcgtcgcgtacgtccgtaggacggacggtaggcgtacgtaacttacgttacgtactaccttacttaccgtttacgtttgggtacggttcgtcgttagttcggtcgttacgggtccgggaggtaccgggtaacgtaacggtccgttaccggtacccgttagttaaccggtaccgaccggtaacccggtaccggtcccggtacccgttcccccgtaccggttaccctcccgtttacccgttaccccgttacccccgttacccccg

SEQ ID NO: 134215 - DNA, 829 bp, Homo sapiens
  misc_feature: GYAE6OF02HRL2H.17.33.C11.1.454.CMB.1.raw
  modified_base (173)..(173): a, c, t, g, unknown or other
  misc_feature (173)..(173): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctnactgactgtcgtccccgaggagggacagtcactctcacctgtgtcttaccaacacgtggagcacgtcaccagtgcttactataccaaacttcggtaccagcaacgaaacctggaacaacgccaaccggtaggacactacgtaattttacgaagtaaccaaacaaaccaaaccgtacttaccgaccggtaacccctacgtacccgtaattcctaacgacggtaccctcccgttcggttacgggggacctaaaacgccgtacgaccctacggtaacctacgttcggtcgtttacgggtcgtacggtaccctacggtacccgtggaacgggaaccgggtacggtaccgttacggtaaccttaacgttaccgttacggttacccttaacctttaccggttaacgttttacggggtacgggtttcgtacggtttacggtacggttacgttacgggtttaccggggaccggggtaaaccgggtaacccggtaaaaggttccgttaaccgggtaacccgttttaacggttttaaaccggtaccgtaacccgggtaaaccccgtaacgggttaccccgttacccccggttaacccccggttccggggtttaaccctaccccggtttacccggttttaccccggttccccccgtttacccccccg

SEQ ID NO: 134216 - DNA, 607 bp, Homo sapiens
  misc_feature: GYAE6OF02FZ5X0.17.33.C11.1.454.CMB.1.raw
  modified_base (239)..(239): a, c, t, g, unknown or other
  misc_feature (239)..(239): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (404)..(404): a, c, t, g, unknown or other
  misc_feature (404)..(404): n is a, c, g, or t
tcagcgtagactagcacgaccggtgctcgatttagagtgagctcgttgggtttggggggcgccaggggtcccttccaatatcagcaccatggcctggactcctctctttctgtcctcctcacttgctgcccagggtccaattctcagactgtggtgactcaggagccctcactgactgtgtccccaggagggacagtcactctcacctgtgcttccaacacgtgagcagtcaccaggtncttactatcctaaactggttccagcaagaaacctggacaagctaccagggacactcatttatagtacaaacaacaaacactaccngaccctncccgattctcaggctccctcgttggggcaaagctgcctgacatcgtcgtggtgtagcacgcctgacggacggnggctagactattacagttcctactcttacgttggttacggtcgtacgtgttcgacgttcgttaccgggacgggtacgggaaccgtaacgccgttaggtaacccgttactttaacggttccaacgggtaccccgaaaggtccgtacccgtccccgtacggttccaccgttccgtccgtttccccaccccgtttaccttacccgg

SEQ ID NO: 134217 - DNA, 715 bp, Homo sapiens
  misc_feature: GYAE6OF02J0XWL.17.33.C11.1.454.CMB.1.raw
  modified_base (211)..(211): a, c, t, g, unknown or other
  misc_feature (211)..(211): n is a, c, g, or t
  modified_base (288)..(288): a, c, t, g, unknown or other
  misc_feature (288)..(288): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtncttccaacactggagcacgtcaccaggtcgcttactaatccaaactggttccacgcagaaacctggacaagcacccngggccactctattatagtacaaacaacaaacaactccgtacgacccctacgcccgtacttcctcgacggtacctccccttaccgttagggggaccaaacggtacgtacggtacccttaccgacctaacgttcggttccgtcggggtacgtcggtcgaacgtcgttacggacggtaacggacggtccgtaaggtaccgttaactttaacgtcgtacccttaccgtttaccgttaacgttttcgggtccggtacggttcgttcgttcggttcttacggttccggggtaacggggtaaccgggtaaccgtaacggtacccgttacggtacccgttacgttaccgtctaaccgggacccgtaacggtccgtaccgtacccccgtcggtacctaccggttcctcggtttcccccgtcccgtccccttaccgg

SEQ ID NO: 134218 - DNA, 574 bp, Homo sapiens
  misc_feature: GYAE6OF02FRW3D.17.33.C11.1.454.CMB.1.raw
  modified_base (229)..(229): a, c, t, g, unknown or other
  misc_feature (229)..(229): n is a, c, g, or t
  modified_base (392)..(392): a, c, t, g, unknown or other
  misc_feature (392)..(392): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcagaaacctggacaagcacccagggcactcatttatatacaaacaacaaacactcctacggacccctcgcccgattctcacggcctcctccgttgggggcaaagctacgccctagacactgtctggtntgcacgcctggaggacgaggtctgtactattactcgaccttacttcttacgtttggtggtgcttgtcgcttagttcgggacggtacgggacctaagcctaggtaccgttacttaacgtcgacgcccgaaggtcctaccggtcccccgttaggtcctaaccgtcgttccgttccccgtccccg

SEQ ID NO: 134219 - DNA, 590 bp, Homo sapiens
  misc_feature: GYAE6OF02FT9BG.17.33.C11.1.454.CMB.1.raw
  modified_base (170)..(170): a, c, t, g, unknown or other
  misc_feature (170)..(170): n is a, c, g, or t
  modified_base (295)..(295): a, c, t, g, unknown or other
  misc_feature (295)..(295): n is a, c, g, or t
  modified_base (334)..(334): a, c, t, g, unknown or other
  misc_feature (334)..(334): n is a, c, g, or t
  modified_base (384)..(384): a, c, t, g, unknown or other
  misc_feature (384)..(384): n is a, c, g, or t
  modified_base (404)..(404): a, c, t, g, unknown or other
  misc_feature (404)..(404): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctnactgactgtgtccccaggaggacagtcactctcacctgtgcttccaacactggagcagtcaccagtgcttactatccaaactggttccagcaagaaacctggacaagcaccgaggcactcattanagtacaaacaacaacactcgacgaccctgcccgtattcncaggcctccgtcgttaggggacaagctcgcctagactacgtgtctggtgngcgagtccgtaggaggacgngctgtactacttacgtcaccttacttcttacgtttgggtgtcgcgtgtcgacttagtcgggacgggtagggaaccaagtcgtacgtaccgttacttacgtccgacggccgaaggtccctaacccggtccccgttacggtaccctaccgttccgttaccggttccccctacccgttcccgttacccg

SEQ ID NO: 134220 - DNA, 660 bp, Homo sapiens
  misc_feature: GYAE6OF02FNN8F.17.33.C11.1.454.CMB.1.raw
  modified_base (336)..(336): a, c, t, g, unknown or other
  misc_feature (336)..(336): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgccttccaactactggacgcagtccaccagtcgcttactactaccaaacgtcggttccagcaagaaacctggaccaagccacccgagggcactctattatagtaacaaacaacaaacactaccncgaccctgccgtattctcacgcctcctccgttcgggggacaaagcgtcgccctacgacacttgtcgtggtgtacgcacgtccgtagggacggacggacggtcgttacgaacgttaattaccgtacggtacccttacgtactttacggtttggtgttcgtcgttgtacgtcgtttaggttccgggacgggtaacgggaccgtaacggtcgtacggtaaccgttccgtttaacggcgtaaccggacccgtaacggtcccgtacccggtccccgttacggttccctaccgttccgttcccgttcccccgtacccttccccgttaccg

SEQ ID NO: 134221 - DNA, 732 bp, Homo sapiens
  misc_feature: GYAE6OF02G97XW.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactaccaaactcggttccagcaacgaaacctcgacaagccaccgagggcactctattatagtaacaaacaacaaacactcctacggaacccctcgacccgtaacttcctaccgacggtacccttccccgttccggttacggggggtacctaaaacggtccgttacggtacccgttacgacctacgttacggtcgttcggttcggtcgtacgacggtccgtaggtaacgggacgtacggtacgtacgtaacgttactttaccgtacgtaccgtttaacgttacccgttttaacgtttgggtcggttagtcgttcggttcgtaccgttaggttccgggtacggggaacggtaacccgtaaacggtccgtaacgtaccgttacgttacggtactaccggtaccgtaacggtccgtaacccggtcccccgttacggttaccctaccgttaccgtttacccggtttaccccctacccgttcccttaacccgg

SEQ ID NO: 134222 - DNA, 842 bp, Homo sapiens
  misc_feature: GYAE6OF02GHHIN.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggaggacagtcactctcacctgtcgcttccaacacgtggagcagtcaccagtgcttactagtacctaaacttcggttaccagcaacgtaaaccgtggaacaagcaccccgagggcactctatttactagaacaaacaacaaacctactccgtacggtacccctcgacccgtattccgtccgacggtcccttcccggttaccgggttacgggggaacctaaacgtccgttaccggtacccctacggtaacctacccggttggttcccggtagggttggttacgggtaccctacggttaccgtacgggtaacggggtaaccggaacgggtccggttaacgtaaaccggtttaacgtttaaccgtaccggttaccccttttaacccgttaccgttttaccgttttacggggttgggtttcggtaacctttcggggttaccgtttaccgttacgggtttaccggggaccgggttaacgggaacccggtaacggttacccggtaaccggtttacccggtttaccgtttaaaccggtacccggtaaccgtaaccccggggtaaccggttcccggttacccccggacccccggtttacccgggttcccgtaacccgttttccccggttaccccggtttaccccccggtttcccccccg

SEQ ID NO: 134223 - DNA, 561 bp, Homo sapiens
  misc_feature: GYAE6OF02GZCR6.17.33.C11.1.454.CMB.1.raw
  modified_base (299)..(299): a, c, t, g, unknown or other
  misc_feature (299)..(299): n is a, c, g, or t
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtgtccccaggaggacagtcactctcacctgtgcttccaacactggagcagtcaccagtgcttactatccaaactggttccagcagaaacctggacaagcacccaggcactcatttanagtacaaacaacaaacactcctacggacccctgcccgtatctcaggcctccctcgttcggggacaaagctcgccctgacnctgtcgtgtgtagcagcctggagacgngctgactagtactcgtacctactcttacgtttggtggttcgtctgtcgcgttacgttcgggcgggaggaccaagcgtacgtaccgttcttaacggtcaacgcccgaacggtcctccggccccttcggtccctactccgttccgttcccgtccccg

SEQ ID NO: 134224 - DNA, 624 bp, Homo sapiens
  misc_feature: GYAE6OF02HL13E.17.33.C11.1.454.CMB.1.raw
  modified_base (351)..(351): a, c, t, g, unknown or other
  misc_feature (351)..(351): n is a, c, g, or t
  modified_base (385)..(385): a, c, t, g, unknown or other
  misc_feature (385)..(385): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactcctcacctgtgcttccaacactggagcagtcaccagtgcttactataccaaactggttccagcaacgaaacctggacaagccaaccgagggcactctatttatagtaacaaacaacaaacactacctcggaccctcgccgtattcncacgcctcctccgttggggcaagctcgcctgacnctgtcgtggtgtgctacgccgtggaggacggagctagtacttattacgtcgtcctaccttcttacgtttggtggttgtcgttgtcgtcgttacggtccgggtacgggtacgggtaccgaacggtcgtaccggtaccgtttacgttacggttaccgaaccgacccgtaacgggtcccgtccccgtcccccggttccggttaccctacccgttacccgttcccggttaccccctacccccg

SEQ ID NO: 134225 - DNA, 858 bp, Homo sapiens
  misc_feature: GYAE6OF02IAUJK.17.33.C11.1.454.CMB.1.raw
  modified_base (172)..(172): a, c, t, g, unknown or other
  misc_feature (172)..(172): n is a, c, g, or t
  modified_base (214)..(214): a, c, t, g, unknown or other
  misc_feature (214)..(214): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccaggtccaattctcagactgtggtgactcaggagccctnactgactgtcgttcccagggaggacagtcactctcacctgtncttccaacactggagcagtccaccagtcgtcttaactactacctaaacgttggttccagccaagtaaaccgtaggaacgaacgacgacccgacgggactaccgtactaacgttttaattaacggtaaaccaaaaccgaaaacctaaaaccgaaccctttacccgtaccccggaacccccgttaccggtacccccgtaacttttaccctaccgtaacggtcccctaccccggtttaccggttaccggggggtaacctaaaacggaccgttaccggtacccgttacggaaccctaacgttcgttaccgttgggttcggttgtacccgacggaccgttacgggacgggaacggtaacgggtccgttaaacggtaaccgtttaacgtttacgttacggttaccccttaaaccgttcctttaaccgggttttgggttaacgggtttcgtcggtttacggttaccggtaccgtttacgggttccggggtaaccgggtaaccggggtaacccgtaaaggttcccgtaggttacccgttaaacgtttaacggtaacctaaccggtaccccggtaaagggtccccgttacccggtcccccgttacgggtcccttaacccggtcccgttttacccgtaccccgttaaccccccg

SEQ ID NO: 134226 - DNA, 790 bp, Homo sapiens
  misc_feature: GYAE6OF02GNCI7.17.33.C11.1.454.CMB.1.raw
  modified_base (517)..(517): a, c, t, g, unknown or other
  misc_feature (517)..(517): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtccccaggaggacagtcactcctccacctgtcgtccttaccaactaccgtggagcctagtccaacctagtcgtacctttaactaactaccctaaacgttcggttaccacgtacaaacggtaaaccgtaggaacaacgacccgaccgaacgggtacctaacctacgttaattttaacgtaactaaaaccaaaaccaaacctaaaacctccgttaccgtaccgaaccccgtacgtaccccgtaacttctaccgacgtcccttacccgttccgggttacgggacctaacgtcctccgtacccctacggacttccgtcgttcgtacggtcgtacncggtaccgtcgtaggacgggacggacgtcgtacggttaactacgtttaccgtaccgtacccgtttacgttacgtttcggttagggttccggtcggtcgttacgttacggttccgttaaggttccggggaacggaaccggtaaacgtcggttacccgtacggtacccgtttacgttaccgtaccggaaccggtacccgtacggtcccgttacccggccccggttttccgtaaccgttcccggtttccccgttcccggttaccccccgtttcccg

SEQ ID NO: 134227 - DNA, 799 bp, Homo sapiens
  misc_feature: GYAE6OF02JYENG.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtcgccttccaacacgttcggagcagtcaccagtcgacttacgtataccaaacgtcggtttaccacgcgaacgtaaaccgtacgggaacctaacggaccaccccgtaggggaccaacgttacctaacgttttaagtacggttaaacctaaaaccgtaaaccaaaaccgtaacccgttacccgtaccgggttaacccccgtacggtacccccgtaagttttccgaccgttaacgggtcccttaccccgttccgggtttacgggggaacctaaaacggcctttcggaccccgttaggaacccttaacgttcgttaacggttcggttcgggtccgtaccgtacggtcccggttaggacggtaaccggtacggtccgttacggaacgtttaacgttacgtacgttaccgtaaccgtttacgttaacggtttcggttacgggtcgtcgttcggtcggtaccgtttcggttacgggtccgggtaacggtaccgtaacgtcgttacgtaccggttactcggtaactcggaaccctaggtcctaccgtacccgttcggccttaccgtccgtaccggttcccctacctacccgttaccg

SEQ ID NO: 134228 - DNA, 849 bp, Homo sapiens
  misc_feature: GYAE6OF02GEYFT.17.33.C11.1.454.CMB.1.raw
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggacgccctcactgactgtcgtccccagggagggacagtcactctcaccttgtgccttaccaactacgtggacgctagtcaccgagttcgcctttactactaccaaaacgttcggtttccagcaacgaaaccgtggaaccgaaagccaaccccgaggggaccaacctactagtttataacggtaactaaaacaaacaaacctaacctcccgtacggtaccccctcggaccccgtacttaccgttacgacggtcccttccccgttccggtttacggggggaccttaaaacgcccgttacgcccccggttagaaccctaccgttcggttcgttcgggggtttcgttcggacctacggtaccgttacgggaacggggtaaccgggaggttcccgttaggaaccctttacgtttacgttacgcccttaaaccgtttcccgtttaacggtttttcgggtacgggtttcggttaccgtttcgggttaccgggttacctttacgggtttcccgggggtaaccggggtaaccgggttaacccgtaagggtaccgttaccggttaacccgttttaccggtttaacggtaccgtaaccggaccccggtaaacgggttcccttaccccgggtacccccgtttccgggtacccttacccgttacccggtttcccgggttaccccccttccccccgg

SEQ ID NO: 134229 - DNA, 681 bp, Homo sapiens
  misc_feature: GYAE6OF02I7Q10.17.33.C11.1.454.CMB.1.raw
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggacgcagtcaccagtcgcttactataccaaactggttccagacaacgaaacctggacaagcacccgaggcactctatttanagtaacaaacaacaaacactccgtacggacccctcggacctattccncgacgtcctccctcggtggggacaagtcncggcctgactactggtctggtgtcgacgacgtcctaggacgggtacgacggtctacgaacttacgttaacgtcggtacccttacttaccgtttaccggtttgggtcggttacgtcgttacgttcggtaccgtttacggttaccggggccgggtaacggtaaccggtaacggtaccgttaccggtaccggttttaaccgttaacggttcccgtaaccggtacccgaacgggtcccttaacccgggtacccccgttggtacccctacgttccccggttccgttacccccgttaccccg

SEQ ID NO: 134230 - DNA, 702 bp, Homo sapiens
  misc_feature: GYAE6OF02JEHPH.17.33.C11.1.454.CMB.1.raw
  modified_base (481)..(481): a, c, t, g, unknown or other
  misc_feature (481)..(481): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccaggtccaattctcagactgtggtgactcaggagccctcactgactgtgtccccaggaggacagtcactctcacctgtgcttaccaacactggagcagtcaccgagtcgacttactactaccaaacgttcggttaccagacacgaaaccgtaggacaacgccacccgacgggccactactatttaagtacgtaacaaacaaaccaaacacctccgtccggacccctacgccctattcctacgacggtcctacccgtccgttacgggggacaaacgtcctacgcccgtaggacctacttacgtccgtaggtcgtcgccgacgcgtacggacggacggacgtctagtaactnttaaccgtcgtacccttacttccgttacgtttcggtagtcgtcgtcgttacgtccgtttagggtccggacggggaaccgggtaacgaacggtcgtaccggtaccttacgttacgtccgtaaccggtacccggtaaccggtccgttacccgtcccccgtttacgtacccgttaccgttcccgttaccccggttaccccctaccccgttcccgttaaccccgg

SEQ ID NO: 134231 - DNA, 891 bp, Homo sapiens
  misc_feature: GYAE6OF02JPERL.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgccaggtccaattctcagactgtggtgactcgaggacgccctcacgtgacctgtcgtccccaggagggacagtcactctcactgtgcctcaacactggagcaggtcctaccaggtcgcttactactaccgtaaaacttcgggttacccaggtacctaaacggaaaaccgttcgggaaaaccgaacgccgaaaccccgggttacggacctaacgtttacctaaccgttttaaagtaaccggtaaaaccaaaaccctaaaaccgtaaaaccgttaacctttccccggtaaccgaaaccccccgtttcggaacccccgtttaacgttacccttaacggaccccccggttccttaacccccgttttccggggtttaccgggggaaacctaaacccgggtctttcccggtaaccccggtttacaaacccggttcccggttaacgttccggggtttaacgggttacgtccgtacggaaccggttccggtacgggacggggtaaccggtagggtaccgtaagtacgttaccgttaacgtcccgttaacttaccgtttaccttaggtttaccggtggtacgtcggtttaccggtcgttaaccggttccggtaagggtcccggggtaagtaaacccgggtcggtaaaccgttccggtaccgtttacgtaaccggtacccgtaccgggtaacccggtaacccggttcccggtacccggttcccccggtaagtaccccgttcgtaccccggtttccgtacccccttccccgg

SEQ ID NO: 134232 - DNA, 589 bp, Homo sapiens
  misc_feature: GYAE6OF02HYKWI.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttcaacactggagcagtcaccagtgcttacatccaaactggttcagcagaaacctggacaacgcaccagggcactcatttatagtaacaacaacaaacactacctacgaccctcgaccgtactctcagctcctcgtggggacaagctcgcctgacactcgtcgtagtgtgcgtagccgtgacggacgagcgtagacgtatacgttgtacctactccttaatttggtcggtgtcgtgtcgtctagttccggacggtacgggacctaacgtcgtacgtaccgttaccgttaagtactaccggacccgtaacgggtccctaccggtcccccgttccggtacccgtacccgttaccgttaccgttccccgtacccccg

SEQ ID NO: 134233 - DNA, 861 bp, Homo sapiens
  misc_feature: GYAE6OF02JAFQX.17.33.C11.1.454.CMB.1.raw
  modified_base (306)..(306): a, c, t, g, unknown or other
  misc_feature (306)..(306): n is a, c, g, or t
tcagcgtagactagcacgaccggtgctcgatttagagtgagctcgttggggtttggggctggcgccaggggtcccttccaatatcagcaccatggcctggactcctctctttctgttcctcctcacttgctgcccagggtccaattctcagactgtggtgactcaggacgccctcactgactgtcgtccccagggaggacagtcactctcacctgtgcttccaacactggagcagtcaccagtgcttactactaccaaactggttccagcaacgaaacctggacaagccaccaggcactcatttanagtaacaaacaaacaaacacctccgtacggacccctcgacccgtagttcctacgacggtcccttccccgttccggtttacggggggaacctaaaacggtccgtaccggtccccgtacgaaccctaaccgttggttaccggttgggttacggtacggtaccggtaaccgtacccgtacggggaacggggtaaccggtaggggtaccgttaacggtaaccctttaacgtttaacccggttacggttaccccgttaaccgttttacccgtttaaccgggttttttacgggttcgggtttacggttccgttacgggtttacggttaccgtttaaccgggttttcccgggggtaccgggggtaaaccggggttaacccggtaaaacgggttacccggttaaccgggtaacccggtttaccggttttaaaccgggtaccggtaacccggtaccccggtaaaccgggttccccgttaaccccgggtcccccccggtttaccgggttaccccgttaaccccgtttcccggtttaccccggttaccccccgtttaacccccccg

SEQ ID NO: 134234 - DNA, 625 bp, Homo sapiens
  misc_feature: GYAE6OF02HYCZS.17.33.C11.1.454.CMB.1.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
tcagcgtagactagcacgaccggtgctcgatttagagtgagctcgttgggttgggggcgccaggggtccttccaatatcagcaccatggcctggactcctctctttctgttcctcctcacttgctgcccagggtccaattctcagactgtcggtgactcaggagccctcactgactgtgtccccaggagggacagtcactctcactgtncttccaacnctggancagtcaccagtgcttatatccaaacgtgttccagcagaaacctggacaagcacccgagggcactcacgtttatagttacaaacaacaaacactacctgacccctgcccgtatctacacggctccctcgttcgggggacaagcgtcgccctagactactacgtctaggtcgngcgacgctgaggacgnggtcgtgactatacgtacgtcctaacttctaacgtttggtacggtcgttctggttacgtacgtacgtttcgggtacggacgggtaaccaacgggtcgtacgggtaaccgttcgttaacgttccgaacggtcccgaaacggttccgtaccggtcccccgttacggttcccgaaccgttccgtacccggtttccccggtcccttacccgttacccg

SEQ ID NO: 134235 - DNA, 685 bp, Homo sapiens
  misc_feature: GYAE6OF02JST10.17.33.C11.1.454.CMB.1.raw
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (340)..(340): a, c, t, g, unknown or other
  misc_feature (340)..(340): n is a, c, g, or t
  modified_base (564)..(564): a, c, t, g, unknown or other
  misc_feature (564)..(564): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagtccctcactgactgtgtccccaggagggacagtcactctcacctgngccttcaacacgtggagcngtcaccagtcgcttactacacctaaacttcggttccaagcaacgaaacctggacaacgaccaaccgaggccactactactttaatacgtaaccaaacaacaaaaccncgttacccgtacggaacccctcgacccgtattacctccgaacggtccttccccgttacggtcggggtaactaaacgccgtacggccctaacggaccctacgttacggtcgtagggttcgtcggacgtacggccgttacgggaaccggacggtacggtacccgttagaacccgtttagtaaccgttccgtacctacgttacttaccggtttggacggtcgtcgtntcgtacgtcgtccgggagaccggttaacacgtactaccggtacgttacgttacgccgtaacggccgtaacgccgttcccgacccgtcggtactacccggttccgtacctaccccgtacccg

SEQ ID NO: 134236 - DNA, 657 bp, Homo sapiens
  misc_feature: GYAE6OF02HYRMI.17.33.C11.1.454.CMB.1.raw
  modified_base (225)..(225): a, c, t, g, unknown or other
  misc_feature (225)..(225): n is a, c, g, or t
tcagcgtagactagcacgaccggtgctcgatttagagtgagctcgttggggtttgggggggcgccagggggtcccttccaatatcagcaccatggcctggactcctctctttctgttcctcctcacttgctgcccagggtccaattctcagactgtggtgactcaggagccctcactgactgtcgtcccgaggagggacagtcactctcacctgtgcttaccaanactggagcagtcaccagtcgacttaactactacctaaaacttcggttaccacgacaacgaaaaccgtaggaacaacgacgaacccgaggacacgtactatttaataacgtaacaaacaaacaaacctacctaccgtacgaccctcgacccgtatcctcgacgctcccgtccgtggggacaagcctacgccagactactcgtcgtgtgtcgcgacgtcgtaggacggtacggaggtacgtgtaacttacgttaaccgtcgtaccctacgtttaccgttaacgtttgggttacggtgtacgttgtcgttacgttacgggttcggacgggaacgggaccaacgtcgtacgaaccgttacgttacgtcgacgaccgtacgtaccgcccgtcccgtacgtctacctccgttcccgtacccctaccctaccttacccg

SEQ ID NO: 134237 - DNA, 521 bp, Homo sapiens
  misc_feature: GYAE6OF02F3QAJ.17.33.C11.1.454.CMB.1.raw
  modified_base (381)..(381): a, c, t, g, unknown or other
  misc_feature (381)..(381): n is a, c, g, or t
  modified_base (518)..(518): a, c, t, g, unknown or other
  misc_feature (518)..(518): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctgacccctgcccgattctcagctccctcttggggcaaagctgccctgacactgtctggtntgcagcctgaggacgaggctgactattactgcctactcttactttggtggtcgctgtgcttattcgggcggtaggaccaagctcgaccgtcgttaacgtcagcccaaggctcgcccctcggtccactctcgttcccnccc

SEQ ID NO: 134238 - DNA, 531 bp, Homo sapiens
  misc_feature: GYAE6OF02FY1XA.17.33.C11.1.454.CMB.1.raw
  modified_base (382)..(382): a, c, t, g, unknown or other
  misc_feature (382)..(382): n is a, c, g, or t
  modified_base (411)..(411): a, c, t, g, unknown or other
  misc_feature (411)..(411): n is a, c, g, or t
  modified_base (475)..(475): a, c, t, g, unknown or other
  misc_feature (475)..(475): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactacctggaccccctgccccgattcctcgaggctccctccgttcgggggcaaagctgccctgacnctgtctggtgtgcggctgaggacgaggcngtactatactgcctactctacgttgtgtgcttgtgctattcgggcgaggccaagctgaccgttntacgtcgagcccaaggccttcgcccctcggtcctacctctcgttcccgcccttccc

SEQ ID NO: 134239 - DNA, 723 bp, Homo sapiens
  misc_feature: GYAE6OF02IJL7W.17.33.C11.1.454.CMB.1.raw
  modified_base (295)..(295): a, c, t, g, unknown or other
  misc_feature (295)..(295): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtcccaggaggacagtcactctcacctgtgcttccaacactggagcaggtcaccagtgcttactataccaaactggttccagcaacgaaacctggaacaacgcaccgaggcactnatttatagtaacaaacaacaacactccgtcggaccctcgacccgtattcctacgacggtcctcccgtaccggttacgggggacaaacggtccttacgcccgtagtaccacgttcgtcgtcggtgtcgacgtacggtccgtaggtacgggacgtacgggtacttacgtaacttaacgtttacgtcgtacccgttaacctttaccgtttaacgtttcgggttacgttcggtacgttcgtacgttacgttacggtttacggggaccgggtaaggtaacccgtaaggtccgttaaccgggttaccgtttaacggtttacggtccggtaacggtacccggtaacggtcccggttcccggtacccccggttacggttacccgtaccgtttaccggttcccgttacccccgttaccccgtttacccgttacccgg

SEQ ID NO: 134240 - DNA, 634 bp, Homo sapiens
  misc_feature: GYAE6OF02F9KEC.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactcggttccagcaagaaacctggacaagccaccgagggcactctatttatagtaacaaacaaacaaacactccgtacggacccctcgacccgtacttcctacgacggtcctcccgttccggttacgggggacaaaggccgtcgtccctagacctacgtgtcgtggtcgtgcacgtctggaggcgaggctgtaacttattactcgtaccttacttcgttacgtttggtgtcgtcgtgttcgtacgttacgttcgggacgggtacgggacctaacgcgtcgtaccgttacttacgtacgaccggaccgtacggtacctcccggttaccccgttccggttacctccgttcccggtccccgtccccgttcccgttaccgtaccgg

SEQ ID NO: 134241 - DNA, 647 bp, Homo sapiens
  misc_feature: GYAE6OF02JIWIC.17.33.C11.1.454.CMB.1.raw
  modified_base (228)..(228): a, c, t, g, unknown or other
  misc_feature (228)..(228): n is a, c, g, or t
  modified_base (430)..(430): a, c, t, g, unknown or other
  misc_feature (430)..(430): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggancagtcaccagtgcttactatccaaactggttccagcaagaaacctggacaagccacccagggcactcatttatagtacaaacaacaaacactcctggacccctgacccgattctcacggctccctccgttagggggacaaagtctacgccctgaacacgtgtctggtgtcgcacgcctaggaggacgagctagactattacncgtcctactccttacgtttggtacgttgaccgttggtcgtacgtttacgttccggggtacggggtaacgggaccgtaacggtcgttcggtaaccgtttacgtttaacggtaccgtaccggacccggtaacggtccgttacccggtcccccgttaccgggttacccgtacctttcccgttaccgtttacccccgacccccgtttcccgttaaccccgg

SEQ ID NO: 134242 - DNA, 670 bp, Homo sapiens
  misc_feature: GYAE6OF02IRMCF.17.33.C11.1.454.CMB.1.raw
  modified_base (188)..(188): a, c, t, g, unknown or other
  misc_feature (188)..(188): n is a, c, g, or t
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
tcagcgtagactagcacgaccggtgctcgatttagagtgagctcgttgggtttgggggcggccagggtcccttccaatatcagcaccatggcctggactcctctctttctgttcctctcacttgctgcccagggtccaattctcagactgtggtgactcaggagccctcactgactgtgtccccaggngggacngtccactctcacctgtcgcttccaacnctggatcacggtcacctagtcgcttactatccaaactgttccacgnacgaacctggacacgcaccnggcactcattacagtacaaacaacgaacactccgtacggaccctgacccgtattcgactacggccgttcccgttccggttacgggggacaaacggtcctcggcccttcgaaccacgttcgtcgtcggtcgtgtaccgacgtcccgtaggaccggtacggacggtctaggtacttacttaccggttactcttaaccttcttaccggtttggtacggttcgtccgtgtcgttactcggttaccgggacgggtacggtacgtaacggcgttacggtaccgttacgttacgtacgtacccggtccggtaaccggaccgtcccgtccccggtaccgtccgtacccgttcccgttacccggttccccggttaccccttcccgttccccg

SEQ ID NO: 134243 - DNA, 819 bp, Homo sapiens
  misc_feature: GYAE6OF02HKUZH.17.33.C11.1.454.CMB.1.raw
  modified_base (236)..(236): a, c, t, g, unknown or other
  misc_feature (236)..(236): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtcgtcttaccaacacgtgggancagtccaccgagtcgtccttactactaccctaaacgtcggttacccagacaacgaaaccgtcggaaccaacgacccaacccgacggggacctaccgtacttaatttactaacgtaaccaaaacctaaaccaaaaccaccttacccgtaccggacccccgtcgaccccgtacttcctccgaccggtcctccccgttccggttacgggggaccgaaacgtccgtccggtcccgtacgaacctaccgttcgttaccggtcgggttacgttcgacgtaccgtccggtagggaacgggtaacgggacgggtaccgtacggtaaccgttacgttttaccgtaccgttacccgtttacctttacccgtttacggttttcgggttacggttcggtccgtttggtaccggttcgttacggttccggggaccgggtaacgggacccgtaacgtacccgaccgttacccgtttaacggttaccgtaacggtaacccggtacccggaaccggtcccgtacccggttccccgtacccggttcccttccggttacccttcccgggtcccccccttacccgttcccctttaaccccgg

SEQ ID NO: 134244 - DNA, 655 bp, Homo sapiens
  misc_feature: GYAE6OF02GMNF7.17.33.C11.1.454.CMB.1.raw
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccgagtgcttactactaccaaactcggttccaancaacgaaacctggaacaacgccacccgaggcactcatttanaacgtacaaacaaacaaacactcctacgacccctcgacccgtattccacacggccttcccgtcgttcggggactaaacggctaccgccctagactacgtcgtcgtgggtgtacgtcacgtcgtaggacggacgcggtctacgacgttactacgttcgtacccttacgttaccgttcgttggtcggttcgtcgttgtcgttcgtttacggtccgggacgggtacggtaccgaacgtcgtacggtaccgttacgttaacggccgtaaccggacccggtaacggtccgtacccggtacccccgttcggtacccgttacctcccgttcccggttacccctacccccgg

SEQ ID NO: 134245 - DNA, 576 bp, Homo sapiens
  misc_feature: GYAE6OF02ITWG2.17.33.C11.1.454.CMB.1.raw
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
  modified_base (398)..(398): a, c, t, g, unknown or other
  misc_feature (398)..(398): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgtcttaccaacacgtggagcaagtccacctagtcgcttaacctactaccaaacttcggttccagacgaacgaaaccgtggaacaacgccaccgaggccactctatttatagtaacaaacaacaaacactccgacgtacccncgccgtattcncgacgcctcctcgttgggacaagctcgtacctnactactgtcgtggtgagcacgcgtaggacggacgagtcgcgtactatcgtctcttactcgtacgttggtgtgcgttgtcgtacttaggtcgggcggacggaccagtcgtacgtacgtacttacggcgacgtccgtaacgccgtccgcccgtcggaccttctccgtcctccccgtaccc

SEQ ID NO: 134246 - DNA, 625 bp, Homo sapiens
  misc_feature: GYAE6OF02F0SIB.17.33.C11.1.454.CMB.1.raw
  modified_base (229)..(229): a, c, t, g, unknown or other
  misc_feature (229)..(229): n is a, c, g, or t
  modified_base (408)..(408): a, c, t, g, unknown or other
  misc_feature (408)..(408): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacactggancagtcaccagtcgcttactataccaacttgtccagcaacgaaacctggaacaagccacccgaggggaccactactaatttagtaacgaaccaaaacaaaccaaacactaccgtacggaacccctcgacccgtattccacacggcctcccgtccggttggggacaacgctcgcctagacnctgtcgtggtgtcgcgagacgtaggacggacgacggtctaggtaacttacgttacgtcgtaccttaccttcgtttaacgtttggtcgtcgtcgtgttcgtcgttacgtcgggtacggacgggtaccaacgcttacgtaccgttatagtcgacgaccgacggtcctacccgtcccgtcgtacctccgttccgtcccgtacccctacccttccctaccg

SEQ ID NO: 134247 - DNA, 679 bp, Homo sapiens
  misc_feature: GYAE6OF02HPS1X.17.33.C11.1.454.CMB.1.raw
  modified_base (227)..(227): a, c, t, g, unknown or other
  misc_feature (227)..(227): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttccaacactggancagtcaccagtgcttactatccaaactggttccagcagaaacctggacaagcacccaggcactctatttatagtaacaaacaacaaacactcctcgacccctgcccgattcctacgacggtcctccctccgttcgggggacaaaggcctacgcccgtgacctactcgtcgttggtagtgtcgacgtcccgtaggacgggacggagggctaggaacttattaccgtcggtacccttacttacttacgttttgggtaggttcgtcttggtggtcgttacggtttccggggacgggtaacggggaacccaaagggtccgtacgtacccggttagtttaacggccgtaacggaccccgtaaacgggtccgttcccggacccccccgttcgggttacccgtaccgttcccggtttacccggtttccccccggtcccccgttaccccgtttacccccg

SEQ ID NO: 134248 - DNA, 665 bp, Homo sapiens
  misc_feature: GYAE6OF02F9612.17.33.C11.1.454.CMB.1.raw
  modified_base (297)..(297): a, c, t, g, unknown or other
  misc_feature (297)..(297): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaacctggacaagcaccagggcactctatttanagtacaaacaacaaacactacctcggacccctgcccgtattctacacggcctcccgttccgttacgggggaccaaacgccgtacgtccctaggacctacgtcgtcgtggtgtcgcgacgcctggacggacggacggcgtagtactacttactcgtaccttactcgtttacgtttgggttcggtacgtcgttggttcgtacgttacgtaccgggtcggggtaacgggtaccgtaacggtccgttacggtacccgttacgttaacggtccgtaacggtacccggtaacgggtcccgtcccgttacccccggtcggttacccgtaccgttcccgttcccggttaccccccgtcccttaccccgttacccgg

SEQ ID NO: 134249 - DNA, 726 bp, Homo sapiens
  misc_feature: GYAE6OF02H6X6H.17.33.C11.1.454.CMB.1.raw
  modified_base (384)..(384): a, c, t, g, unknown or other
  misc_feature (384)..(384): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctacactgactgtcgtccccaggaggacagtcactctcacctgtcgccttccaacactggacgcacgtcaaccgagtgtcttaactactaccaaacgttcggttccagactaagaaaccgtggaaccaacgccaacccgagggcaactcaatttaactaacgtaaacaaaacaaacaaaccacctacccgtacggacccctcgacccgtattccncgtacggtcccttcccgtaccggttaggggacctaaagccttcgaccctagaccgtactcggttcgttggtgtcgccaggtcctaggacgggacggacggtcgtacgtaacttacgttaccgtcgtacccttacgtttcctttaacggtttcggttggtcgtcgttcggtcgtacctttagggtaccggggacgggtaacgggtaaccgaaggtccgtacgttaaccggttacttaacgtcccgtaaccggaacccgtacggcccgttccccggtaccccgttacggttcccctaccggtttccctttacccggtttccccctccccgtacccgttaacccg

SEQ ID NO: 134250 - DNA, 751 bp, Homo sapiens
  misc_feature: GYAE6OF02I1VQF.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgacttactataccaaacgtcggtccagacaacgtaaaccgtggaacgaagcccgaacccgacgggccacgtactaatttacgtagtaactaaaacaaacaaacctaccgtaccgtaccggtacccctccgaccgtacttcctacgaacggtcccttaccccgttccgggtacggggggacctaaacggtctacgtacccgttacgaactaccgttcgtcgttcgggtcggtacgcgtaccggtaccggttaggaaacgggtaccggaggtaccgtagtaaccttacgttaccgtccgtaacctttacgttccgtttaacgtttggggtcgtttacggcgttggtcgttacgtttacgggtcggggtaccgggtacgggtacccgtaaagtcccgtacggtacccgtttacgttacgtcgaaccggtcccgtaacggtcccgtacccgtccccgttacggttaccctacgtttcccgttacccgttacccccgttacccgttcccgttaacccg

SEQ ID NO: 134251 - DNA, 688 bp, Homo sapiens
  misc_feature: GYAE6OF02JPTDY.17.33.C11.1.454.CMB.1.raw
  modified_base (217)..(217): a, c, t, g, unknown or other
  misc_feature (217)..(217): n is a, c, g, or t
  modified_base (364)..(364): a, c, t, g, unknown or other
  misc_feature (364)..(364): n is a, c, g, or t
  modified_base (436)..(436): a, c, t, g, unknown or other
  misc_feature (436)..(436): n is a, c, g, or t
  modified_base (643)..(643): a, c, t, g, unknown or other
  misc_feature (643)..(643): n is a, c, g, or t
tcagcgtagactagcacgaccggtgctcgatttagagtgagctcgttgggtttggggggcgccaggggtcccgttccaatatcagcaccactggcctcggactcctctctttctgttcctcctcacttgctgccacggtccaattctcagactgtggtgactcaggagccctcactgactgtcgtccccaagggagggaccagtcaccgtctcaccngtcgccttccaacacgtggacgcacgtacaccgagtcgcttacaactccaaaactggttaccagtcacgaaacctggaccaacgaccacccacgggacactactacttatacgtaacaaacctaaacaaacgactaccacgtacccncgaccgacttcctcgacgtcctcccgtacgtcggggtcaacgtctcgacctcgacactacgtcgtgtacggngtaccgcgtaccgtaggacggtaacgtacggggacgtcaacggttacttactaccgttcctacctttacgtttacgtttcgggttcgttacggcggtttcgacgtacggttaccgttcgggaaccgggtaacgggggtaaccacgggttaacctgtaccgggttacttagtccggtaccgtcccgaacggtccgtccgttcccccgnggtttaccccagtcccgtttccgcccgttacccctcggttacccg

SEQ ID NO: 134252 - DNA, 724 bp, Homo sapiens
  misc_feature: GYAE6OF02GN54W.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttaccaacacgtggagcacgtccaccagtcgtaccttactaactaccctaaaacgttcgggtttaccaacggcaacgtaaaaccgtgggaaccaacgccaaccccgagggcccacgtacaattttaacgtacgtaaactaaaaccgaaacaaaaccacctaccgtaccggtacccctcgacccgtattcctacgacggcctcccgtcggttacggggacaaacgctcgcctacgactcgtcgtcgtggtcgtcgcgacgcgtaggacggacggacggtctagtaacttaacttaccgtcgtaccttaccttacctttacggtttcgggtgtacgtcgttcgtacggtacttaggttccgggacggtaacgggacctaaaggccgtaacggttacccggttagttaacgtccgaccggtaacccggtaacggtccgtaccccggtccccgttaccggtaccttccgtttcccgttaccccgttccccgttaccccgttccgtttaaccccg

SEQ ID NO: 134253 - DNA, 709 bp, Homo sapiens
  misc_feature: GYAE6OF02F7OV8.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccgaggaggacagtcactctcacctgtcgtcttaccaacactggacgcacgtaccaccgaggtcgtacctttaacctactaccctaaacgttcggttacccaggaccaacggaaaccgtacggaaccaacgacccaaccccgaagggtccacgttctatttaataacgtaaccaaaacaacaaaccgactaccgtacgacccctcgacccgtattcctacgacggtcctcccgtacggtacggggacaaacgctcgtacctacgactactcgtcgtggtcgtgcgtacgccgtaggacggacggtaggtctagtacttaacttctacgtaccttaccgttacgtttacggtttggttggttcgtacgtgttcgtcgttacggttccgggacgggtaacggtaccgaacgtcgttccgtaccgttacgttacgtctaccggaccgtacggtcccgttacccggtccccgttacggtacctaccgttccgttccccgttaccccgttaccccttacccgttacccg

SEQ ID NO: 134254 - DNA, 638 bp, Homo sapiens
  misc_feature: GYAE6OF02GYTD7.17.33.C11.1.454.CMB.1.raw
  modified_base (325)..(325): a, c, t, g, unknown or other
  misc_feature (325)..(325): n is a, c, g, or t
  modified_base (406)..(406): a, c, t, g, unknown or other
  misc_feature (406)..(406): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccaggaggacagtcactctcacctgtgcttccaacacgtggacgcacgtcaccgagtcgacttactataccaaacgttcggttccacgcaacgaaaccgtaggaacaacgaccacccgacgggccactactatttaanagtaacaaacaaacaaacaactcctcgaccctacgcccgacttctcgaggcctccctcgtaggggacaagctcgcctgacnctacgtctggtcgtcgcgacgccgtagaggacggacgcgtagacctaagttctcgtacctacttcttacgtttgggtcggtgtcgttgtcgtcgttagttccggggacgggtaccgggaacgtaggccgttacggtacccgtttaggttaacgtcggtaccgaacccggtacggccgtacccggtccccgttcggtacccctacgtttacccttcccgtaccccttaccccg

SEQ ID NO: 134255 - DNA, 593 bp, Homo sapiens
  misc_feature: GYAE6OF02GBF8X.17.33.C11.1.454.CMB.1.raw
  modified_base (173)..(173): a, c, t, g, unknown or other
  misc_feature (173)..(173): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctnactgactgtcgtcccaggagggacagtcactctcacctgtgcttccaacacgtggagcagtccaccgagtgactttactaactaccaaactggttccagctaagaaacctggaacaagccaccgaggcactcatttanagtaacaaacaacaaacactctcgaccctgccattcncgacgctccgtcgttagggacaagctcgcctgactactgtcgtggtgtcggacacgtctagggacggaacgaggtctagtaacttaacttcgtacgacccttaacttaccttaacgttttgggtagtcgtctggtcgtacttacggtcgggacggacggtacgaagtcgtacgtacgttacgtaacggcgacgaccgaaggtcctccgaccccgttcggctaccgtcgttaccgtcccctacccg

SEQ ID NO: 134256 - DNA, 866 bp, Homo sapiens
  misc_feature: GYAE6OF02H9GXC.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactcctcaccgtggtcgtccttaccaactacgtggacgcacggtcaaccgaggttcgtactttaactacctaccctaaaacgtttcgggtttacccaagtaccgtaaacggaaaacccgttagggaaaccgaacgacccgaaccccggaacggggacctaacccgttacttaatttttaaacgtaaacggttaaaacccaaaaaacgaaaacctaaaacctaacccttacccggtacccggtaaccccgtacgaccccggttaacttaccgtaccgacggtacccttccccgttaccggtttacgggggaacctaaacggtcctaccggtcccgtaccggtacctaaccgttcggttaccggttgggtaggttcggaccgtacgtccgtacgggtaacgggaccggacgggtcgtacgtacgttaacgttacgttacgtacccttacctttccgttacgttttcgggtacggttcgtcgttaggttcgttaccgttacggttaccggggacgggtaaccgggtaaccgaacggttaccggaccggttaccgttaacgttaccggtacgtacccggaaccgtacgggtccgtcccggttacccccgtcgttacccgaccgttcccgtttacccggttccccccgttaccctcccgtttaaccccg

SEQ ID NO: 134257 - DNA, 597 bp, Homo sapiens
  misc_feature: GYAE6OF02F4SXK.17.33.C11.1.454.CMB.1.raw
  modified_base (224)..(224): a, c, t, g, unknown or other
  misc_feature (224)..(224): n is a, c, g, or t
  modified_base (340)..(340): a, c, t, g, unknown or other
  misc_feature (340)..(340): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacnctggagcagtcaccagtgcttactatccaaactgttcagcaagaacctgacaagcaccgaggcactctatttatagtacaaacaaacaaaccactcctcgaccctcgcccgattcncgcgctcccgtcttcggggacaaacgtctcgccctacgacactgtctggtgtgacgacgctggaggacgagtcgtagacttactacttgtaccttactcgttacgtttggtcgttgcgttgtcgtcttacgttaccgggcggtaacggactacggtctacgtaccgtacgtaacgtccgaccgacccggtaacggtccgtcccgtacccccgttacggttaacccgtcgttccggttacccccacccgtttaccccg

SEQ ID NO: 134258 - DNA, 567 bp, Homo sapiens
  misc_feature: GYAE6OF02G98J7.17.33.C11.1.454.CMB.1.raw
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaaacaaacactcctcggacccctgtccgattctcagctccctcgttggggacaaagctgccctgacactgtctggtgtgcagcctggaggacgaggctagactattactcgtcctactcttcgtttggtggtgcgttgtgtcttagtcgggcgggtacgggacgaagtccgtggtaccgttacttaacggtcacggacccgtaacggccgttccggcccccttcggtcctacctccgttccgttccccgttcccccg

SEQ ID NO: 134259 - DNA, 808 bp, Homo sapiens
  misc_feature: GYAE6OF02HZF6H.17.33.C11.1.454.CMB.1.raw
  modified_base (372)..(372): a, c, t, g, unknown or other
  misc_feature (372)..(372): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtcccgaggaggacacgtcactctcacctgtcgcttaccaacacgtggacgcacgtcaccgtagtgaccttataacttaccaaaacgttcggttccaggaccaacgtaaaccgtggaacgaaaccgccaaccggacgggtacactacgtaactttaagtaactaaactaaaaccaaaactaaaaccnccttaaccgtacccgacccgtaccggtaacccgtaacttacctaccgtacggtaccccttaccccggttaccggtacgggggtaacaaaaccggttccgtccgttaccccgttaacgaccgttaaaccgttcggacgttcgggtacggtacgaccgtacggtaccgttacggacgggtaacggtacgggtacgtacgggtaacctttaacgttacgttaccggttacctaaccgttaccgttttcgttacgggttaacgggttccgtacggtttcgtaccggttacgtttacgggtaccggggttaaccgggggtaaccggtaccggtaacggtacgtaccggttaccgttacgtttaaccggacgtaccgtaccggaacggtccgttacccggtcccgtcggtaccgttcccgtacgttcccgttcccgtacccc

SEQ ID NO: 134260 - DNA, 625 bp, Homo sapiens
  misc_feature: GYAE6OF02GXQF0.17.33.C11.1.454.CMB.1.raw
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactataccaaactggttccagcaagaaacctggacaagcacccagggcactcatttatagtaacaaacaacaaacactcctcggaccctcgacccgtattctcacggcctcccgtccgttcggggacaaacgctcgccctagactactgtctggtgtcgcacgctggaggacgnggctgactacttacnctccttactcttcgttggtggtgtcgtgtcgtcgttacgtttcggggacgggaacgggtaccgaacggtcgtaccggtaccgttacgtttacggtaccgtacggtacccggaacgggtccgtcccgggtcccccttacgggtccctacgttcccttacccggttcccccttaccccgttcccgttaaccccgg

SEQ ID NO: 134261 - DNA, 680 bp, Homo sapiens
  misc_feature: GYAE6OF02FFTDP.17.33.C11.1.454.CMB.1.raw
  modified_base (203)..(203): a, c, t, g, unknown or other
  misc_feature (203)..(203): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (284)..(284): a, c, t, g, unknown or other
  misc_feature (284)..(284): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (401)..(401): a, c, t, g, unknown or other
  misc_feature (401)..(401): n is a, c, g, or t
tcagcgtagactagcacgaccggtgctcgatttagagtgagctcgttgggtttggggggcgccaggggtcccttccaatatcagcaccatggcctggactccctctctttctgttcctcctcacttgctgcccagggtccaattctcagactgtggtgactcaggagccctcactgactgtgtcccaggaggacagtcactcncacctgtgcttcacactggcncagtcaccagtncttactatccaaatgttcagcacgaactaggacacgcaccgaggcacnctattactagtacaaactaacaaacactacgtcgacccngccgatcncgngcctccctcgttcggggactacggctcgtccgtgaccgtcgtacgtcgtggtcgtgactcgctaggnggtacgacggtctaggtacttaactacgtctaccgttataccgtttacgttcgggttcggttacgcgtttacgtcgtacgttacggtaccgggtacgggtaccgggtaaccgtaaccgtacggtccgttaacccggtttaacggtttaaccggtaccgtaaccggtaacccggtaaccggtcccggttaaccccgggtccccccgtttacggtaccccgttaacccgttcccggtttcccgtttaccccccggttaccccgttcccgtttaacccccgg

SEQ ID NO: 134262 - DNA, 771 bp, Homo sapiens
  misc_feature: GYAE6OF02FKVAZ.17.33.C11.1.454.CMB.1.raw
  modified_base (393)..(393): a, c, t, g, unknown or other
  misc_feature (393)..(393): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctcgcccacgggtcctaattctcagactggtggtgactcgaggacgccctcactgactgtcgtaccccgagggacgggacagtcactcctcacctgtcgccttaccaacacgtggacgcacgtccaccaggtcgtacctttaacctaactcccgggggggggggaaaacctcgggtttcccagccaagaaaccctggacaacgccaccccgaggcactcatttatacgtaacaaacaaacaaacacctacctcggacccccgtcnccccgtacttttcgtacggcctccccgtccgttgggggacaaacggctcgccctacgactacgtgtcgtcgggtgtcgcaacgccgtggtacgggaaccgagggaccttacggtaccttaacgttaccgttacgtaccctttacttccgtttaccgtttcggggttacgggtcggtcgtttgggttcgttcgtttacggtttaccggggacggggtaaccgggaaacccgtaaaggtccgttaccgggacccggtttaccgtttaaggaccggtaaccggtcccgaaacgggtccccgttaccggacccccccggtttaccggacccgtaacccggtttccttaccccgggttacccccggttcccccgttacccccg

SEQ ID NO: 134263 - DNA, 662 bp, Homo sapiens
  misc_feature: GYAE6OF02IVTLY.17.33.C11.1.454.CMB.1.raw
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (446)..(446): a, c, t, g, unknown or other
  misc_feature (446)..(446): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgcttccaacactggagcagtccacctagtcgtcttactatacccaaacgttggttaccaagcctaacggaaaccctggaacaagccaccgtagggctactactattagtagtaacaaacaacaacactccgtcgtacccncgacctattcnccacggtcctcccgtcggtgggacaagctcgacctgacctagtcgttaccgtgtacgtcgcacgtccgtaggacgacggtacggngtcgtaacttactacgtacgtccttacgtcttacgtttaggtcgtcgtcgttcgtgttccgttacggttcgggtacgggtacgggaaccgtaacgtaccggtaccgtaccgtttaccgttaaccgtacgtaaccgtacccgtaaggtccgtaccgtcccccgttacgttaccgtaccgttccgttacccgttacccctaccccgttccttaccccg

SEQ ID NO: 134264 - DNA, 708 bp, Homo sapiens
  misc_feature: GYAE6OF02ID8N1.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtgtgactcaggacgccctcactgactgtcgtccccaggaggacagtcactctcacctgtcgtcttaccaacacgtggacgcagtccactagtcgacttactactacctaaacgttcggttaccacgacaacgaaaccgtggaacaacgcacccgaggcactctaattactaacgtaacaaacaacaaacacctaccgtacgaccctcgacccgtatctacgacgtccttccgttcgtcgggggaccaaacgtcgtcgaccgtacgactacgtcgtacgttcggttcgtcgaccgacgtaccgtaggacggacggacggcgtacgtaacgtttacttaccgttacgtaccttaccgttaccgtttacggtttcggtacggttacgtcgttaggtcgtacgttacggttcggggacgggtaaccgggaacctaacgggtcttacggtaccgtttacgttaaaccggtcgaaccggaacccggtaccggtaccgtccccggtacccgttccgttaccgtacccggtttaccgttaccccgttcccccttaacccccg

SEQ ID NO: 134265 - DNA, 700 bp, Homo sapiens
  misc_feature: GYAE6OF02FGYF1.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaactgacaagcaccagggcactcatttatagtacaaactaacaaacactcctacggacccctgtacccgattcctcacggcctccctccgttcggggggaccaaaggcctaggccctgaccacttgtcgtaggttcgtgccgagtcccaggtacgggacgtacgggtactacggtacttaacgttacctacgtacccgttaccttcgtttaaccgtttggggtacgtttcggtcgtttaggttccggtattaacgttccggggtacggggtacgggtaacccaaggtccggttacgtaacccggtttacgtttaccggttaacgaccggtaaccccgtaacgggtacccgtcccggttacccccgtacggggttaccctaacccggttcccgtttccggttacccccggttccccgttaccccgtttaaccccgg

SEQ ID NO: 134266 - DNA, 619 bp, Homo sapiens
  misc_feature: GYAE6OF02HTRD0.17.33.C11.1.454.CMB.1.raw
  modified_base (353)..(353): a, c, t, g, unknown or other
  misc_feature (353)..(353): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcaggagccctcactgactgtcgtccccagggagggacagtcactctcacctgtcgcttaccaacactggagcagtcacagtgcttactatcctaaacgtggttaccagcaagaacctaggacaagccaaccgaggcactatatttatacgtaacaaactaacaacactcctacgaccctcgacccgtattcncgacgtcctacccgtcgtacggggacaactcgtcgccgtagacctacgtcgtcgtgggtgtacgacgacgccgtggacggacgagacgtgtaacttattacgtcgtaccttacgttactttgttaggcggttgcgttgtacgtcgttaggtccggggaggtaccgggaacgtacgtccgtagtacccgttacgtaacggtccgaccgtaccgacggtccgtcccgtcccgttccgtacctaccgttccgtccgttccccgtccccg

SEQ ID NO: 134267 - DNA, 610 bp, Homo sapiens
  misc_feature: GYAE6OF02IM4Z6.17.33.C11.1.454.CMB.1.raw
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
  modified_base (359)..(359): a, c, t, g, unknown or other
  misc_feature (359)..(359): n is a, c, g, or t
  modified_base (572)..(572): a, c, t, g, unknown or other
  misc_feature (572)..(572): n is a, c, g, or t
tcagcgtagactagcacgaccggtgctcgatttagagtgagctcgttgggtttggggctggcgccagggggtcccttccaatatcagcaccatggcctggactcctctctttctgttcctcctcacttgctgcccagggtccaattctcagactgtggtgactcaggagccctcactgactgtcgtccccagggagggacagtcactctcaccttgcgcttccaacncgtggagcagtccaccagtcgcttacactaccaaactcggttccagcacgaaactggaacanccaccgagggcactctatttatagtaacaaacaaacaaacactaccacggtacccctcgaccgtacttcncacgtctcccgtccgttcggggacaacgcgtcgacccgtgacctactcgtcgtggtgtcgcgacgcgtggacggacggaggtcgtacgacttacgttacttcgtccttacgtctttaacgtttggtcgggtgtcgttaggtcgtagttacggttcgggacgggtacggaccgaagtcgtacgtaccgttacttaacgcgacgaccgacggtcnccgtcccgtcgtacctacgtccgttaccgtccctaccc

SEQ ID NO: 134268 - DNA, 692 bp, Homo sapiens
  misc_feature: GYAE6OF02IALU6.17.33.C11.1.454.CMB.1.raw
  modified_base (329)..(329): a, c, t, g, unknown or other
  misc_feature (329)..(329): n is a, c, g, or t
  modified_base (481)..(481): a, c, t, g, unknown or other
  misc_feature (481)..(481): n is a, c, g, or t
  modified_base (574)..(574): a, c, t, g, unknown or other
  misc_feature (574)..(574): n is a, c, g, or t
  modified_base (650)..(650): a, c, t, g, unknown or other
  misc_feature (650)..(650): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactccaggagccctcactgactgtcgtccccagggacgggacagtcactcctcacctgtcgccttaccaacacgtggacgcagtcaaccagtcgtcttactactacctaaacgttcggttacccagtacgaacgtaaaccgtgggaaccaacgaccacccgacgggctacctnttaactttagtaacgttaacaaaaacctaaacaacctacctacccgtaccggtacccctacgaccctacttaccgtccgacgttccctccccgttccggttcgggggaacctaaacgtccgtccgtaccgtacgactacgttcgtttaccgnggtacgtcgctacgtcgtacgggtacggtacggtacggtcgtacgtacttacgttaccgtcgtaccgttacttccgttagttcggttacggtnacgttgttacgtacgtacggtcgggacgacggtacgaggtacgacgtacgttacgtagccaccgtcgaccggtccncccgttccgcctaccgcttccgtccgtccctccctctacccg

SEQ ID NO: 134269 - DNA, 635 bp, Homo sapiens
  misc_feature: GYAE6OF02IGV2C.17.33.C11.1.454.CMB.1.raw
  modified_base (356)..(356): a, c, t, g, unknown or other
  misc_feature (356)..(356): n is a, c, g, or t
  modified_base (617)..(617): a, c, t, g, unknown or other
  misc_feature (617)..(617): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtcgcttccaacacgtggagcagtcaccagtgtcttactactaccaaactggtaccagcaagaaacctggaacaagcaaccgaggcactcaatttatacgtaacaaacaaacaaaccactccgtacgacccctcgacccgtattcncacggcctacccgtcggttggggacaaacgctcgtccctgactactcgtctgggtgtcgcacgtccgtggaacggacgtggcttagactacttactcgaccttacttcgttacgtttggtggttcgcttggtcgtagttacggtccgggacgggtacgggtaaccaacgtcgtacgaaccgtttacgttacgtaccgacgaaccggtacggtccgtacccgtcccccgtaggtaccctaccgttccgttcccgttaccccncccccgttccttaccccg

SEQ ID NO: 134270 - DNA, 716 bp, Homo sapiens
  misc_feature: GYAE6OF02H88Z1.17.33.C11.1.454.CMB.1.raw
  modified_base (233)..(233): a, c, t, g, unknown or other
  misc_feature (233)..(233): n is a, c, g, or t
tcagcgtagactagcacgaccggtgctcgatttagagtgagctcgttggggtttggggctggcgccaggggtcccttccaatatcagcaccatggcctggactcctctctttctgttcctcctcacttgctgccagggtccaattctcagactgtggtgactcaggagccctcactgactgtcgtcccagggacgggacagtcactctcacctgtgcgttaccaacactggancagtcactagtgaccttactactaccaaacttcggttaccagaccaacgtaaaccgtggaaccaagccacccgaggaccactactattttacgaacgtaaaccaaactaacaaacctaccgtaccgtacgaccccttgaccccgtattcaccgtacggcccttcccgtaccggttgggggaacctaaacggtcctaccggccccttaagacctacgttggtccgttaggtcgtacgacgtacgtcccgtagggaccggaacggacggtcctaagtaccttaacgttaccgtacgtccttaacgttaccgtttacggtttgggtacggttcgtcgttaggtcgtcgttacggttcgggacgggtacggaacgtaacgtcgtaccggtaccgttacgtaacggtccgtaacccggtaccgaaccggtccgtacccggtaccccgttcgtaacccgtccggttaccttccccggtccctacccccg

SEQ ID NO: 134271 - DNA, 859 bp, Homo sapiens
  misc_feature: GYAE6OF02JFERC.17.33.C11.1.454.CMB.1.raw
  modified_base (178)..(178): a, c, t, g, unknown or other
  misc_feature (178)..(178): n is a, c, g, or t
  modified_base (220)..(220): a, c, t, g, unknown or other
  misc_feature (220)..(220): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtacgcacgaggcctcctacncgtacgcgtggtcccgtacccgagggaacggacgtcgtaccnctccctacctaccgtggtcgttcctacccaaccgtacggtaggacgacgtaccgtaccaaccgtggtacgttaccttaacgtacctaaccgttaaacggtttccgtaccgacgtaaccgaaaccgtaaccgtacggaaacgaaccgacccgtaaccgggacggtacctaccgttaaacttactttaaacggtaacgtaaaaccaaacctaaaccaacgtacccttcggaccccgtaccgtcccgacctacgtcctacggtaccgtcccgtacccttacggggtccggtaaacgaccgtacgtcccgtccgtacgtaccctacggttccgtggttcggtacggtccgacggaccgtccgaagggacggtacggcgtacgttaccgtacgttaccttacgttcccgtaccctttacgttaacccgttttaggtttcggtacgggtttccgttacggttacggttaccggttaccgtacgggtccgggtaaccgggtaccgtaaaccggtaaccgtcgtaaccgggttacccttaacggtaccgtacggaaaccccccggttcggaacccggttcccgttccccgggtccccttaccgggtacccttacccgttcccggtttacccctacccccgtaccccg

SEQ ID NO: 134272 - DNA, 636 bp, Homo sapiens
  misc_feature: GYAE6OF02IEXWQ.17.33.C11.1.454.CMB.1.raw
  modified_base (227)..(227): a, c, t, g, unknown or other
  misc_feature (227)..(227): n is a, c, g, or t
tcagcgtagactagcacgaccggtgctcgatttagagtgagctcgttgggtttggggctggcgccaggggtcccttccaactatcagcaccatggcctggactcctctctttctgttcctcctcacttgctgcccagggtccaattctcagactgtggtgactcaggagccctcactgactgtcgtccccaggaggacagtcacctcgtcacctgtgcttaccaacnctggacgcagtcacagtgcttactatccaaacgtggttccagcaagtaaaaccgtggaacaacgcacccgaagggtcactactatttatagtacaaacaacaaacactcctacggaccctcgccgattcctcacgcctacctccgttggggacaaagtctacgccctgacactcgtcgtggtcgtaggcacggaccctggacggacggaaggtcgtacgtacgttaactttaaccttcggtaccttaccttaccgtttaccgttttggtcgggttcgtccgtggttaacgtcttacggtttcgggacgggttacgggacccgtaagcgtacggtacccgttcgttaaacgtcggtaacacccggaggtacctccgccccgtaggtcccactccttcggtcccctacccc

SEQ ID NO: 134273 - DNA, 623 bp, Homo sapiens
  misc_feature: GYAE6OF02JJ5PQ.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccagggagggacagtcactctcacctgtcgccttaccaacactgggacgcgacgtaccaccgagtcgtacttaactactaccaaactacgttaccagacaacgaaccgtacggaacaggcacccagggcactcatttacagtacaaacaacaaacacacctggacccctgaccccattcctcacggctacccgtaccttacgggggctaaacggcctagccctaggaccacgtgtctcggtcgtcgctaggcctaggacggacgacggctagactagtactgaccttactctactttcgtagtgcttgtcgtcgtacgttcggacggacgggacgtaacggacgtacgtaccgttcgttaacgtctacggtcccgaacgaccgtacggccccgtacggtcctacgtacctacgttaccccgtacctacccgtacccg

SEQ ID NO: 134274 - DNA, 775 bp, Homo sapiens
  misc_feature: GYAE6OF02H209L.17.33.C11.1.454.CMB.1.raw
  modified_base (175)..(175): a, c, t, g, unknown or other
  misc_feature (175)..(175): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtaggtgactcaggacgccctnactgactgtcgtccccaggagggacagtcactctcacctgtcgcttaccaacacgtggagcagtaccaaccagtcgaccttaactactaccaaaacgttcggttaccaagaccaacgaaacctgggaaccaaagacccaaccgaggacctaacgtactaacttttaagtaacgtaaaccaaaactaaacaaacctaccttaccgtaccggaacccctcgtaccccggtacttacctacggaaccgtcccttacccgttaccggttagggggaacctaaacgtccgtaccgaccccgttgaacctacggttcgttacggttcgggttcgtacgtacccgtacggaccgttacggggaacggtaaccggacggtacgttacggtaacctttaacgttaaccgttcgtaacccgttacttaacgttttacggtttagggtacgttcggtcttacgggtcgtaacgttacggtacgggtacgggaacgggtactaaacgggcgtaccgtaccgttaacgttaggacccgtaaggacccgaaggttccctacccggtccccgttcggttacccaccgtttaccgttcccggtacccctacccccg

SEQ ID NO: 134275 - DNA, 683 bp, Homo sapiens
  misc_feature: GYAE6OF02JECII.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcactgtgcttccaacactggagcagtcaccagtcgcttactactccaaacgtggttccagcaacgaacctggacaagccaaccgaggctactctatttactacgtaacaaacaacaaacacctaccgtacggaccctagcccgtattctcacggtcctcccgttcgttcggggaccaaaggctaggccctagaccactgtcgtggtcgcgcgacgcaggacggacgacggctacggacttaacgttacctcgtaccttacgttcgtttaacgtttgggttacggttcggcgttcggttcgtaccgtttacggttaccggggtacggggaacccggtaacggaaccgtccgttaaccggtacgtttaaccgttaacggtaccgtaaccggtacccggtaacggtcccgttacccggtacccccggttcgttaaccccgttccgtttacccgttacccgtttccccccggtaacccccg

SEQ ID NO: 134276 - DNA, 664 bp, Homo sapiens
  misc_feature: GYAE6OF02FWUDC.17.33.C11.1.454.CMB.1.raw
  modified_base (172)..(172): a, c, t, g, unknown or other
  misc_feature (172)..(172): n is a, c, g, or t
  modified_base (431)..(431): a, c, t, g, unknown or other
  misc_feature (431)..(431): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcgaggagccctnactgactgtgtccccgaggagggacagtcactctcacctgtgtccttaccaactactggacgcagtccaccagtcgtcttacctatacctaaactcggttaccagtcaacgaaacctggaaccaagccaccgagggccactctaatttatacgtaacaaacaaacaaactacctaccgtccggacccctgcccgtattccgtacacgtcctccctcggtgggacaacgtcgtcgcctagactactgtctaggtgtcgcncgtcgtggacggacgcgtcgtcgtaactacgttacgtctaccttacgttctttacggtttggttcggtcgtcgttgtcgtacgttacggttcgggacgggtacggtaaccgtaacgtccggttacgtaccgttacgttaccgtacgtaccggaccggtaacggtcccgtacccggtccccgtacggttacctaccgttccgttaccccggtccccgttcccgtcctttacccg

SEQ ID NO: 134277 - DNA, 715 bp, Homo sapiens
  misc_feature: GYAE6OF02ICLP8.17.33.C11.1.454.CMB.1.raw
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccaacactggagcacgtcaccgtagtcgactttactactaccaaaacgttggttaccagcaacgaaacctggaaccaagccaacccgagggccactactatttaacacgtaacaaaaccaaacaaaaccacgtaccgtacggacccctcgacccgtacttactacgaacggtccctcccgtaccggttacggggggactaaaacggtcctacggccctaggtaacctacgtacgtcgtacggtggtcgcgacgtccgtaggaacgggacggacggtcgtacgtacttaagttactcgtacccttacttcgtttacgtttggtcggttcgtcgttggtcgtacgtttacgttaccgggacggggtaacgggaaccgtaaggtcgtaaccggtaccgttacgttaacgtacgtaccggaaccgtaacggtcccggtacccgtccccgtacgggtccctaacgttcccttaccggttcccctacccgttcccgttaacccg

SEQ ID NO: 134278 - DNA, 641 bp, Homo sapiens
  misc_feature: GYAE6OF02FTXVW.17.33.C11.1.454.CMB.1.raw
  modified_base (226)..(226): a, c, t, g, unknown or other
  misc_feature (226)..(226): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccaacactggancagtcaccagtcgcttactataccaaactcggttccagcaagaacctggacaagcaccgaggcactcatttatacgtaacaaacaaccaaacactcctcggacccctgcccgattctcacggcctccgtccgttggggaccaaagcctgaccctgacactgtcgtggtcgtgcacgccgtgaagggcgaggtctagacttagttactcgtaccttaacttcttacgtttgggcgtgtctggttcgcgttagtcgggcgggtacgaccgtaagtcgtacgacccgttacgttacgtaccgaccggtaaccccgtaaggtccccgtacccggtccccccgtttaccgggtacccttaacccggtttccccgtttacccggtttacccccccgtacccctttcccctttaacccccgg

SEQ ID NO: 134279 - DNA, 783 bp, Homo sapiens
  misc_feature: GYAE6OF02JXZIX.17.33.C11.1.454.CMB.1.raw
tcagcgtagactagcacgaccggtgctcgatttagagtgagctcgttgggtttggggcgtggcgccaggggtcccttccaatatcagcaccatggcctggactcctctctttctgttcctcctcacttgctgcccagggtccaattctcagactgtgggtgactcaggacgcccctcacctgacctgtcgtccccgagggaggggacagtcactctcacctgtgacttccaacactggagcagtccaccgagtgaccttactactacctaaacgttcggtacctagacaacgaaacctaggacaacgccaccgaggacctacgtaattacgtaagtaaccaaaacaacaaaacctactacccgtaccggacccctacggacccctacgttcctaccgaagtccctaccccgtaccggttagggggtaccaaacgtccgtcggtaccctcgtaaccctacgtccgttggtacgggttcgtacggtacgaccggtaccggtcggtaacgggtaaccggcggtaccgtacggtaaccgtttacgttaccgaccgttaaccttaccgtttaccttccggttttgggtacggttccgttcgttacggtacggttcgtttaaccgggtccgggtaccgggttaaccgggacccgtaaacggtacgtaccgggttacccgttaccgttaacggtaccggacccgtaccggtaaccggtcccgtccccgttacccggccccgttaccgtacttacccggtttcccggttccccccgttacccgttcccccg

SEQ ID NO: 134280 - DNA, 625 bp, Homo sapiens
  misc_feature: GYAE6OF02F63KB.17.33.C11.1.454.CMB.1.raw
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgcttccaacactaggacgcagtcaccagtcgacttactactccaaactcggttccagcaagaaactcggacaagcaccgaggcactcattanagtacaaacaacaaacactcncgaccctcgccgatctcacgctcctcgttggggacaacgctcgcctgacacgtcgtcgtggtgtcgacgacgctaggacggacggacggctacggacttaacttacgtcgaccttacgttaccttacggtttggtacggtcgtacgtgttcgtacttacggttcggacgggaacggtacgaacgtccgtaacgtaccggttacgttaacggttccaacggttaccccgaacggttcccgtacccggtcccccgttccgggtaccctaccgttcccgttcccggttacccccgttcccccg

SEQ ID NO: 134281 - DNA, 626 bp, Homo sapiens
  misc_feature: GYAE6OF02FY1A4.17.33.C11.1.454.CMB.1.raw
  modified_base (224)..(224): a, c, t, g, unknown or other
  misc_feature (224)..(224): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgactgcccagggtccaattctcagactgtggtgactcaggagccctcactgactgtgtccccaggagggagagtcactctcacctgtgcttccaacnctggagcagtcaccagtgcttactatccaaactggtccagcagaaacctggacaagcaccaggcactcattatagtacaaacaacaaacactcctcggaccctgccgattctcacgctcctccgtggggacaacgctcgcctgaccacgtcgtacctggtcgtcgacgtacgccgtggacgggacgagggccgtagacttattaccgtgcccttactccgttactttgggtaggtcgtcgttgtcgtcgttacggttcgggacggggtaacggaacccgtaacggtcgtacgggtacccgtttacgttaacggtccgtaaccggtacccgtaacggtccgtacccggtcccccgttacggttaccctaccgttccgttacccgtttacccccctaccccccg

SEQ ID NO: 134282 - DNA, 624 bp, Homo sapiens
  misc_feature: GYAE6OF02FOZW9.17.33.C11.1.454.CMB.1.raw
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactggactgtgtcccccagggacgggacagtcactctcacctgtgcttccaacactggagcagtcaccagtgcttacatccaaactggttccagcagaacctggacaagccaccagggcactcattanagtacaaacaacaaacactccncgacccctgcccgattctnacgtccncccttccgttcgggggacaaacgctcgccgtgacctacgtcgtcgtggtcgtgcacgtctggtacggacgacggctagacgtattacgtcgtccttactcttacgtttggtcggtgccttgtcgtacgttcgttcgggcgggacggggtaccaacggtccgtacgtacccgttacgttaacgtccgacggtaccccgaaggtcccgtcccggtaccccccgttggtacccgtaccgttcccgttaccggtttcccccgtccccttcccgttaccccg

SEQ ID NO: 134283 - DNA, 832 bp, Homo sapiens
  misc_feature: GYAE6OF02IWQD4.17.33.C11.1.454.CMB.1.raw
  modified_base (168)..(168): a, c, t, g, unknown or other
  misc_feature (168)..(168): n is a, c, g, or t
tcagcgtagactagcacgaccggtgctcgatttagagtgagctcgttgggtttgggggggtcggccgaggggtcccgttccaatatcagcaccatggcctggactcctctctttctgttcctcctcacttgctgcccagggtccaattctcagactggtggtgacttnacggagccctcactgactgtcgtccccaggagggacaggtcactcgtccaccgtgtcgcttaccaacgacttgggaacgcacggttccaacccgtaggtaggtccttttaacgtacctaccctaaaaccgttcgggtttacccaacggacgtaaaccggtaaaacccggttacggaacgtaacggtacccaacccggaggggacctaccgttaccctaagttttaacgttaagtaaccgtaaaaaccaaaccgtaaaaccaaccgtttaccctaaccgggtaacccccttaccggaaccccgttaacttaccgttccggaaccgtcccgttaccccgttccggtttaacggggggacccaaaacggtccgtttacggaccccttaggaacccttacgtcggtaccgttcggggtacgttacgaccggtaacgtcccgtacggaacggggtacgacggtctacggtaccttagttacctcggtaccttaaccgttcttaacggttttcgggcgttggaccgttgtacgtaccgtttacgtaccgggacgggtaacgggctaacgggccttaagggacccttgtacgttcgacgaaccgtacggtcctaccggtccccttacgggaccttaccggtcgttcccgtacccgtccctcccttacccgg

SEQ ID NO: 134284 - DNA, 660 bp, Homo sapiens
  misc_feature: GYAE6OF02GVGHS.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgccttccaacactggagcagtcaccagtcgcttaactactaccaaactcggttccagacaacgaaaccgtggaacaacgccacccgagggcacgtactatttaacgtagtaacaaaacaaacaaaccactacctacggaccctcgacccgtacttctacacggtcctcccgtcgtcggggacaaacgctcgcctacgactactcgtcgtcggtgtcgacgacgtccgtggacggacggacgcgtacgtacttagttacgttcgtaccttacgttcgttacgtttcggtaggtcgtcgttagtcgtacgttacggttcgggtacgggtaacgggtaccgtaacggtccgtacggtaccgttacgttaacggtacgaccggtaccgtaacggtccgtacccggtccccgttacggtacctaccgttccgttcccgtccccgttccccg

SEQ ID NO: 134285 - DNA, 680 bp, Homo sapiens
  misc_feature: GYAE6OF02F9KBY.17.33.C11.1.454.CMB.1.raw
  modified_base (168)..(168): a, c, t, g, unknown or other
  misc_feature (168)..(168): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcagganccctcactgactgtcgtccccaggagggacagtcactctcacctgtgccttccaacactggagcagtcaccagtcgcttactataccaaacgtcggttccacgtcgaacgaaaccgtggaacaagacaccgagggcactctattagtacgtaacaaacaacaaacactacctacggaccctcgacccgtatccgtacacggtcctcccgtcggttacggggactaaacggctcgccctcgacctacgtcgtacgtggtcgtgcacggtcctaggacggacggaacggtcgtcgtaacttaacgttacgtcgtaccttacttaccgttaacgtttgggtcggttcgtcgttgttcggtacgttacgttacgggtaccgggacggaaccgtacgtacggttaccgtaccggttaccgttaaaccggtcaaccggtacccgtaacgggtaccgttccggtaccccccggttacggttacccgtaccttcccgttacccggttacccccgtccccg

SEQ ID NO: 134286 - DNA, 931 bp, Homo sapiens
  misc_feature: GYAE6OF02IC6IP.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctctcacttgctgcccagggtccaattctcagactgtggtgactcaggacgccctcactgactgtcgtccccgaggaggacagtcactctcaccgtgtcgcttccaacacgtggacgcagtaccaccgtagtcgtacttaactactaccgtaaacgttggttaccagtaccgaaaggtaaaccgtaggaaccaaacgcccgtaaacccgacgggtacctaacccttattaacgttttaaacgtaacgttaaaaaccaaaaaccgtaaacctaaaaccgtacccgttaaccgtaccgggtaacccccctacggaccccgttactttccgtaccgtaacggttccccttaacccccggtttccggggttacgggggaaaccgtaaacggtccgtacccggttaaccccgtacggtaaccgttaaccgttcgggtttaccggttagggttccggttaccgtaccgtacgggtcccggtttaacgggaacgggtaccggtaacgggttaccgttaacgttaaccttaacggtttaacccgtaccgttaacccgtttaccgttttaccggtttaaccggtttttcgggtacgggttacgtaccgtttagggttaccggtttacgttacggtttaccggggaaccggggtaaccgggttaaaccgtaccggttaccgtaccggtttaccggttaacgttaaccgtaccgtacccggtaacggtacccggtaccgtcccccggtaccccggttaccggttccgtttacccgttacccgtttaccccggttacccccgttaccccgttacccgtttaaccccgg

SEQ ID NO: 134287 - DNA, 690 bp, Homo sapiens
  misc_feature: GYAE6OF02JT768.17.33.C11.1.454.CMB.1.raw
  modified_base (132)..(132): a, c, t, g, unknown or other
  misc_feature (132)..(132): n is a, c, g, or t
  modified_base (353)..(353): a, c, t, g, unknown or other
  misc_feature (353)..(353): n is a, c, g, or t
tcagcgtagactagcacgaccggtgctcgatttagagtgagctcgttgggtttggggcgtggcgccaggggtcccttccaatatcagcaccatggcctggactcctctctttctgttcctcctcacttgctncccagggtccaattctcagactgtggtgactcaggagccctcactgactgtcgtccccaggagggacagtcactctcacctgtcgcttccaacacgtggagaccacgtccaccagtgccttaactactaccaaacgtcggtaccagacacggtaaaccctgaacaacgccacccgaaggtcactactatttacaagtaacaaacaacaaaccaccgtaccncgtacccaccgacctacttcctacacgttaccctccgttaccggtacgggacaaacgtctaccgacccagtacaccgtgtcgtacgtgcgtcacgcgtacggaggacgacgtacgtcgacttacgttccgtacgtacctaccgttacttacgttggtcggttcgtcgtcggttccgtagttaccggttacggacgggttaacggaccggtaaacgttccgtaagggtaccgtttaaccgttacgggtacctaaccggacccggtaaccggtacccgttacccgtccccggttccggtaccctaaccgttcccgtttacccctaccccttacccccgg

SEQ ID NO: 134288 - DNA, 703 bp, Homo sapiens
  misc_feature: GYAE6OF02I1ZU1.17.33.C11.1.454.CMB.1.raw
  modified_base (169)..(169): a, c, t, g, unknown or other
  misc_feature (169)..(169): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (411)..(411): a, c, t, g, unknown or other
  misc_feature (411)..(411): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacnccctcactgactgtcgtcccaggaggacagtcacctctccacctgtcgacttccaacgcgtagganaccgagtcaaccgngtcgactttacactaccgtaaatcggtccagacaacgtaaaccgtaggaactaaacggaccaacccgaacgggtacctaccgtacgtaacgtttaacgtaacgtaacctaaaacaaaccgaaaacctacccgttaccgtaccgaaccccgttgaaccccgtnttaccgtaccgtacgcccgtaccctacggttcgggaacctaaacgtccgtactacccgtacgacctacgtcgttcgtacgggttcgtacgcgtacggtcgtaacggacggacgggaaccgtcgtacgactacgttactacgtcctacgttacgttaagttcggtggttcgcgtagtcgtcttacggtggaccggtaaggcccgtaagtcgtaccgtacgtaaccgttacgtccgaacgtaccgagtacccgtcgtacccctcggtacctccgtcgttacccgtcccgtcccg

SEQ ID NO: 134289 - DNA, 732 bp, Homo sapiens
  misc_feature: GYAE6OF02FSUHX.17.33.C11.1.454.CMB.1.raw
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
tcagcgtagactagcacgaccggtgctcgatttagagtgagctcgttgggtttggggctggcgccaggggtcccttccaatatcagcaccatgggcctgggactcctctctttctgttcctcctcacttgctgccccagggtccaattctcagactgtggtgactcaggacgccctcactgacctgtgtccccagggagggacaggtccactctcacctgtcgctttccaacactggancagtcaccagngcttacatccaaactggttaccngcacgaacctgggaacaancaccagggcacgtcattanacgtaacaaacaacaacgctacctacggaccccttgccccgtaattcctacgacggtccttcccgtccggttagggggacaaacggcgttacggtaccctcggtaactaccgttaggtcccgtggtcggtcgccgtacgtccgttacgggaacggacggtaacgggtctacgggtaaccttaccgtttacgtaccggtaccctttactacccggtttaacggttttccgggttaggttcggttccgttcgggttacggttaccgtttagttacccggggtcgggtaaccgggtaccgtaaccgggtcgtaccggtccgttaacgttacggtacgtaacccgtaccccgggtaagtcccgttcccggtaccccgttcccggtacctacccggtttccgtccccgggttccccttacccccgg

SEQ ID NO: 134290 - DNA, 732 bp, Homo sapiens
  misc_feature: GYAE6OF02HSQWQ.17.33.C11.1.454.CMB.1.raw
  modified_base (177)..(177): a, c, t, g, unknown or other
  misc_feature (177)..(177): n is a, c, g, or t
  modified_base (217)..(217): a, c, t, g, unknown or other
  misc_feature (217)..(217): n is a, c, g, or t
  modified_base (618)..(618): a, c, t, g, unknown or other
  misc_feature (618)..(618): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactnactgtcgtccccaggacgggacagtcactctcacctgtcncttccaacactggagcagtaccaccagtgcttatactaccaaaactcggttccagacaacgaaacctaggacaagacaccgaggccacactattttaactaagtaaccaaaacaaaccgaaaacaccttacccgtcggacccctcgacccgtattaccgtcgaacggccttaccccgttccggttacgggggacaaaacggtccgtacgacccgttacgaacgtccgttacgttcggtggttcgtgaccgtacgaccgtaggacgggtaccgagggtactacgtaaccttaacgttaccgttaccgttaccctaacgtttaccgtttacgttttagggttcggttacgtcggttaggttacgtacgttaacgggttccggggacgggaacgggtaaaccgnggtaccgttaccgggtaaccgtttacgttaacgtccggaccgacccggtaacggtccctaccgcccccggttcggacccgttaaccgtcccgttacccttccccgttacccccg

SEQ ID NO: 134291 - DNA, 751 bp, Homo sapiens
  misc_feature: GYAE6OF02H1T35.17.33.C11.1.454.CMB.1.raw
tcagcgtagactagcacgaccggtgctcgatttagagtgagctcgttgggtttggggctggcgccagggtcccttccaatatcagcaccatggcctggactcctctctttctgttcctcctcacttgctcgcccagggtccaattctcagacgtgtggtgactcaggacgccctcactgactgtcgtccccagggacggacagtcacgtctccgaccttgtcgaccttaccaacgtacgtacggagactacggtccaccgtagtcgtccttactactaccgtaaacgttcgttaccagtcgaaacgtaaccgtggaacaacgacccacccggacgggccaccgtacttaatttaacgtaacggtaaaccaaaacctaaacaaaccgtccctaccgtacccggacccctacggtcccgtacttacctaccgtaccggtacccttcccggtaccggttacggggaacctaacggtccgtacgcccgtagtacctacgttcgtcgtaggttcgacgtaccgtacgtacggtaggaacgggtacgtcggacctaacgttaccttacgtaccgttcctacccgtttacgttaaccgtttgggttaggtcggtactcgtggtaccgtagttcggttaccgggacggtacgaaccgcgttacgtaccgttacgtacttacggaccgtaaccggccgtaaccgtcctacccggtaccccgttcgacccttaccgtccgttaccccgttaccctacccgg

SEQ ID NO: 134292 - DNA, 894 bp, Homo sapiens
  misc_feature: GYAE6OF02FNRIS.17.33.C11.1.454.CMB.1.raw
tcagcgtagactagcacgaccggtgctcgatttagagtgagctcgttgggtttgggggtctggcgccaggggtcccttccaatatcagcaccatggcctggactcctctctttctgttcctcctcgacttgctgcccagggtcaagttctcgagtactggtgggtgactcgaggagccctcactgactgtcgtccccaggacgggacagtccactctaccaccgttgtcgccttaccaactacgtggacgcctagtaccaccgacgtcgtacctttactactacctaaacgtcggttaccacgtacaacgaaaccgttcggaacaacgccctaaccccggaggtaccaacccgttactaacttttaacgtaacgtaacccgtaaaaccgaaaccgtaaaacctaaccttaccgtaaccgggtaaccccccgtcgggtaccccgtacgttcccgtacgacggtcccgttaccccgtttaccgggttcgggggtaacctaaacgggtccgttaaccgtcccggttaagaccgtacgttacggttcgtacgggtcgtacgtacgtacccggtacgtagggaacgggaaccgggtacgggtaccgttacgggtaaccgttaacggtttaccgtaacggttacctttaaccggtttacccgttttacggtttacgggtttcgggttacgtaccggttacggggttacgacgggttttacggtttcccgggaaccggggttaacgggtaaacccgtagggttacccgttacgggttaccccggtttacgtaacgggttacccggaaccgggtaacccggtaaccggtccggttacccccggttacccgttacccggtaccgtaaccccggtttcgttaccccggttccccgttacccccg

SEQ ID NO: 134293 - DNA, 666 bp, Homo sapiens
  misc_feature: GYAE6OF02GK9FG.17.33.C11.1.454.CMB.1.raw
  modified_base (221)..(221): a, c, t, g, unknown or other
  misc_feature (221)..(221): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
tcagcgtagactagcacgaccggtgctcgatttagagtgagctcgttgggtttggggggcgccagggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacncgtggacgcagtccacagtgtacttactacttaccgaaacttcggttaccagctaacgaaacctacgggacaagcctacccgaggccgactcgtatttatagtaacaaacaacgaaacacctcctacggacccctcgcccgacttcacgacgcctccctcgttacggggcaaacgctcgcctgacacgtntcgtggtacgtgaccncgacgtggacggacggacgcgtgtacttagtacgtcgaccttacttcgttacgtttcgggtgttacgtcgttaggtcttacgttcgggttacgggccggggaacgggtaaccgacggttacgaaccggtccgttaacgttagtcccgtaacggaccgtaacggtccgtaccccggttaccccgtcggttcccgtacccttccgtttacccgttccccgttacccctcccgttaccccgg

SEQ ID NO: 134294 - DNA, 848 bp, Homo sapiens
  misc_feature: GYAE6OF02HV0B6.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcacgtgactgtcgtccccgaggacgggacagtcacctcctcacgtgtcgccttaccaaccagtcggagacagtccaaccgacgttcgtaccttactaacgttacccaaacgttcggttacccaggacctaaacggaaacccgttaggggaaccaacgtaaccgacccccggtaggggacctaaccttactaattttaacgttaacgttaaaaccaaaaccgtaaaaccaaaacctactacccggttaccggtaacccccgttcgacccgacgtttacccacggaaccggttcctaccccgttacgggtttaccggggggaaccttaaacggccgtaacgtccccgtaagtaccgtaccgtttcggtaacggtttcggtaccgtaggtccgacgtcccgaggtaaccgggaacggtaacgggtcctagtaccttagttaaccgtaccgtaccttacgtttacgttacggtttcgttggggttaccgtaccgtttaggaccggttacgtttaccggtcggggtaacgggtaaccgggaaccgttacggtccgtaacgttaaccggttacttaacggccgttaacgaacccgggaacttcccggttcccgggtaccccgttcgtacccgtacccgtttaccggttccccgttccccggtacccccttcccgtttaacccg

SEQ ID NO: 134295 - DNA, 672 bp, Homo sapiens
  misc_feature: GYAE6OF02JK61R.17.33.C11.1.454.CMB.1.raw
  modified_base (339)..(339): a, c, t, g, unknown or other
  misc_feature (339)..(339): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgcctgcccagggtccaattctcagactgtggtgactcaggagccctcactgactgtgtcccaggagggactagtcactctctacctgtcgcttaccaacactgggatcacgttacaccgagtcgctttaacactaccaatgggttccagcaacgaaccgtcggacaagccaccgaggcactcattatagtacaaacaacaacactcctcgacccncgaccgactctcgacggcctaccgtccgttaggggacctaacggcctcgcctacgacctactcgtccgtaggtcgtagccgtacgcgttacggaagggaccggaggtcgtagtaccttaagttaccgtacgtaccgtccttacgtttacgtttgggtacggttcgtaacgttcgtacgtacgttcgttaccgggccgggtaaggtaaccgacggtacggtacgttacccggttaagttacgtacggtaccgtcgaaccggtccgtccggtcccccgttaacgggtcctaccggtttcccgtccggtttaccccctacccgttcccttacccgg

SEQ ID NO: 134296 - DNA, 802 bp, Homo sapiens
  misc_feature: GYAE6OF02I78JU.17.33.C11.1.454.CMB.1.raw
  modified_base (168)..(168): a, c, t, g, unknown or other
  misc_feature (168)..(168): n is a, c, g, or t
  modified_base (206)..(206): a, c, t, g, unknown or other
  misc_feature (206)..(206): n is a, c, g, or t
tcagcgtagactagcacgaccggtgctcgatttagagtgagctcgttgggttgggctggcgccagggtcccttccaatatcagcaccatggcctggactcctctctttctgttcctcctcacttgctgcccagggtccaattctcagactggtggtgacctcaggacnccctcactgactgtacgtcccaggaggacagtcactcnccacctgtcgtaccttaccaactcgtaggacgtcaacgtccaacctaggtcgtaccttaactactacccaaacgttggttacccagtacaagtaaacccgttggaacgaaacgtcccgaaccgacgggtacctacggttaacctattttaaacgtaacggttaaacccaaaaaccaaaaccggtaaaccctaaccttacccgtaccggtaaccccgttaccgtacccccggttaattaccgtaccgaaacggttaccccttcccgttaaccggggttacgggaaaccgtaaacgtaccggtccgtacccgtagtaaccgtaacgtacggttctacgggttcgtacgaccgtacgtaccgtacggtacggacgtcggtacgtacgtactacgttacgtcgtaccttaccgtacgttacgttcggtcggtacgtcgtacgttacgtactacggtttaccgggacggttaccgggaacctaacgtacgtaccgtaccgttacggtaaccggttaccaaccggtacccggtaacgtccggtaaccccgtccccgtttacgaacccgtttaccttccggttacccgtaccccgttaccccg

SEQ ID NO: 134297 - DNA, 650 bp, Homo sapiens
  misc_feature: GYAE6OF02FUELI.17.33.C11.1.454.CMB.1.raw
tcagcgtagactagcacgaccggtgctcgatttagagtgagctcgttgggtttggggggcgccaggggtcccttccaatatcagcaccatggcctggactcctctcttctgttcctcctcacttgctgcccagggtccaattctcagactgtggtgactcaggagccctcactgactgtgtccccaggaggacagtcactctcacctgtgcttccaacactggagcagtccaccagtgcttactatccaaatcggttccagcagaacctgacagccaccaggcactcattatacgtacaaacaacaactactcctcggacccctgacccgtattccgtcacggtcctcccgtccgttacgggggacaaacgtcctcgaccctgactactggtctgggtcgtgctcgtcgtcggaacggtacggaggtccttagtaccttagttacctcgtacccttactccgtttacgtttgggtcgttcgtacgttggtacgttacgttacgttccggggaccggggtaacggacccgtaaggcccggttcgtaaccgttacgttaacgtacgaccgtcccggaaggtcccgtcccgtaccccgttcggtcctaccgttacccggttcccgtcccccgttcccgttacccgttaccccg

SEQ ID NO: 134298 - DNA, 762 bp, Homo sapiens
  misc_feature: GYAE6OF02GXGOT.17.33.C11.1.454.CMB.1.raw
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactggtggtgactcgaggacgccctcactgactgtcgtcccgaggagggacagtcactctcacctgtcgtccttccaactacgtggacgcacgtccacctagtgtccttaactactacctaacgttcggttaccgagacaacgaaaccgtaggacaacgacccgaccgacggacctactactaactttaataacgtaaaacaaaacctaaacaaacctaccttcccgtacgacccctaccgacccttacttccgtacgtaccgtcccgttcccgttccgggtcggggaaccaacggtcctaccgccctacggacctacggttcggtacgttgggtcgaacgccgtacgtacggtacgggaacgggacgtacgggtctacgtaaccttagttacccgcgttaccttccttcggtttacgtttcgggttaggtcgtcggttcggttcgttaccggttcggttaccggggacgggtaacgggaccgtaggtacgttacgttaccgttaacggttacgttacggtaccgtaccggtaaccggtaccgggtcccgttcccggtaccccggttccgtaccgttcccttccggttcccgttaccccctcccgttaccccg

SEQ ID NO: 134299 - DNA, 815 bp, Homo sapiens
  misc_feature: GYAE6OF02H0FX2.17.33.C11.1.454.CMB.1.raw
tcagcgtagactagcacgaccggtgctcgatttagagtgagctcgttggggtttgggggggcgccagggggtcccttccaatatcagcaccatggcctggactcctctcttctgttcctcctcacttgctgcccagggtccaattctcagactgtggtgactcgaggacgccctcactgactgtcgtccccgagggagggacacgtcactctccacctgtcgccttaccaacacgtcggacgcgacgtaccaccgtagtcgtaccttactaactacctaaacgttcggtttacccacgaccaaacggaaaccgttacggaaccgaaaccgccgaaaccccggacggggtacctaaccttaccgttaaattttaacgtaaacggttaaaccaaaaacaaaacctaaaacctaccgtcccgtaacccgggtaccccctcggaccccgttaacttcccttaccgacggtcccttccccgtaccgggttaccgggggactaaacggtcctaccggtcccgtacggacctaaccgttcggttccggtttaggtcgggttcgaccgtacggtcccggtagggaacgggacggtacggtacgtacgtaacttacgtttacgtacgtacccttacgtttactttaccggttttggttcgggtctggttcggttcgtacggtaccggttcgggacgggtaccggtaccgtaagggtccgtacggtaccgttacgttaaccggactaccggaccgtaacggtccgtccccggtcccgtacggtccctacgttacccttaccggtccccttacccgtcccgttacc

SEQ ID NO: 134300 - DNA, 702 bp, Homo sapiens
  misc_feature: GYAE6OF02JLPK0.17.33.C11.1.454.CMB.1.raw
  modified_base (231)..(231): a, c, t, g, unknown or other
  misc_feature (231)..(231): n is a, c, g, or t
  modified_base (333)..(333): a, c, t, g, unknown or other
  misc_feature (333)..(333): n is a, c, g, or t
  modified_base (436)..(436): a, c, t, g, unknown or other
  misc_feature (436)..(436): n is a, c, g, or t
tcagcgtagactagcacgaccggtgctcgatttagagtgagctcgttgggtttggggggcggccaggggtcccttccaactatcagcaccatggcctcggactcctctcttctgttcctcctcacttgctgcccagggtccaattctcagactgtggtgactcaggagccctcactgactgtgtccccaggaggacagtcactctcaccgtgtgccttccaacactggacnccagtaccaccagtcgacttacgtatacctaaacgtcggttccaacggcaagtaaaccccgttagaaccgtaacgctacccgaaggccgaactcgactttanacgtacaaaccactaacaactccgtagacccctagcccgtagttctaccgacggtctcccgttccgtacgggggctaaacggcctaccgttcgacactccgtntacgggtctggactaccgcgtacgacgggacaagggctacggtcttaacgttccaacgtccttacgttccgtttacgttagggttcggttagtccgtaggtttcgaccgtttaagtccgggtaccgggaagggtccctaaggtaccgtacggtaccgttgttaaccgttacgaccgcccggtaacgaccgttacccggccccttaccgggtaccaccggtttccttaccccggtcccgtaccccgttaccctccggtttaaccccg

SEQ ID NO: 134301 - DNA, 673 bp, Homo sapiens
  misc_feature: GYAE6OF02FG1X8.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgttgcccagggtccaattctcagactgtggtgactcaggagccctcactgactgtcgtccccagggagggacagtcactctcacctgtcgcttccaacactggagcagtcaccagtcgcttactactaccaaactggttaccagcacgaaacctcggacaacgcacccgagggcacgtcatttatacgtaacaaacaaacaaacactacctacgacccctcgcccgtattcctcaggcctcccgtccgttcggggacaaacgctcgccctgactctgtctggtgtcgcgtacgccgtaggacggaacgaggcgtgtaactacttacgttcgtccttacgtttccttaacgtttggttaggttcgtcgttggtacgtcgttacgtttaccggggccgggtaacggggaacctaaggacgttccggtaacccgtttacgtaacggtaccgtaaccgacccggtaacgggtacccgttcccggtacccccgttcgggtcccgttacccgttaccgtttccccggttcccccggtacccctttacccccg

SEQ ID NO: 134302 - DNA, 929 bp, Homo sapiens
  misc_feature: GYAE6OF02G2YJB.17.33.C11.1.454.CMB.1.raw
  modified_base (170)..(170): a, c, t, g, unknown or other
  misc_feature (170)..(170): n is a, c, g, or t
tcagcgtagactagcacgaccggtgctcgatttagagtgagctcgttgggtttggggggcgccaggggtcccttccaatatcagcaccatggcctggactcctctctttctgttcctctcacttgctgcccagggtccaattctcagactgtggtgactcaggagccctnactgactgttccaccgaggacgatcgactactccgtcctacgtgtcgttcctaaccaacgtcggtacggacacgtcaccacgtgtctacttactacaacctaggtcgtacacgacgaaaccgtacgacgaacacgacccaccgggtacgtacctactactttaattaacgtaaaccgtaaaaccaaaaccggaaaacccaaccgtaccgtaccggtacccccggtacctccggtaccctttaacttccggaccgtaccttcccccgttaccccggtttacggggggaaccgggaaaaccgtaccgttcccggtaccccggtaccgtaacggtaacccgtttcggttacccggttacggggttcggttccggtacctaccgggtaccggttccggaacgggggaaccgggtacggtacgtacgttaacgttaaccgtttaaccttccgggcccttaacccggtttaccttttaccggtttagggtttcgggtacgtttccctaggtttggtacccgttaaccggtttcgggggaacccgggaggggttaaacccgactttaacccggttcggttaaacccggtttaacccgtttttaggtaccggtacccggtaaaccccgggtaacccgggttaccgtttcccccccgggttaaccccccgggtttacccggttacccgtttacgttaccccggtttttccccccgggtttaaccccccttacccccccgtttacccgtacccgtttttaacccccggg

SEQ ID NO: 134303 - DNA, 713 bp, Homo sapiens
  misc_feature: GYAE6OF02H0SVZ.17.33.C11.1.454.CMB.1.raw
  modified_base (441)..(441): a, c, t, g, unknown or other
  misc_feature (441)..(441): n is a, c, g, or t
tcagcgtagactagcacgaccggtgctcgatttagagtgagctcgttgggtttgggggctggcgccagggggtcccttccaatatcagcaccatggcctggactcctctctttctgttcctcctcacttgctcgcccagggtccaattctcagactggtggtgactcaggagccctcactgactgtcgtccccgaggagggacagtcactctcacctgtgcttaccaacacgtggagcagtcactagtgtacttaactactaccaaactcggttaccacgacaacgaaaccgtcggaacaacgccaccgacgggacactctaatttactaacgtaaccaaaacaaacaaacctaacctaccgtaccggtaccccgtacgacccgtacttcgtacgacggtccctacccgttcggtacggggtacaacgtcgtacgcccgtnactacgtcgttacgtcggtacggtcgcgtaacgcccgttaggaacgggacggacggtccgtagtaaccgttacttacgtcgttacccgttacgtttaccgtttaacggtttcgggtacgggttcgtacggtttcggtacgttacgttacggttcgggacggggaaccggtaaccgaacgttacgtacggtaccgttacgttacggtaacaccgtaccggaacggtccgtaccgtacccgtccggtcttaccgtccttccgtaccctaccccg

SEQ ID NO: 134304 - DNA, 637 bp, Homo sapiens
  misc_feature: GYAE6OF02GNNVN.17.33.C11.1.454.CMB.1.raw
  modified_base (310)..(310): a, c, t, g, unknown or other
  misc_feature (310)..(310): n is a, c, g, or t
  modified_base (494)..(494): a, c, t, g, unknown or other
  misc_feature (494)..(494): n is a, c, g, or t
  modified_base (590)..(590): a, c, t, g, unknown or other
  misc_feature (590)..(590): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccgaggagggacagtcacctctcacctgtcgtccttccaaactacgtggacgcacgtaccacctagtgacttactatccaaactcggttaccagcaagaacctggacaagcacccgaggcacncatttatatacaaacaacaaacactccgacgaccctcgaccctattctaccgacgtccctacccgtccgttgggggacaacggctcgcctacgactacgtcgtcgtggtgtcgcgacgccgtggaacggacgaggtcgtactactagttacgtcgtaccctcttaccgttacgtttggtacggngttaccgtggttcgtacgttcggttacgggacgggtacgggtaacctaaggccttaaccggtacgttacgttacgacgtaccgaccgacgggtccncccgtccccgtacggtccttaccgtccgttcccgtacccttcccccg

SEQ ID NO: 134305 - DNA, 821 bp, Homo sapiens
  misc_feature: GYAE6OF02HS7IP.17.33.C11.1.454.CMB.1.raw
  modified_base (110)..(110): a, c, t, g, unknown or other
  misc_feature (110)..(110): n is a, c, g, or t
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagcgtagactagcacgaccggtgctcgatttagagtgagctcgttgggtttggggggcgccaggggtccttccaatatcagcaccatggcctggactcctctctttcngttcctcctcacttgctgcccagggtccaattctcagacctggtggtgactcaggtagcccctcgaactgactcgtcgtccccagggaggacagtcnctcgacacctgtcgtccttaccaaaacncgtaggacgtcaggtccaccggtagtgtaccttaactataccgtaaagtcggttaccaggtaccaagaaccttggaaccgtaacggccctaaccgacgggactacctacgtaacgtttaagtaaaccgtaacaaaaccgtaaaacaaacctaactacccggtaccgtaccccgtacgtccccgtaacttaaccgtcgaccggtacccttccgtaaccgggttagggggaacctaaacgggcccttaccggtaccacgggtaactaccggttccggtcgttaacggggttgttcggaaccgtcggttaaccgcggtaacgggtacccggtaacgggtccgtaacgtaacgtttaacgtaaccgttcgtaccgtttaaactttcgttacgggtttacggtggttccgggtaagtcgttaacgttaccttaggtaccggggtaacgggaaccggtaacctaacggtacgtacggttaccgttacgttaacggttaccgtacccgaacccggtaccggacccgtacccgttaccccggtcgttacgcccttaccggttaccccttcccttaccccggtacccttacccgg

SEQ ID NO: 134306 - DNA, 710 bp, Homo sapiens
  misc_feature: GYAE6OF02JRWNN.17.33.C11.1.454.CMB.1.raw
  modified_base (150)..(150): a, c, t, g, unknown or other
  misc_feature (150)..(150): n is a, c, g, or t
  modified_base (166)..(166): a, c, t, g, unknown or other
  misc_feature (166)..(166): n is a, c, g, or t
  modified_base (246)..(246): a, c, t, g, unknown or other
  misc_feature (246)..(246): n is a, c, g, or t
  modified_base (524)..(524): a, c, t, g, unknown or other
  misc_feature (524)..(524): n is a, c, g, or t
  modified_base (578)..(578): a, c, t, g, unknown or other
  misc_feature (578)..(578): n is a, c, g, or t
tcagcgtagactagcacgaccggtgctcgatttagagtgagctcgttggggtttggggggcgccaggggtcccttccaatatcgagcaccatggcctggactcctctctttctgttcctcctcacttgctgcccagggtccaattctcanctgtgtagactcaggngccctcactcgactgtcgtccccgagggacgggactagtcactactcaccgtgtacgtaccttaccgaacacgtgggacncagtaccaccgtagtagttccttacgactacctaaagtcgttaccagtacacgtaaaccctgaaccgaagaccaaccgagggaccacgttactaatttaacgacgtaactaaaaccaaaccgtaaccgtaccgttaccgtacccggtaaccccgtacgtaccccgttacgtacctaccgacggtcccttcccggttacggttacgggggaaccaacgtccgtaccggtcctacgacctacgttctacggtgtcgcacgtacgccgtaggacgtacggngtacgtacgtactagtacgtacgtaccgttacttacgtttacggttggtacgtnttcgttacgtcgttacgttacgtacgggacggtacggtacgaccgttcgacgtacgttactacgctaccgacgtcggaccttcccggaaccgtctaccgttcgtccgttcccgtacccaccttcgtaacccg

SEQ ID NO: 134307 - DNA, 758 bp, Homo sapiens
  misc_feature: GYAE6OF02FL6F6.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgccttaccaacacgtggacgcagtccaccgagtcgtacttactactaccaaactcggttccagacaacgtaaaccgtcgggaacaaacggccaacccgacgggacactctatttaataacgtaacctaaaacaaacaaaacactacccgtacgacccctcgacccgattctaccgaggccctcccgttccggttcggggactaaacgcctacgcctacgacctacgtcgtacgtcggtcgtcgcgtacgccgtaggacgggacggtacgggcttacggtaccttaacttaaccgttccggtaccctttaccgttaccgttttacgttttcggggttacggttcggtcggttcggttacggttaccgtttacgggttaccggggtacggggtaaacccggggtaacgtaacggtacgttaccggttaccggttaccgttaacggtaaccggaaccgtaccccggtaacggcccgttaccccggtacccccggtttcgggtacccttacccggttaccgtttccccgttaccccttaaccccccg

SEQ ID NO: 134308 - DNA, 770 bp, Homo sapiens
  misc_feature: GYAE6OF02HBCLX.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccaggaggacagtcactctcacctgtcgtcttccaacacgtggagcacgtcaccgagtgcttactactaccaaactggttaccagacaacgaaccgtggaacaacgccacccgacggacactactatttatacgtaacaaaaccaacaaaccacctaccgtacggacccctcgacccgtattacctccgacggtccctcccgtttaccgggtcgggggtaaccaaacggccgttaccgtacccgtacggaacgttaccgttcggttccgtttagggttacgtcgtaccgacgtacccgtacgggaacggggaacggtacggtaccgttacggtaaccgtttactttaccgtacgtacccgttacccgtttacgtttaaccgtttgggttggttacggtccgtttacggtccggttacgttacgggttccgggaacgggttaacgggaacccttaaggtccgttaccggttaaccgttacgttacgtaccgtaccggacccggtaaccggccgttcccgttaccccgtccggttacccgtaccgttccgttacccgttacccccgttcccctacccgttacccgg

SEQ ID NO: 134309 - DNA, 808 bp, Homo sapiens
  misc_feature: GYAE6OF02H43LL.17.33.C11.1.454.CMB.1.raw
  modified_base (163)..(163): a, c, t, g, unknown or other
  misc_feature (163)..(163): n is a, c, g, or t
  modified_base (173)..(173): a, c, t, g, unknown or other
  misc_feature (173)..(173): n is a, c, g, or t
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (484)..(484): a, c, t, g, unknown or other
  misc_feature (484)..(484): n is a, c, g, or t
tcagcgtagactagcacgaccggtgctcgatttagagtgagctcgttgggtttgggggcgccaggggtcccttccaatatcagcacatggcctggactcctctctttctgttcctcctctacttgctcgccagggtccaattctcagactgtggtagactcgnggacgccctnaactgactgtcgtcccgaagggacggacagtcactctacncctgtcgtaccttaccaaacgtcgtggaacncgtaacgtaccgaaccgagttcgtacctttaactactaaccgaacgttcggttaccagaccgaaacgtaaccgtaggaacctaacgcccaaccggaggacctacctagtaactttaacgtaacgtaaacaaaacaactaaaccggccttaccgtaccgggtaccctcggaacctttccttcgaccgtacgtccttcccggtagggtacgggaacaacggttcctcggtacctacgtaccnggtttacgttacggtggttacgtaccgacggtcgtaccgagggaacggtacggtcggttacctagtacccgttattacccggtacgttaccctttagttacggtttacgtttcgggtggttccttaacggtcgtttcgggttaccgtttacggcgggggtaaccggtaacgtaaaccgtcggtttaaaccggtaccgtttaccggtttaagttacccggccgtaaccggtaacccggttcccggtccggttaaccccgtcccgggtttaacacccgtttcggttaccccggttccccttcccgttccccggttatttaacccgg

SEQ ID NO: 134310 - DNA, 667 bp, Homo sapiens
  misc_feature: GYAE6OF02F8YBO.17.33.C11.1.454.CMB.1.raw
  modified_base (174)..(174): a, c, t, g, unknown or other
  misc_feature (174)..(174): n is a, c, g, or t
  modified_base (390)..(390): a, c, t, g, unknown or other
  misc_feature (390)..(390): n is a, c, g, or t
  modified_base (480)..(480): a, c, t, g, unknown or other
  misc_feature (480)..(480): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
  modified_base (535)..(535): a, c, t, g, unknown or other
  misc_feature (535)..(535): n is a, c, g, or t
  modified_base (547)..(547): a, c, t, g, unknown or other
  misc_feature (547)..(547): n is a, c, g, or t
  modified_base (591)..(591): a, c, t, g, unknown or other
  misc_feature (591)..(591): n is a, c, g, or t
  modified_base (642)..(642): a, c, t, g, unknown or other
  misc_feature (642)..(642): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctnactgactggtcgtccccgagggaggaccagtccactctcacctgtcgtccttaccaacactggagcctagtccaccgtagtcgtaccttaacgtactaccaaacgttcggttaccaggtaccaaacgtaaaccgtacgggaacaaacgtcccgaacccgaggggtccaacttaccgtaatttaactaacggttaaaccaaaaacaaacctaaaacnccttacccgtaccggtaaccccgtcgtaccccgtaatttccgccgaacgtcccttcccgtttcgggtcggggaacaacggtctcgtaccngaccagtcgttacgnggttancgacncgtcgagcggagtacggctgactgttacncgacttacgttntacgttgagtcagttgtagtcgttgtacggcggtacgacgttanccggtcgtactacgtacgaagccgacgtacgtccgaccgtcccgtccgtanaccgttcgttcccgacccgttaccc

SEQ ID NO: 134311 - DNA, 914 bp, Homo sapiens
  misc_feature: GYAE6OF02HYMQ2.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgacttgtgtccccaggagggacagtcactcctcacctgtgcttccaacactggagcagtcaaccagttcgcttaacgtactaccctaaaacgttggtttacccaacggaccaacggtaaaaacccgtaggaaccgaaaacgacccgtaaacccccgaacgggggaccctaaacccgtttacccgtaaattttttaaagttaaaccgggtttaaaaaccaaaaaacccgaaaacctaaaaaaccctaacccttaccccgttaaccggggtaacccccccgtttaccggaacccccggtattttacccgtaccggtaaccgggtccctttacccccgttacccgggtttacgggggggtaacctaaaaccggtccgttaccgaccccgttaaggaacccgtaaccgttcggttaccgttagggttcggtacgtacgtaacgtcccggttagggaacggggtaaccggtacgggaccgttacggtaaccttaacgttaccgtacgtacccgttaacgtttccgtttaacgttttggggtcggttacggtcgtttcgtacgttaccgtacggtttccgggacggggtaacgggtaaccgtaacgtccgtacgttaaccgtttacgttaaccgtaccgtaaccggtaccccgaacgggttccctacccggtcccccgttaccggttacccgtaaccgttcccgtttaccccggtttaccccctaccccgtttacccgttaacccgg

SEQ ID NO: 134312 - DNA, 677 bp, Homo sapiens
  misc_feature: GYAE6OF02FQLKP.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttaccaacactggagcagtcaccagtcgcttacatccaaactggtccagacagaaacctggacaagccaccagggcactctattatagtaacaaacaacaaaccactcctacggacccctcgacccgtattctccacgtcctcccttcggttacggggacaaacgtcgtacgtacccgtgactacgtcgtcgtggtcgtacgcggtccgtggaacggtacggtacggcgtacgtaacgttacgttaccgtcgtacccttacctttaccgtttacgttcgggttacggttcgtcgttaggtcgtaccgtttacggttcgggtaccgggtacgggtaaccaaggtaccgttacgtaccgttacgtttaacgtccgtaacggtacccgtaaccggtcccgtcccggtcccccgttaccggttccctaccgttacccggtcccgttccccgtaccccgttccccg

SEQ ID NO: 134313 - DNA, 888 bp, Homo sapiens
  misc_feature: GYAE6OF02G6QRB.17.33.C11.1.454.CMB.1.raw
  modified_base (167)..(167): a, c, t, g, unknown or other
  misc_feature (167)..(167): n is a, c, g, or t
  modified_base (173)..(173): a, c, t, g, unknown or other
  misc_feature (173)..(173): n is a, c, g, or t
  modified_base (213)..(213): a, c, t, g, unknown or other
  misc_feature (213)..(213): n is a, c, g, or t
tcagcgtagactagcacgaccggtgctcgatttagagtgagctcgttgggtttggggggcgccaggggtcccttccaatatcagcaccatggcctggactcctctctttctgttcctctcacttgctgccagggtccaatttctcagactgtggtgactcgaggacnccctanactgactgtcgtccccgaggacgggacagtacactctacnccgtggtctaccttaccgaaactaccgtaggacggactacgtaccgaaccgtaggtcgtaccttaactacgtaaccctaaacgttcggttaccaggtacaaacggtaaacctaggacaacgcgaaccgaagggcctacgtacttaacttaaggtaactaaacgaaacaaactaactaccgtaccgtacggtacccctggaccctacgttacctcggaaccgttcctacccgtacggttacggggaaccaaggtccgcgtaccgtaacgacgtaaccgtttcggacgttcggtacgtcgtaacgtccgcgtaacggggacgtacgggaacgtcgttacgtaaccgttacgttaacgtacccgttactttaaccggtaccgttttaaacgggtttcggtaacccgggttcttacggttccggttaacggtacccggtttaccgggttttacccggggaaccgggggtaacccggttaaaccgggttaaccggtaacgggtttaaccccgttaacggtttaacccggttaacgttaacccgggtacccggtaaacccgggttcgggtaccccgtacccccggggtttaccccggttacccggttacccggtttacccggttcccggtttaacccccggtttccccggtttacccccgttaccccggtttaaacccggg

SEQ ID NO: 134314 - DNA, 658 bp, Homo sapiens
  misc_feature: GYAE6OF02F136Y.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtcgcttccaacactggagcagtcaccagtcgcttaactataccaaacgttcggttaccacgcaagaaacctaggaacaacgccgacccgaggcactctatttatacgtaacaaacaaacaaacactccgtacgacccctcgacccgtacttctcgacggtcctccccgttccggttacgggggaccaaacgcgttcgaccgtacgacctacgtcgttacgtggtcgtcgtcacgccgtaggaaggtaacgaggtcgtacgtaacttacgttacgtaccgtacccttactttaccgttactttcgggtggtcgtcgttggtcgtacgttagtccggggacggacgggacctaacgtcgtacgtaccgttacgttagtccgaacgtccggacgtcccgtaccgtaccccgtcgtacgtccttccgttccgtaccccctacctcccgttaccg

SEQ ID NO: 134315 - DNA, 720 bp, Homo sapiens
  misc_feature: GYAE6OF02JO569.17.33.C11.1.454.CMB.1.raw
  modified_base (195)..(195): a, c, t, g, unknown or other
  misc_feature (195)..(195): n is a, c, g, or t
  modified_base (248)..(248): a, c, t, g, unknown or other
  misc_feature (248)..(248): n is a, c, g, or t
  modified_base (510)..(510): a, c, t, g, unknown or other
  misc_feature (510)..(510): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactggtcgtccccgaggngggacagtcactctcacctgtcgtccttacaactacgtggacgcagtccaccngtagcttactaactaccaacgtcggttaccacgacgaacgtaaaccgtggacaacgccacccgagggacacctacgtattacgtaacgtaaccaaaccgtaaccaaaaccgtacctaccgtaccggaacccctccgacccgtacttaccgtaccgacgtccctcccgttccggttacgggggacaaacggtcgtccgacccgtacgtacccgtacgtcgttcgtagggttcgtcgacgtacggaccgttggacgggtaacgngggtactacggacgttacttacgtacgtacccttaccgttacgttacgttttggtacggttccgtggttcgttcgtacgttacgggtacgggtccgggtaaggaccgtacgtaccggttacttaccggtacgttaacggccgtacgtacccggaacgtccgtacccgtcccggtccgttcctacggttcccttccggtcccggttacccc

SEQ ID NO: 134316 - DNA, 852 bp, Homo sapiens
  misc_feature: GYAE6OF02I8J3D.17.33.C11.1.454.CMB.1.raw
tcagcgtagactagcacgaccggtgctcgatttagagtgagctcgttgggtttgggggcgccaggggtcccttcaatatcagcaccatggcctggactcctctcttctgttcctcctcacttgctgcccagggtccaattctcagactgtggtgactcaggagccctcactgactgtcgtcccaggtagggaccagtcactctcacctgtgcttccaacacgtggagacagtaccaacctagtcgtacttaactacgtacccaaaactcggttccacggacgaacgtaaaacccgtcgaacaaacggtccaacccgaacggggtaccacgttactaactttttaacgtaacggtaaacccgaaaacctaaaaccgtaaaaacccacccgtttacccgttaccggggtaaacccccccgttcggaaccccggttaaactttccgtaaccgtaaccgggttaccccttacccccgtttacgggtaccgggggtaaccgaaaaccgttccccggtaccgtccccggtaagaacccgtaactacgggttaccggttaggtacgtttccgaccgtaaccgggtcccgtaacgggaacgggaacccggtaagggtaaccgtacgtaacgttaacgttaccgtaccgtacccttaaccgttaccgttttaacgtttgggtacggtacggttccgttaagtcgttaacctaggttttaccggggacggtaaccgggacctaaggttccgtaccgtaaccgttacttaaccgcgttacggaaccccgtagtacccgtacccgcccgttaccgtacgtaccgttaccgttcccggttccccgttacccgttacccttaccgg

SEQ ID NO: 134317 - DNA, 607 bp, Homo sapiens
  misc_feature: GYAE6OF02HH98Y.17.33.C11.1.454.CMB.1.raw
  modified_base (229)..(229): a, c, t, g, unknown or other
  misc_feature (229)..(229): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (412)..(412): a, c, t, g, unknown or other
  misc_feature (412)..(412): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactaactccaaaacgttcggttaccaagcaagaaaacctggaacaagccaacccgagggccaacctcatttataagtaacaaaacaacaaaacactcctcggaccccngacccgattcncagcctccctcgttcggggacaaagctcgccctagactactgtctggtntacgcagcctaggaggacgaggcctagacttatactcgacctactcttacgtttggtggttgcttgtcgtacgttagttccgggagggaaccgggacaagtccgtacgtaccgttacgttaacgtaccaacggacccgtaaaggcctaccggcccccttacggtcctaccgtccgttaccgtcccctaacccccg

SEQ ID NO: 134318 - DNA, 770 bp, Homo sapiens
  misc_feature: GYAE6OF02FNBNN.17.33.C11.1.454.CMB.1.raw
  modified_base (230)..(230): a, c, t, g, unknown or other
  misc_feature (230)..(230): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccgagggaggacagtcactctcaccgtgtgtccttaccaacncgtggacgcagtccaccagtcgtacttaactactaccaaacgttcggttaccagcaacgaaaccgtggaaccaacgtccaacccggaggcctactacgtaatttagtaacgtaaacgaaaacaaaccaaacctacctccgtaccggtacccccgtcgacccgtattccgtaccgacggtccctcccggttcggtacggggaactaacggtctaccgtacccgtacgtacctacgttcgttaccggtggtacggtcgtcgaccggtcgtaagggtacgggaaccggtacgggtacgttacgtaaccgttacgtttacgtaccggtaccctttacgttcccgttttaacgggtttcgggttccgggttgttaccggttcggttaccggttacgttaccgggttaccgggtaaccggggtaacggtaaccgtacggttaccggtacggttacccgttacgttacgaaccgtaccgaccgtacggtccgttaccccggtccgtacgttacccgtccgttacccgttcccgtccccgttaccccg

SEQ ID NO: 134319 - DNA, 773 bp, Homo sapiens
  misc_feature: GYAE6OF02F0AYN.17.33.C11.1.454.CMB.1.raw
  modified_base (231)..(231): a, c, t, g, unknown or other
  misc_feature (231)..(231): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgacctgtcgtcccagggagggacagtcactctcacctgtgcttccaacactggancagtcaccagtcgacttaaccatacctaaactcggttaccagacgaagaaacccgttgggaaccaagacaccccgagggacctaccgtctaatttaataagttaaaccaaaactaaaaccgaaaaccgtacctaccgtaccgggaaccccctacggaccccgtaacgttcctaccgacggtaccctccccgtttacccgggttcgggggaaccgtaaaaccggtcttacccggacccccgttacgaacctaccgtcgttacggttacgggtacgtcggtacctacgggcccgtacggaaacggggaaccggtacgggtactacggttaaaccttagtttaccttaccgtaccctttaccgttaccgttaacgttttacgggtacgggttcgtcgttacggtcgtaccgttaggttccgggacgggtaacgggacccgtacgtaccgttggtacccgttacgttaacgtcgacggacccgtaaccggccgtaccggaccccgttcggtaccctacccgttcttacccgttccccttacccccg

SEQ ID NO: 134320 - DNA, 720 bp, Homo sapiens
  misc_feature: GYAE6OF02FJ2RO.17.33.C11.1.454.CMB.1.raw
  modified_base (171)..(171): a, c, t, g, unknown or other
  misc_feature (171)..(171): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (391)..(391): a, c, t, g, unknown or other
  misc_feature (391)..(391): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
tcagcgtagactagcacgaccggtgctcgatttagagtgagctcgttgggtttggggggcgccaggggtcccttccaatatcagcaccatggcctggactcctctcttctgttcctcctcactttgctgcccagggtccaattctcagactgtggtgactcaggagccctnactgactgtcgtccctaggaggacagtcactctcacctgtcgcttccaacctactggacgctagtccacctagtcgcttactacttccaaacgttggtccagctaagaacctcggaacagccgaccaggccnctcatttanactacaactaacaacnctcctacggaccctcgccgtattccacgacgtcctcccgtacggttcggggaaccacggtacnccgtcctagaccgtacgttcgtcgtcggtanccgtacnccgtacgttcggacggtacgaccggtgtacgtaacccttagtaccctcggtacccttaactccgtttacggtttacgggtacgtcttccggttacgtctacttccggttaaacgggggccggtaacgggttaccctaaaggtccttaccgggtacccgtttaaccttacgggtaccccttaccgggaaccgttaaacggtcccccggtaaacccgttcccccggtacggtacctttaaccccggtccgtttaccccgggtaaccccttacccggtccctttaaacccccgg

SEQ ID NO: 134321 - DNA, 726 bp, Homo sapiens
  misc_feature: GYAE6OF02HETV6.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcagggagccctcactggactgtcgtccccaggaggacagtcactctcacctgcgtcttccaacacgtggagcacgtcaccagtgacttactactacctaaaacgtggttacccaagacaaacgaaaaccgtacggaacaaacggccaacccgacggggacacctactactttaagaacgttaaacaaaacctaaacaaacacctaccgtaccgaaccctgtaccccgacttcgaccacgtcctacccgtacggttaggggacctaaaggtcctaccgacctacgaacgacttcggtacttgggtcgtacgtctaacggcccttagggaacggacgggtaactacggttacgtaacttaacttaccgtacgtccctttaacgtcctttaacgtttgggcgttacgacgtagtacgtagttaaccgggttcggacgggtaacggaaccgtaacgtaccgtaccggtaacccgtttaggttaaacgtccgtaacggtacccggaacggttccgtccggtacccccgttggtaccaacccggtttcgtacccgttcccccgtaacccg

SEQ ID NO: 134322 - DNA, 763 bp, Homo sapiens
  misc_feature: GYAE6OF02GJM1L.17.33.C11.1.454.CMB.1.raw
  modified_base (409)..(409): a, c, t, g, unknown or other
  misc_feature (409)..(409): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggagccctcactgactgtcgtccccagggagggacagtcactctcacctgtcgccttaccaacacgtgggacgcacgtccaccgtagtcgtactttaacctaactacccaaaacgttcgggtttacccagaccaacggtaaaacccgttggaacaaggccaaccccgagggccactcctaattttataagttaacaaaaccaaaccaaaacgacctaccgtcggacccctcgtccccattaccncgacggccttccccgttcggttcgggggacaaagccgtcgacccgtcgacctactcgtcgtcgggtgtcgacgacgtctaggacggacgacgggcttaggtactaacttaccgtcggtacccttaccgttacttaacggttttcgggttcgggttagttccgttacggtcgtacgttacggttccgggaccgggggtaacgggtaaccgaacggtaccgttacgggtacccgtttagttaaccggttaccggaaaccggttcccggtaaaccggtcccgttaccccggtacccccggttaccggttacccgtacccgtttcccgttacccccggttacccccttaaccccccgg

SEQ ID NO: 134323 - DNA, 765 bp, Homo sapiens
  misc_feature: GYAE6OF02IXPWW.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtcgcttccaacactggagcagtcaccagtcgcttactactaccaaacgttggttaccagaccaagaaacctaggaacaaagccaacccgagggaccaactactattttaataagtaaccaaaacaaacaaacacttaccgacggtacccctcggaccccgtattaccacgacgtccctacccgtccggttacggggactaaacgctacgccctagaaccacgttcggtacgttgggtacgacgtacgacgtccggtacggaacgggtaccggtaggtaccgttacgtaaaccgttaacgtttaaccgtacgtaccctttaccgttaccgtttacggtttttcgggtcgggtttacgtaccgttaggttacgtaccgtttaacgggtttccgggacgggggaacgggtaaaccgaagggttaccgtacggttaacccggttcgtttaaaccggtaccgtaccggaacccgtaacggtcccggtcccggttaccccccggttaccggttacccgtaccgttaccccgtttacccggttcccccttaacccccg

SEQ ID NO: 134324 - DNA, 744 bp, Homo sapiens
  misc_feature: GYAE6OF02JV4BV.17.33.C11.1.454.CMB.1.raw
  modified_base (320)..(320): a, c, t, g, unknown or other
  misc_feature (320)..(320): n is a, c, g, or t
  modified_base (436)..(436): a, c, t, g, unknown or other
  misc_feature (436)..(436): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactcctcaccttgtcgtccttaccgaactattggagccaagttccaccgagtcgtacttactactaccaaacttcggttccagacaacgaaaccgtggacaaacgccaccgaggccactntaattacgtagtaacaaaacaacaaccactccgtcgaccctacgtacccgtattccgtacgacgcctaccccgtcgtacggggactaacgcctcgtaccgctactaccgtgttcgngtgtcgacgcgtcacgggtacggacggcgacgtatacgttaacttaccgtacggtacccttacgttaccgtttacggtttacggtcgggttcttcggttacgttacggttaccgttacgttaccgggggccgggtaacgggtaaccgttaaccggtcgtaaaccggtttaccgttaaaccggttacgttacggaacccggtaaccggtaaccggttcccgtcccgttaccccccgttggtaaccccgtaccgtttccccggttaccccgtttcccccccgttaaccccgttcccgtttaacccccggg

SEQ ID NO: 134325 - DNA, 666 bp, Homo sapiens
  misc_feature: GYAE6OF02HSTDZ.17.33.C11.1.454.CMB.1.raw
  modified_base (406)..(406): a, c, t, g, unknown or other
  misc_feature (406)..(406): n is a, c, g, or t
  modified_base (437)..(437): a, c, t, g, unknown or other
  misc_feature (437)..(437): n is a, c, g, or t
  modified_base (465)..(465): a, c, t, g, unknown or other
  misc_feature (465)..(465): n is a, c, g, or t
  modified_base (485)..(485): a, c, t, g, unknown or other
  misc_feature (485)..(485): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtcccgagggagggacacgtcactctccacctgtcgcttaccaaacacgtgggacgccacgtccaaccgaggttacgtacctttaactacttacccgtaaaacgttcggttacccagactaaacgaaccgtacggaacaacgccaacccgaggaccacctacgtaatttacaacgtaaccaaaaccaaacaactacctccgtaccgaccctcgccgtattcncgtacgtcctccgtacggtcgggacaagtcncgtcctacgactacgtcgtcgtggtgcncgacgcgtgacggcgacgtntacgtatactacgtctaccttacttcgttacgtttgggtcgtgtcgttgtcgtacgttcggttccgggacgggtaaccggtacgacgtcgtcgtaccgttacgttaacgtaccgaccgtaccggacgtcccgtaccggtccccgtacgtccctaccgtttcccgttcccgtcccgttcccg

SEQ ID NO: 134326 - DNA, 794 bp, Homo sapiens
  misc_feature: GYAE6OF02GK8W7.17.33.C11.1.454.CMB.1.raw
tcagcgtagactagcacgaccggtgctcgatttagagtgagctcgttggggtttgggggctggcgccaggggtcccttccaatatcagcaccatggcctggactcctctctttctgttcctcctcacttgctgtccagggtccaattctcagactgtggtgactcgaggacgccctcactgactgtcgtccccagggagggacagtcactctcacctgtctcttaccaacacgtggagcgacgtcaccagtcgcttactactacctaaacgtggtccagcacgaacgtggacacgacaccgaggcactctatttatactaacaaacaacaaactctaccgtcgaccctcgacctacttctactacgcctccgtcggttcgggacaacgtacgtccgtcctacgacacgttcggtcttacgggtgtcgcgtaccgtcgtaggacggacggacggtcgtacgtacttaccttacgttacgtaccttaccgttacgtttacgtttgggttcggttacggtttcgtcgtttacggttacgtttaccgggtttaccgggggtaccgggtaaccgggtaaccggtaaccgggtacccgttacccggggtttaccccgtttaaccgggttttaaaccggtccccgggttaaacccgggtacccccggttaaaacccggggttccccccggtttacccccgggggtacccccccgtttacccggggtttaaacccccgtttcccggttttacccccggtttttacccccccgggttttccccccgttttacccccccccggg

SEQ ID NO: 134327 - DNA, 782 bp, Homo sapiens
  misc_feature: GYAE6OF02JR17P.17.33.C11.1.454.CMB.1.raw
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactggtggtgactcaggacgccctcactgactgtcgtccccgaggagggacagtcactctcacctgtgcttaccaacncgtggancagtccaccgagtcgtacttactactaccaaacgtcggtacccaagcgaacgtaaaccgtggaaccaaacgacccgaacccgagggtaccaacgtcttaacttttaacgtaacgtaaaccaaaaccaaaccaaaaccgtacccttacccggtaccggaacccccctccggaccccgtaattacctccaaccggtcccctccccgttaccgggtacgggggaaccaaacgtccgtcgtacccctacgaacctaccgttacggttccggttcgggtacggtaccggtcgaccgtaccgtacgggaacgggtacgaccggtccgtacggtaacctttaacgttaccgttcccgtaccctttacgttaccgtttacggttgggttacggttcgtaccgttggttaccgtcgttacggtaccgggtaccgggtaacggtaccgaacgtcgtacgtaccggttacgttaacgccgtaaccggcctaccggttaccgcccgtaccccgttaccggtccctaccggttcccgttacccggttcccccgtaccccg

SEQ ID NO: 134328 - DNA, 849 bp, Homo sapiens
  misc_feature: GYAE6OF02JJ16E.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgccaggtccaattctcagactgtggtgactcaggacgtccctcactgactgtcggtccccgagggtacgggactacgtaccgacttcctccgtaccgtcggtacgtcccgttaccaaactccgttagggaccgaccgacgttacccaccgtagttacgtaccgtttaacctaacttacccgtaaaccgttcgggtttacccgtaggcctaaacggtaaacccgtaacggggacctaaacggacccgtaaccccgacgggggtacctaccggtaccttaacgtttaactaacggtaaccgtaaaccaaaacgtaaccctaacgttacccgtacgggtaaccccctacggacccgttagtaccccgttaccgaacgggtccccgttaacccgttccgggttacggggggaacctaaccgttccgttacgacccttacggactaaccgttcgtacggttcggtaagttcccacggcgtccggtaggtaacggcggaagtccgtaagtacgtacgtttaccgtgtacccgttactttacggttaacggttttcggtgggttaacgttcgtacgggtacgttaccgttaggtcccggggtaacggtacggggtacctaacggtccgttaccgtacggttactttacggaccgtacgtacccggtacgccgttaccgcccggtgtcccttaccggtccgtccgttaccctacccgttaccgttaccc

SEQ ID NO: 134329 - DNA, 679 bp, Homo sapiens
  misc_feature: GYAE6OF02FH55O.17.33.C11.1.454.CMB.1.raw
  modified_base (388)..(388): a, c, t, g, unknown or other
  misc_feature (388)..(388): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcctttccaacactggagcagtcaccagtcgcttactactaccaaactcggttccacgacaacgtaaaccgtggaacaacgaccaccccgagggcctactactaatttacgtaacgtaaccaaaacaaacaaaacctaccgtacccgtaccggaccccctcgaccccgtattcncgacggtccttaccccgttcggtacgggggtaacaaacggtcctcgacccgtacgtacctaccgttggttcctagggtcgtacggacgacgtaccgtacggaacgggacggaggtcgttagtaccttacgttacgttcgcctttacttcgtttaccgtttggtcggttgtcgttgtcgtcgttaggttcgggacgggacggtacacgtcgtacgtaccgttatacggtcgacgtacccgaaggtccgccgtccccgtggtaccgtaccgtccgttcccgtcccctaccccg

SEQ ID NO: 134330 - DNA, 714 bp, Homo sapiens
  misc_feature: GYAE6OF02H4RNV.17.33.C11.1.454.CMB.1.raw
  modified_base (317)..(317): a, c, t, g, unknown or other
  misc_feature (317)..(317): n is a, c, g, or t
  modified_base (432)..(432): a, c, t, g, unknown or other
  misc_feature (432)..(432): n is a, c, g, or t
  modified_base (487)..(487): a, c, t, g, unknown or other
  misc_feature (487)..(487): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgccagggtccaattctcagactgtggtgactcaggagccctcactgactgtcgtccccgagggaggacagtcactctccacctgtcgcttaccaactacgtggagcacgtccacctagtgtccttactactacctaacttcggtaccacgcaacgaaccgtggaacaacgccaccgacggctacctntatttaacgtaactaaccaaaaccaacaaacctacgtacccgaccggtacccctcgaccctacttccgcgaccgtccctaccgttcggtacggggacctaaacgctcgcccgtanaccgtaccttgtcggttcggtacgtgccgagtccgtaggacgggacggtgacgtntaaccgttattaccgccgtaccttacgttaccgtttcgttagggtggttcttccggttgtacgttacgtttacgggtccgggacgggtaccggaaccgtaacgtcggttaaccgtaccgtttaacgtaaccggtcgtaacccggtccggtaaccggtcccgtccccggttaccccgtaccggttaccttacccccgtttcgttacccccggttccccttaacccccg

SEQ ID NO: 134331 - DNA, 711 bp, Homo sapiens
  misc_feature: GYAE6OF02IGFKQ.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtcgtccttaccaacacgtggacgcagtaccaccagtgtaccttactactacctaaaacgttcggttaccgagacaacgtaaacctggaacaagaccgacccgagggaccacttctaattttagtaacgtaacaaacaacaaacactccacgaccctcgaccgtattctcacgtcctcctccgttcggggacaaacgtcgcgtcccgtagactacgtggttcgtggtcgtcgcgtacggccggttaggaacggacggtacggacgtacgtaacgttaacttacgtcctaccgttaccttccgtttaagtttcggtcggtacgtccgttaggtcgtacgttacggtacgggccgggtaaacggtacccgaaggtccgttacggtacccggtttagttaacggttacgaacccggtaccggaaccggttaccgtaccccggtccccggttaccggttactaccccggtttacgttccccggttaccccttaaccccccgg

SEQ ID NO: 134332 - DNA, 952 bp, Homo sapiens
  misc_feature: GYAE6OF02FGZR7.17.33.C11.1.454.CMB.1.raw
  modified_base (170)..(170): a, c, t, g, unknown or other
  misc_feature (170)..(170): n is a, c, g, or t
  modified_base (253)..(253): a, c, t, g, unknown or other
  misc_feature (253)..(253): n is a, c, g, or t
tcagcgtagactagcacgaccggtgctcgatttagagtgagctcgttgggtttggggctggcgccagggtcccttccaatatcagcaccatggcctggactcctcactttctgttcctctcacttgctgcccagggtccaacttctcagactgtcggtagactcaggacnccctcactgactcgtctaccccgaggacgggaccagtcacgtcttccaccgttgtacgtcccttaccaaccgacgttgggacncctacggttccaacgtacggttccgaccttttaactaacgttacccgtaaaccgttcgggttcccaacggtccgtaaaccggtaaaacccggttcgggaaacccttaaaccggggtccccaaacccccgggtacgggtacccgttaaaccttaccggtttaacttttaacttaaaacggttaaacctaaaaacccggtaaaaccaaaacccgttacccgttaacccgtacccgggttaccccctaccggtaccccccggttaagttcccttaaccggaccggttccccgtacccccggttttacccggggttacgggggggaaacccaaaccggttccggttcccgtaccccggttaaccggtacctaacccgggtttcggtacgtttaccgggtacgttccggtaccgtacgtccggggttaacggaccggggaacggtaccggtaccgttaacggtaacccgttactttaacccggtccggtaaccctttaccgttaccggtttaccggttttgggaacgggttctaccggttgttaccggtaaccggtttacggttacgggggacccgttaaacgggaccgtacggtacccgttacggacgtttaccccgtaagtacccggaccgtaacccggaaccggtccgttaccccgcccggtaggtccccttagggtacccttcccgttcccccgtacccg

SEQ ID NO: 134333 - DNA, 836 bp, Homo sapiens
  misc_feature: GYAE6OF02HSMMN.17.33.C11.1.454.CMB.1.raw
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggcgccctcactgactggtcgtccccgagggaggacagtcactctcacctgtcgcttaccaacacgtcgggagactagtaccaaccaggtgcctttaactaactacctaaaacgttcggttaccaacgacaaacggaaaccgtacggaacaaacgaccgacccgacgggacctaaccgttacttaactttaacgtaacgtaaaccgaaaactaaaccaaaacctaaccgtacccgtacggaacccctaccgacccgttacttcgtacgtaccggtccctacccggttaccgggtacggggactaaacggtccgtacccggtaccgttacgaacctacgtttcggacggtttggtacgtacggacgtacgtacgtacgggaacggacggtagtaccgtacgtaacgtttacgttaaccttaccgttaccttaaccgtttaccgttacggtttacgggtacggttcgttaccggttacggttcgtaccgtttacgggttaccggggacgggtaccggtaaaccgaacggttccgtaacggttacccgtttacgtaaacgggttaaccgaaccccggtaaccggttaacccggtccccgttaccccgttaccccggtttacccggtacccgttaaccccgtttccggtttaccccgttacccccgttacccccg

SEQ ID NO: 134334 - DNA, 723 bp, Homo sapiens
  misc_feature: GYAE6OF02FWBI1.17.33.C11.1.454.CMB.1.raw
  modified_base (169)..(169): a, c, t, g, unknown or other
  misc_feature (169)..(169): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacnccctcactgactgtcgtccccgaggagggacagtcactctcacctgtgtcttaccaacacgtggagcagtccaccagtcgtcttacctataccaaacgttcggttaccagtacaacgaaacctaggaacaagccgacccgagggcctacctctatttactaagtaacaaaaccaaaccaaacctaccttaccgtccggtacccccgtacgtaccccgtacttacctaccgtacggtacccttcccgttaccgggttcgggggaacctaaacggtacccgtccgtacccgtacgtaaccgtaccgttgttcggttgggtcgtacgcgacgtcggtaggacgggacggtacggtactacggtaaccttacgttaccgtacgtacccgtttacgttaccgtttacgttttcgggtcgtgttccgttgttacgtcgttacgggtacgggtacggggtaacggaaccgtacgtcgtacgttaccgttacgtacgtcgaccgccggtaacgtccgtcccgtcccgtacgtaccttccgtccgttccccgtcccttccccg

SEQ ID NO: 134335 - DNA, 703 bp, Homo sapiens
  misc_feature: GYAE6OF02FLYCN.17.33.C11.1.454.CMB.1.raw
  modified_base (173)..(173): a, c, t, g, unknown or other
  misc_feature (173)..(173): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctnactgactgtcgtcccgaggagggacagtcactctcacctgtcgcttaccaacacgtggacgcagtcacctagtctactttactactacccaaacgtggtttccagcaacgaaacctacggaacaagccaacccgagggcactactatttatacgtaacaaaacaaacaaaccacctaccgtacggacccctcggcccgtattccaccgacggtaccctcccgttccgttcgggggaccaaacggtcgtaccgtcccgtacgtaactaccggttgttaccggttgggttacggtcgtaccgaccgtaccggtagggaaccgggtaccgggacgggtaccgtaacggtaaccttacggtttaccgttaccggtacccttacttaccgtttacgtttaggtcggttcgtcgttgtcgtcgttacggtcgggacggtacgggaaccacgtcgtacgtaccgttacttacggtcgaccgtccgaacggtcctaccgccccgttcgtaccgtcgttcccgtccgttccccgtcccg

SEQ ID NO: 134336 - DNA, 727 bp, Homo sapiens
  misc_feature: GYAE6OF02GZE4P.17.33.C11.1.454.CMB.1.raw
  modified_base (225)..(225): a, c, t, g, unknown or other
  misc_feature (225)..(225): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgccttccaacnctggacgcacgtcaccagtcgacttactactacctaaaacgtcggttaccagacaaggaaacctcggaacaacgccaacccgagggacacgtctatttataacgtaacaaaaccaaacaaacctactccgtaccggacccctacggaccctacttcctacgacggtccctcccgttccgggtacgggggaccaaaggtcctccggaccctacgacctactcggtcgttcggtgtcggccgtacggacgtcgggacggtacgacggtcgtacggttaaccttacgttactcggtacctttacgttcctttcggtttacgggtggttacgtcgtttacgtggtacttgggttaccgggacgggtaacgggtaaccgaagggtccgtaaccgttaccggttaccggtttaacggtccgtaaccggaacccgtacgggtaccctcccggttacccccgtacggttacccgttccgttacccgtttacccggttcccccgttacccc

SEQ ID NO: 134337 - DNA, 701 bp, Homo sapiens
  misc_feature: GYAE6OF02GSTRV.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacacgtggagcagtcaccagtcgcttactactaccaaacttggttaccagccgaaacgtaacgtacgaaccgaacgacccgaccggacggactactacttaattagaactaaacaaaacaacaacctaccgtcgtaccgaccctccgtaccgtacttcgacgacgtcccttacccgttcgggtacgggaactaaccgtcgtacccgccgtacgacctacgttacgtcggttggtcgtcgacgcgtacgtggacgacggcgtcgtactactactcgccgtacttacgttcgtttaggttcggtagtcgtcgttgacgttacgttcgggtaccgggagggtaaccgaacgtacgtcgttaaccgtacgttacgttacgaccgtaccgggtaccgtaacggttccccgccccggttaccccgttcgtacccgttcccgtttcccgtacccccgtttacccccttacccgtaccccgtttaacccgg

SEQ ID NO: 134338 - DNA, 695 bp, Homo sapiens
  misc_feature: GYAE6OF02H2G4D.17.33.C11.1.454.CMB.1.raw
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
tcagcgtagactagcacgaccggtgctcgatttagagtgagctcgttggggtttggggctggcgccaggggtcccttccaatatcagcaccatggcctggactcctctctttctgttcctcctcacttgctcgcccagggtccaattctcagactgtggtgactcaggagccctcactgactgtcgtccccaggagggacagtcactctcacctgtcgtcttccaacactggagcagtcaccagtcgtacttacataccaaactggttaccagcaagaacctggacagccaaccgagggacaccttntaactttanaacgtaaccaaaacctaacgaaaacctaccttaccgtaccggaccccctggaccccgtaacttcctacgacggtccctcccggttccgttacggggactaaacgtcctcggaccctagacctactggtacgttcgggtcgtacgacgtacgtccgtacggacgggacggtacggactacggtaacttacgttaaccgttcgtaccttacttacgtttacggtttcggtcggttcgtcgttcgttcgtacgttacggttacgggacgggtaccggacgacgtccgtacggtaccgtacgttacgtccgacgtaccggtaaccggtccgacccggtaccccgtccggtaccttacccgttccgtcccgttccccgtccccg

SEQ ID NO: 134339 - DNA, 621 bp, Homo sapiens
  misc_feature: GYAE6OF02IPE7E.17.33.C11.1.454.CMB.1.raw
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
  modified_base (390)..(390): a, c, t, g, unknown or other
  misc_feature (390)..(390): n is a, c, g, or t
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtcgcttactataccaacttggttaccagcaagaaacctggacaagcaccgaggcactctaattatagtacaaacaacaaacactcncgaccctcgccgatcncgngcctcctcgtgggacaacgctcgcctanacactgtcctggtcgtgcncgctggacggacggacggtctgacttattaccgtcgtccgttactcgtttacgtttggtggttcgtgttgtgtacgttacgtccgggacggacgggtaccgaacggtcgtacgtaccgttacgttaacgtcgtaccggaacccggtaacgtccgttaccccggtcccccgttacggttaccgtacccgttccgttacccgttttacccccgtaccccttacccgttacccg

SEQ ID NO: 134340 - DNA, 655 bp, Homo sapiens
  misc_feature: GYAE6OF02FNMOT.17.33.C11.1.454.CMB.1.raw
  modified_base (227)..(227): a, c, t, g, unknown or other
  misc_feature (227)..(227): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtcaccagtgcttactatccaaactggttccagcaacgaaacctggaacaagcacccgagggcactcatttatagtacaaacaacaaacactacctggacccctgcccgattctacacggcctccctccgttgggggaccaaagctgccctgacacgtgtactggtgtgctacgcctggacggacgagggtctgtacctattaccgtcgtacccttactctttaacgttttgggtggttcggtacgttgttcggtactttacggttcggggcgggtaacgggacccgaaaggccttagggtacccgttacgtttaacggtccgtaacggtaccccgtaacgggtcccgtaccggtccccccgttcgggtcccctaaccgtttcccggttcccgtttaccccctacccccgtttcccgttaccccgg

SEQ ID NO: 134341 - DNA, 678 bp, Homo sapiens
  misc_feature: GYAE6OF02GQ2A3.17.33.C11.1.454.CMB.1.raw
  modified_base (85)..(85): a, c, t, g, unknown or other
  misc_feature (85)..(85): n is a, c, g, or t
tcagcgtagactagcacgaccggtgctcgatttagagtgagctcgttgggtttggggggcgccaggggtcccttccaatatcagnaccatggcctggacccctctctttctgttcctcctcacttgctgcccagggtccaattctcagactgtggtgactcaggagccctcactgactgtcgtccccgaggagggacagtcactctcacctgtgcttaccaacacgtggtacgcagtcacctagtgtaccttactaactccaaaacttcggttcccagacaacgaaacctggaacaacggccacccgagggccactactattatataacaaaacaaccaacacctcctcggaccctcgcccgtatcctacacggccttcccgtcggttcggggacaaggtcctcgcccgtagacctacgtcgtcgtaggtcgcgtacgccggtacctagggtacgggacgggtacggtcggtacgtaaacgttacgttacttcggtacccttacgttacgttacgtttggggttcgtcgtccgtgtacgtcgttaggtcgggacgggacggtacgactcggtacgtacgttaccgttaagccgaccgtaccgtacggtccgttcccggtcccctccggttccctacttcccggttcccgttacccgtccccttcccgtccttaacccg

SEQ ID NO: 134342 - DNA, 581 bp, Homo sapiens
  misc_feature: GYAE6OF02JB2B9.17.33.C11.1.454.CMB.1.raw
  modified_base (161)..(161): a, c, t, g, unknown or other
  misc_feature (161)..(161): n is a, c, g, or t
  modified_base (167)..(167): a, c, t, g, unknown or other
  misc_feature (167)..(167): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (414)..(414): a, c, t, g, unknown or other
  misc_feature (414)..(414): n is a, c, g, or t
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
tcagcgtagactagcacgaccggtgctcgatttagagtgagctcgttggggtttgggggcgccaggggtcccttccaatatcagcaccatggcctggactcctctctttctgttcctcctcacttgctgcccagggtccaattctcagactgtggtgactnaggacncctcactgactgtcgtacccagggaggacagtcactcncactgngacttcaactactgganacagacaccgtatcgtacttaactactccaaattcgttccagcacgaaaccgtgacaagccacgagcnctanattagaactaacaacgaacaacacctacgtacgacccgtnacccgtattaccgacgtcgtacctcccttacggtcggggactaacgctacgacctgaactacgtctagtcggtnacgctaacgcgtaggagaacggtcgctagaacttntaaccgtctaccctntacttacgttggtggtctgtctgtacgttagcggtacggagacaagtcgtagaccggtacttagctcggaccgaggccttaccgcccgtancncttcgtccgtaccgtcctcctacg

SEQ ID NO: 134343 - DNA, 753 bp, Homo sapiens
  misc_feature: GYAE6OF02JHM7A.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttacatccaaactggttccagcagaaacctgacaagcacccagggcactcattatagtaacaaaaccaacaaaaccactacctacggaacccctcgacccgtatttactaccaggcctaccccttccgttacggggggtacaaacggtcctcggacccttgaaccacttcggtacttggtcgtgccaacgccgtaggagggaccgagggtcttacggaacgttaactttaacgttacggtacccttacctttaccgtttaccgtttgggttacgggttacggctttacgggttacgttaccgtttaacgttaccggggtaccgggggtaacggggtaaacccgtaacgggtaccgttaccgtaaccgggtttaccgtttaacggtacccgtaaccgtaccccggaaacgggttcccgtaacccggttccccccccgttagggttacccctaaccggtttaccccgttaccccgggttttcccccgaccccccgttttaccccgttacccccgg

SEQ ID NO: 134344 - DNA, 725 bp, Homo sapiens
  misc_feature: GYAE6OF02JYGZH.17.33.C11.1.454.CMB.1.raw
tcagcgtagactagcacgaccggtgctcgatttagagtgagctcgttgggtttggggctggctccaggggtcccttccaatatcagcaccatggcctggactcctctctttctgttcctcctcacttgctgcccagggtccaattctcagactgtggtgactcaggagccctcactgactgtgtcccgaggaggacagtcactctcacctgtgcttaccaacactcggagcagtcaccagtcgtcttaactaactaccctaaaacttcggttaccacggcaaacgaaaaccgtcgggaacaaacggaccaccccgaacggggccaacctacctaattttactaaactaaacctaaaaaccgaaaccaaaaaccaaccttacccgtaccgggtaaccccctccggtaccccgtacctttcctaaccgacggtacccttccccgttttacggttacggggggtaacccaaaggtcccgttaaccgccccgttaggtaaccctaaccgttcgtttacggtcggggttcgtcgacggtaccgtaccggtacgtacggacggtacgggtctacgtactacgtactcgcctactccttagttgtggttcgtgtgtgtcgttacggttcgggcgggtaacggaccgaagtcgtcgtacttacgttaccgtcggacgtacgacggccgtaccgtcccttccggtctaccgtcgttcccgtccccgttaccccg

SEQ ID NO: 134345 - DNA, 612 bp, Homo sapiens
  misc_feature: GYAE6OF02JCZ3E.17.33.C11.1.454.CMB.1.raw
  modified_base (409)..(409): a, c, t, g, unknown or other
  misc_feature (409)..(409): n is a, c, g, or t
  modified_base (426)..(426): a, c, t, g, unknown or other
  misc_feature (426)..(426): n is a, c, g, or t
tcagcgtagactagcacgaccggtgctcgatttagagtgagctcgttgggttttgggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggacgcacgtccaccagtgcttactactccaaactggttccagacagaaaacctggacaagccaccagggcactatatttatacgtaacaaaacaacaaaccactccgtcgacccctgccctattcacacgcctccctcgtcggggacaacgtctcggccctagacactcgtcgtggtagtgcncgacgtggacgggacgngtacgtgtacctagttaccgttcgtacctacttcttacgtttggtgttcgtcgtagtcgtcgttacgttccgggacggtaagggaccaaggtctcggtaccgttacgttaacgtacgaccgaccgaacggtccgcccggtccccgttccgggtacctccgttccttaccggttccccctaaccccg

SEQ ID NO: 134346 - DNA, 734 bp, Homo sapiens
  misc_feature: GYAE6OF02J0F1E.17.33.C11.1.454.CMB.1.raw
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (471)..(471): a, c, t, g, unknown or other
  misc_feature (471)..(471): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactcncacctgncttacacactggagcagtcaccagtgtaccttactataccctaaacgtcggttccagacaacgaaaccgtacgggaacaacggaccaccccgaagggtacctactctaactttagtaacgtaaccaaaacaaccgaaactaccgtccgacggtaaccccctcgacccgtacttaccacgacggtccctcccgtcggttacgggggaactaaacgccgtccgacctcggaactcggttagtcgttacggtcgtaccggntaccggtccgtagggaacggacgacggtactacggtcctaacttcgtactccttacttcgttacgttcggtcggtagtcgttcggtacgttacggttacggttccggggtacgggaaccggtacccgtaagttccgtaaggttacccgttacgtttaacggtccgtaaccggtcccggtaaaccggttcccggtacccgggttaccccggtacggtttacccgacccggtttcccgttaccccgggttaccccccttcccccg

SEQ ID NO: 134347 - DNA, 714 bp, Homo sapiens
  misc_feature: GYAE6OF02JYU2Y.17.33.C11.1.454.CMB.1.raw
  modified_base (165)..(165): a, c, t, g, unknown or other
  misc_feature (165)..(165): n is a, c, g, or t
  modified_base (182)..(182): a, c, t, g, unknown or other
  misc_feature (182)..(182): n is a, c, g, or t
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (427)..(427): a, c, t, g, unknown or other
  misc_feature (427)..(427): n is a, c, g, or t
tcagcgtagactagcacgaccggtgctcgatttagagtgagctcgttgggtttggggctggcgccaggggtcccttccaatatcagcaccatggcctggactcctctctttctgttcctctcacttgctgccagggtccaattctcagtctgtggtgactcgagngccctcatgtactgtcncccaggaggacagtcactctcacctgtcgcttacaacncgtggganactacgtctaccgtagtcgccttaacgttactacctaaacggttcggttaccgacgtaacgaaccgtaaccgtaggaacaaacgcaacccggtaggaccctactacgttaatttacaactaacgaaacctaacaaacacgtcctaacggacccctcgaccgtacttactacgcggtacccctcggtaccgtcggggaanaaccggcgttacgcctacgtaactaccgtcgttacgtcggtagtacgtactacgaccgtgggaacgtacgacggtacctaaggttactacgtaacgttccgtaccttaacgtcgtttgtcggtcgtacgttcgtacgtcggttactacgggttccggaacgggtaacgggtaccgtagtacccgtagggttacccttacggttaccgtcccgtaaccgttaccggaaccgttcccgttaccggcccgtttcgaacccggtttctcccggtttcgacccccgtttccg

SEQ ID NO: 134348 - DNA, 766 bp, Homo sapiens
  misc_feature: GYAE6OF02GRAFR.17.33.C11.1.454.CMB.1.raw
  modified_base (130)..(130): a, c, t, g, unknown or other
  misc_feature (130)..(130): n is a, c, g, or t
  modified_base (594)..(594): a, c, t, g, unknown or other
  misc_feature (594)..(594): n is a, c, g, or t
  modified_base (632)..(632): a, c, t, g, unknown or other
  misc_feature (632)..(632): n is a, c, g, or t
tcagcgtagactagcacgaccggtgctcgatttagagtgagctcgttgggttggggctagggccgaccaggggtccccttccaagtatcacgcaccatggcctggactcctctctttctggttcctctcncttgcttcgccggaggtccaattctcacgctggtggtcgacctaccagggtcgccctctacgcgtactgtacgcccgaggagggacagttccactcgtcgccttgggtccgtaccttaccgaactaccgtggggacaccgtagtacaaccctgggttactcgtttaaccgtactaccttaaacggttccgttaccgaacgaagtaccgtaaaaccgttggaacaacggcccgaccggtacggggaccctaggtccttaatttaaggtaccgaaacgtaaacgaaacaacgtaccgtccggtaccgaacccgttaccggtacctaaacttccgtacggaacgtccgttacccggtttaggggtacggggaaccgacgtaccggcgtaaccgtcgtaaacgtccgtttaccgttggtacgggttcggacgaacgtcgtaccggacggacggttacggacgccgtancgttagtacacgtctacgttacctcgttggtacgtcgnacgtcgtaccgtggttaccggaggtacggtacaacgtcgttaccgaggtttacgtacgtaccggtaccgtaacccgtacggcgttcccggtaccccgtggtacccttcggtcccgtttaccggcccttccccgg

SEQ ID NO: 134349 - DNA, 915 bp, Homo sapiens
  misc_feature: GYAE6OF02G6X3B.17.33.C11.1.454.CMB.1.raw
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagccctcactgactgtcgtacccgaggagggacagtcactctcacctgtgcttaccaacacgtggagcacgtcaccagtcgtacttactactaccaaacttcggttaccacggcaacgtaaaccgtggaacaagccaaccgacggggctaactctaatttaacgtaacgtaaactaaaaccaaaacaaacaccttaccgtaccggtaccccgtacgtccccgtaacttccgtccaacggtccctacccgttccggttacggggggacaaacggtcgtaccggtccgtcgaaccgtacgttcggttcgtacgggttcggtacgtaccgtacggtaccggtacgggtaacggggaccgggtaaacgggtaccggttaacggttaaccgtttaaaccgtttaaccggtaccggtttaacccctttaaccggtttacccgtttaaccggggtttttcggggtttaacggtttaccgggtttaccggttaccgggtttacggttaacccggttttaacggggtttaccccgggggtaacgggggtaaacccggggtaaacccggttaacgggtaacccggtttacccgggttaacccggtttaccgggtttaaacccggttaccggtaaacccgggtacccggtaaaccggggttccccgttaaccccgggttaccccccggttacccgggtttaacccgttaccccgtttaccccgggtttcccccgtttaccccccggtttaaccccccgg

SEQ ID NO: 134350 - DNA, 1034 bp, Homo sapiens
  misc_feature: GYAE6OF02HYWX7.17.33.C11.1.454.CMB.1.raw
tcagcgtagactagcacgaccggtgctcgatttagagtgagctcgttgggtttgggggcgccagggtcccttccaatatcagcaccatggcctggactcctctcttctgttcctcctcacttgctgcccagggtccaattctcagactgtggtgactcaggacgccctcactgactgtcgtccccaggtagggactacgtcacctctcaccgtgtcgtccttaccaactacgtggaacgctaaggtccaaccgtagttcgtacctttaaccgtacttacccgtaaaaccgtttcgggtttacccaacggtaccgaaaaccggtaaaaccccgttacgggaaaccgaaaccggtaccccgaaaccccccgggaagggggtacccctaaccccgttaacttaaaacggttttttaaccttaaaccggttaaaacccgaaaaaaacccaaaaccctaaaaacccgtaaaccccggttccccgttaacccgggtaccccccctaaccggttaacccccggttaaattttcccccgaaccgggttaaacccggttccccgttaccccccggtttaccggggttaccgggggggtaaaccctaaacgggttcccgtaacggtccccgtaagtaaccgtacgtttcggttacggtcggtttacgggtacgtacccggtcggtaccccggttagggaacccgggtaacggacggtaccgttacgtaacctttaagttacccgtaccgttacccttacgtttacccgtttaccgggttttagggttccgggttccgttcggttacggttacccggttaccgtttaccgggggtaacccgggggaccgggttaaaccggggtaacccgtaaacggttcccggttaaccggggtaacccgttttaccggttaaacccgggtaccgtacccgggtaacccgtaaccgggttccccgtaacccccggtttcccccggttaacccgtccgttttaaccgtttccccggttcccggttaaccccccgttcccttacccgtttaccccgg

SEQ ID NO: 134351 - DNA, 1017 bp, Homo sapiens
  misc_feature: GYAE6OF02GVVIO.17.33.C11.1.454.CMB.1.raw
  modified_base (169)..(169): a, c, t, g, unknown or other
  misc_feature (169)..(169): n is a, c, g, or t
  modified_base (174)..(174): a, c, t, g, unknown or other
  misc_feature (174)..(174): n is a, c, g, or t
  modified_base (244)..(244): a, c, t, g, unknown or other
  misc_feature (244)..(244): n is a, c, g, or t
tcagcgtagactagcacgaccggtgctcgatttagagtgagctcgttgggtttgggggcgccaggggtcccttccaatatcagcaccatggcctggactcctctctttctgttccctcctcacttgctcgcccagggtccaattcctcagactgtggtgactcaggacnccctnactgactcgtcgtccccagggacgggacagtccacttctacacctgtcgtccttaccaactactgggacncagtccaccgagtcgacttactactacctaaacgttcggttaccaagtaccaacggaaacccgtgggaaccaacgtcccaacccggacgggacctaccttaccgtaattttaacgaacgttaaacaaaaccgtaaaccaaacctaaccttaccccggtaccggaaccccctacggtacccgttaccttccgtaccgaccggtacccttccccggtttacccgggtacgggggtaacctaaaccggtccgtttaaccggtaccccgtaacgtaaccgttaaccggtttaccgttacggttccggggtttaccgtaccggttacccggtaacccggttcccggttaacggggaaccggggtaaaccgggtaaccgggttacggttaaaccggtttaacccgtttaaccgggttttaacccgtttacccgggtaaccccttttaaccggtttaacccgttttttaaccgggggttttacgggtttccgggtttacgttaacccggtttcgggtttacccgtttaaccgggttttaccggggtaccggggtaacccgggggttaaaccggggaaccccgtttaaacgggtcccgtttaacccggggttaaccccgttttaggtttaaacccggtccggtaaaccccggttacccgggtaaacccggggttcccgttacccccgggttacccccgttacccgggttaccccgttacccggtttaccccggtttccccgggtttcccccccgtttcccgtttaacccccctttcccggg

SEQ ID NO: 134352 - DNA, 684 bp, Homo sapiens
  misc_feature: GYAE6OF02I43M4.17.33.C11.1.454.CMB.1.raw
  modified_base (173)..(173): a, c, t, g, unknown or other
  misc_feature (173)..(173): n is a, c, g, or t
  modified_base (211)..(211): a, c, t, g, unknown or other
  misc_feature (211)..(211): n is a, c, g, or t
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctnactgactgtgtccccaggaggacagtcactctcactgngccttccaacactggacgcagtccaccgaggtnacttaactactaccaaacgtggttaccaancaacgaaaccgtgacaagccaccgtaggccactctatttacgtacgtaaccaaaacaaactaaacctaccgtacccgtacggacccctacgaccgtaacttcctaccgacggtccctacccgtttacccgggttgggggaaccaacgtaccgtccggtaccctcgaacctaccgttcggttacgtcggtacggtcgtacgacggtcctagggacggacggacgtcgtaggtacttaacgttcgtcgtacccgttatttaccgttaggtttcgggtagttggttactcggtacgtacgttacgggttccgggacgggtacgtaccgacgtacgtacgtacgttactacgtcgaccgaccggacgtccgtacccgtcccgtcggtcctacgtttcccgtacctcccctaccg

SEQ ID NO: 134353 - DNA, 688 bp, Homo sapiens
  misc_feature: GYAE6OF02I6W8D.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccaggtccaattctcagactgtggtgactcaggagccctcactgactgtcgtccccgagggaggacagtccactctcactggtcgccttccaacactggagcagtccacacgtgcttactacacctaaactgtcagcaacgaacctgacaacgccaccgaggacactctaatttacaacgtaacaaaacaacctaaacaacctccgtaccgacccctcgacccgtacttaccacgtacggtcccttcccgttaccggtacggggaaccaacggtctccgaccctagaccgtacgttcgtcggtcggtacgtcgacgtacgtacccgtaggaacggtacggacggtacgtaacgtacttaagttcccgtacctaccgttacttcgttaacgtttcgggtcgtacgtgttacgtaccgtcgttacggtacgggtacgggaaccgttaaccaggtaccgtaccgtaccgttagttacgcgtaccgacccggaacgtccctcccggtacccccgttcggtaccctcggttccgttccccggtcccgtaccccttccgtacccg

SEQ ID NO: 134354 - DNA, 833 bp, Homo sapiens
  misc_feature: GYAE6OF02JI3VI.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccagggaggacagtcactctcacctgtgccttaccaacactggagcagtcaccagtcgacttactactacctaaacttcggttaccacgacaacgtaaaaccgtacggaaacaaccgaccaacccgacgggaccaacgtacttaacgttttaagtaacgttaaaaacctaaaacaaaacctaaaacctaaccgttaccccgtaaccggtaaaccccccgttcggtaaccccgtacttttacccgtacctacggggtaccccttcccccggttaccgggttacggggggaaacctaaaacggtccggttaccgtacccgttacggtaacctaccgttacgttccggttagggttcggtaccgtcgtccgtaccggttaaggaccggtaacggtacggtaccgttacggtaacgttaacgtttaccgtaccgttaccgttacccgttaccgtttacggttttacgggttcgggttaccggttcggttacggttcgtttaccgtttaacgggtttccggggtaccgggtaacgggtaaccgtaacgtccgttacggtaccggttacgttacgtacgtaccgaaccggtaaccgtccgtaccgtccccgtaccggtctaccgtcctcccgtacccctcctcccgttacccg

SEQ ID NO: 134355 - DNA, 698 bp, Homo sapiens
  misc_feature: GYAE6OF02IF51E.17.33.C11.1.454.CMB.1.raw
  modified_base (453)..(453): a, c, t, g, unknown or other
  misc_feature (453)..(453): n is a, c, g, or t
  modified_base (474)..(474): a, c, t, g, unknown or other
  misc_feature (474)..(474): n is a, c, g, or t
tcagcgtagactagcacgaccggtgctcgatttagagtgagctcgttgggtttgggctggcgccagggtccttcaatatcagcaccatggcctggactcctctctttctgttcctcctcacttgctgcccagggtcctaattctcagactgtggtgactcaggacgccctcacctgactgtcgtccccgaggacgggacacgtcactctccaccgtgtgcttaccaactaccgtggacgcaacgtaccaccgagttacgtaccttaacctaacctaccgtaaaaccgttcggtttaacccgagtaccgaaacggtaaaccgtacggaacaacgaccaacccgaggaccacctactaatttataacgtaaccaaaactaaccaaactacctaccgtacgaccctcgacctacgtctacgacgtccctaccgtcgtgggacaacgcgtacgactnactagtctgtcgtgtacgacncggtacgtaggacgacggtagtcacgtacttaacgttctacgccttactaccgttagtttacgggtggttacgtcgttacggtactcgtttacggtaccgggtcgggaacggtaaccgtacggacgtaccgccgtttaacggtacgtacgaccccggttacgaacggttcccgtaccgtccccggtccgtacctacccgtacttcccccgttacccgtaacccc

SEQ ID NO: 134356 - DNA, 808 bp, Homo sapiens
  misc_feature: GYAE6OF02HBFMC.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccagggagggacagtcactctccacctgtcgcttaccaacacgtggacgtcacgtccaacctagtgtacttactactaccaaaacgttggttaccagtaccgaaacgtaaacctggaacaacgaccaacccgagggcctactctaatttaagaacgttaaaccaaaacaaaacctaaacctacctaccgtaccggacccctacggaccccgtaacttccgtaccgacggtaccctaccccgtttcgggttaccgggggactaaacgtcgtacggtccccgtagaaccctagttccgtacggttcggtcgtacgcgtacgtacccgttggaacggacggtacggtaccgtacgtaaccgtttaactaccggtttaccgtacccgttaaccgttccgtttaaccggtttgggttcggttaccgtcggttaccggttacgtaccgttacgggttttacccggggacgggtaaccggggtaaccgaacggtaccggttaccgtaaccgggttttaaccggttaacggtaaccggtaaccgaacccggtaaccgggtccgttaccccggacccccggttcggtacccttaccggttacccggtcccgttacccccgttacccccg

SEQ ID NO: 134357 - DNA, 721 bp, Homo sapiens
  misc_feature: GYAE6OF02HQ47W.17.33.C11.1.454.CMB.1.raw
tcagcgtagactagcacgaccggtgctcgatttagagtgagctcgttggggtttggggctggcgccaggggtcccttccaatatcagcaccatggcctggactcctctctttctgttcctcctcacttgctcgcccagggtaccaattctcagactgtggtgactcgaggacgccctcgactgactcgtcgtccccgaggacgggacagtcactctcaccgtgtcgtcttaccaacacgtggacgcgacgtaccacgagtctacttaactactaacctaaacgttcggttaccagaccgaaacgaaccgtaggaacaaacgtccgaacccggacggacctaactgtaacttttaataacggtaaaccaaaacctaaaaccaaaacctaccgtacccgtacccggacccttccgaacccttattccgcgaaccggtcccttacccgttcgggtaccggggtaacaaacggtcctaccggtacaccgttactacgttcggttacgtagggttcgtacacgtacgtaccgtaggacggtaacgtcggatcgtaactttagtaccgtacttacctagtttacttacggtttgttacgtgtacgttagtaccgttaggtaccggtacggggacgaacggataaccgtcgtacgtacctttagacgtacgaccgtaacgccgtaccgtcgtccccgtacgtcctaccgtccgttccctacccgtccg

SEQ ID NO: 134358 - DNA, 744 bp, Homo sapiens
  misc_feature: GYAE6OF02JRLLW.17.33.C11.1.454.CMB.1.raw
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
tcagcgtagactagcacgaccggtgctcgatttagagtgagctcgttgggtttggggcgtggcgccaggggtcccttccaatatcagcaccatggcctggactcctctctttctgttcctcctcacttgctgcccagggtccaattctcagactgtggtgactcaggacgccctcactgactgtcgtccccgaggacgggacagtcactctcacctgtgtcttaccaactactggacgcagtcaccgagtcgcttactactccaaacgtcgttccagtcacgaacctggtaacaagccaccgaggaccacncgtatttanaacgtaaccaaactaaccaaaccaccgtacctaccggtaaccctcgaccccgtaacgtcctacgacgtccgtacccgttaccggttcgggggaacccgtaaaacggtcctaccggtccccgtaagtaacctcgttaggttccgtaggttcggtacgacgtaacggccttacgggacggaaacggtcggtacgtcgtaccgttagttccggtacgtaccgtaccgttacttacggtttggttacgttcgtccggttagacgtacgtttaccggttcgggtacgggtacgggtaaaccggtagttacgccggtacgtttacggttaacggaccggtaccgtaccggtaacccggtccgtaaccccgtcccccgggttcgttaacccgttccgtttaacccggtcccgtttaacccccgttcccccg

SEQ ID NO: 134359 - DNA, 942 bp, Homo sapiens
  misc_feature: GYAE6OF02IESRY.17.33.C11.1.454.CMB.1.raw
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggacgccctcacgtgactggtcgtccccgagggaggacagtcacctctacaccgtgtcgccttaccaacgacgtaggacgccagtccaccaggtcgtacttaactacctaccgtaaacgtttcggttaccaggtaccgaacgtaaaacccgtacggaacaacggccgaccccggtaacgggcctacgttacctaagttttaactaaacggtaaacctaaaacccaaaaccaaaccgtaccttacccgtaccgggtaacccccttccgggaacccctacgtttaccaccggtaccggtaccccgttccccgtttcccgggggttaacggggggaacctaaaccggtcccgttaccgccccgttaaccggaattcccgttacgggttaccgtttcggggtgttaccgggaacccgtacgggttcccggtaagggaaccggggtaacgggtaacggggttaccgttacggtaaaccgttaccttttaaccggtaccggtttacccgttaaccgttttaccgttttaccgggttttcgggtcgggttgttaccgggtttcggtaccgtttacccgggttagggtttacccgggggtacgggtaaccgggaaccgggtttaacggcccgttaacgggttcccgttaagtttaacccggtccgaacccgggtacccgttaccggggtcccccttaccccgggtaccccggttacccggttacccgtacccgtttcccggttttacccccggtccccccgttacccccgtttccgtttaacccccg

SEQ ID NO: 134360 - DNA, 627 bp, Homo sapiens
  misc_feature: GYAE6OF02FVQ0Z.17.33.C11.1.454.CMB.1.raw
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (446)..(446): a, c, t, g, unknown or other
  misc_feature (446)..(446): n is a, c, g, or t
tcagcgtagactagcacgaccggtgctcgatttagagtgagctcgttgggtttggggctggcgccagggtcccttccaatatcagcaccatggcctggactcctctctttctgttcctcctcacttgcctgcccacgggtccaacttctcagactgtggtgactcaggtacgccctcactgactgtacgtccccaggaggacagtccacgtctcgacctggtcgcttaccaacaccgtggagcagttccaccgtagtcgcttactagtccaaacgttcgttccgagtcacgaaaccgtggacaacgccaacccgacgggcactcgattatacgtacaacaacaacactccncgtacccngccgactctcacggctccctccgttggggacaacgcgtacgcctgtaccactcggtctggtctgcgtgcctggacggtacgtacggnttacgactacttaccgacgtccttacgttccgttacgttacggttggtgtccgttaggtgcttacggttcgggacgggtaacggaaccgtagccgtagtacccgttacgttaacgtccggacgtaccgaacggtccgtccgaccccgtcgtccgtacctccgttccgttaccccgtccccg

SEQ ID NO: 134361 - DNA, 713 bp, Homo sapiens
  misc_feature: GYAE6OF02IRNIQ.17.33.C11.1.454.CMB.1.raw
  modified_base (482)..(482): a, c, t, g, unknown or other
  misc_feature (482)..(482): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgacctggtcgtccccaggaggacagtcactctcacctgtcgtcttaccaacacgtggacgcagtcaccagtgtacttactactacctaaacgttcggttaccagacgaacgaaaccgtggaacaacgccaacccgaggccacgtactatttactagtaacaaaacaaacaaacctacctacccgtaccggtaacccctcgtacccgtacttacctacgaccgtcctccccgttaccggttcggggaaccaacggcctacggaccctcgactacgtcgttcgtgggtcgtcgcgacgccgtggaacggnggtacggcgtagtacttactacgtcgtaccttaacttcgtttacggtttgggttacggtgtcgttcggttcgttacgttcggttaccggggtacgggaaccgggtaaccgtacggtaccgtacggtaccgttacgttacgacgtaccgtaacccggtaaccgtccgtacccgtccccgtaccgtacctccgttaccgttcccggttaccccgttccctacccgttacccgg

SEQ ID NO: 134362 - DNA, 756 bp, Homo sapiens
  misc_feature: GYAE6OF02HYV52.17.33.C11.1.454.CMB.1.raw
  modified_base (227)..(227): a, c, t, g, unknown or other
  misc_feature (227)..(227): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccgagggagggacagtcactctcacctgtctccttaccaaacnctaggacgactacgtaccaccgtagtcgtaccttactactaccgtaaacgttcggttaccagtacaacgtaaaccgtaggaacaacgacccaacccggagggaccctaactacttaattttaacgtaaacgtaaaccaaaaaccgaaacctaaaacctaccttccccggttaaccggaccccctacggaccccttacgttacctaccggaccgtcccttccccggttacggggttacgggggactaaacggtcctaccgacccgtagtacctacgtcgtcgtggtcgcgacacgtcgtaggaacgggtacgaggtcgtacgtacttacgtacgttcgtaccttacgttacttcggtttaggtcggtacgtcgttgttcgtacgttacggtccggtacgggaacggacgtaacgtccgtacggtaccgtacgttacgtccgtaacggacccgtaacggtcccgtacccgtacccccgttacgacccgttaccttccgttacccgttaccccgtccccttccgttaacccg

SEQ ID NO: 134363 - DNA, 842 bp, Homo sapiens
  misc_feature: GYAE6OF02GVX44.17.33.C11.1.454.CMB.1.raw
tcagcgtagactagcacgaccggtgctcgatttagagtgagctcggttgggtttggggctggcgccaggggtcccttccaatatcagcaccatggcctggactcctctctttctgttcctcctcacttgctgcccagggtccaattctcagactgtggtgactcgaggacgccctcactgactgtccgtacccgagggagggacagtcactctcaccgttgtcgacctacccaactacgtggagcacgtaccacgagtacgtacttactaactaacctaaccgttcggttaccaacgaccaaacggtaaccgtacggaacgaaccgacctaacccggacgggtacctaaccgtattaaccttttaagaaacgtaaaccgaaaaaccaaaccaaaaccgtacccgttaaccgtacccggtaacccccgtaccggtaccccgttaacttaccgtaccgtaaccggttcccgttaccccggttccggggttacggggggaaaccctaaacggtccgtacccggtacccgtacgaaccgtacgtcggttcggttcgggttagtaccggtacgtacggtaccggtacgggaaccgggacgggtacgtacgtacggtaactttacgttacgttaccgtcgttaccgttccgtttacggtttggtcgggttcgttcgttacggttcgtacgttacgggttaccggacggggtaaacggccggaacgttaccgttacggttaccgttacggttaccgtaccggaaccggtacccggtaccggtacccgtccccggttacccggtaccgttaccgtacccgttacgtttccccgtacccccgtttaccccg

SEQ ID NO: 134364 - DNA, 827 bp, Homo sapiens
  misc_feature: GYAE6OF02HFI8P.17.33.C11.1.454.CMB.1.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtgcttccaacnctgganccagtcaccgtagtcgtacttaactactacctaaacgttcggttaccagtaccgaaagtaaacccgtggaaaccgaacgacccaaaccccggacggggacctaaccttacgtaattttaacggtaactaaaccaaaaaccaaaccaaacctacctcccgtacggtaacccctcgtacccgtacgttacctacgaaccggtccctcccgttacgggtacggggacctaaacgtccttaccggaccctacggaacctaccgttcgttaccgggttagggtcgttacggaccacggtccggtaagggaacggggacgacgggtacgttacgtaaccttaacgttaccgttaccgtccttaaacgttttcctttaacgggtttcgggttacggttccggtacgttcggtacgttccggttaacgggttccggggaccgggaacgggttaccggaaccgtcggttaaccggtacccgttaagttacgtaccgtaacccggtaccggtaaccgggttcccgtaccccggttaccccggttaccggttacccgtacccttttcccggtaaccccgttacccccttacccgttccccgttacccg

SEQ ID NO: 134365 - DNA, 775 bp, Homo sapiens
  misc_feature: GYAE6OF02JF8Q8.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccaggggtccaattctcagactgtggtgactcaggagccctcactgactgtgtccccaggagggacagtcactctcacctgtgcttccaacacgtggagcaagtcaccagtcgtctttacactaccgaaacttcggttaccagcaacgaaccttggaccgaacgccaaccccgagggaccactactaatttaagtacgttaaaccaaaacgaacaaaacctcctacccgtaccgggaaccccctcgacccccggtaacttccgtaccgtaaccgggtccccttcccccgttaccgggtttaccggggggggaaccctaaaacggtacccggtcccggccccgttaacgaacccgtaccggttcgtaccgggtttcggttcggtacggtaccgaacggtcccgttaggggaacggtaccggacgggtccgtaacggtaccgtttacttaacggttaccctaccgtttaaaccttccgtttaccgtttgggttcggtcggtcgtttggtcggttacttacgggttccgggtacgggaaccgggtcaaacggtgtacccggttacgttacgtaacgtaccgaccgtacccgaagtcccgtccgtcccccgttcgtaccaccttccgttcccgtccccgttaccccg

SEQ ID NO: 134366 - DNA, 652 bp, Homo sapiens
  misc_feature: GYAE6OF02HIDFS.17.33.C11.1.454.CMB.1.raw
  modified_base (337)..(337): a, c, t, g, unknown or other
  misc_feature (337)..(337): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccaacactggagcagtcaccagtgcttactataccaaactcggttccagacaacgaaacctggacaagcaccgaggcactcaattactaagtacaaaacaacaaacactccgacgaccccngacccgtacttctacgacggtccttacccgtccggttacgggggactaaacgtcctcgtccctagactacgtcgtctggtgttcgcncgtccgnggacggacgnggtctagacttacttacgtcgtaccttacctcgttacgtttgggtcgttgcgttgtcgtacttcggtcggacggggtacggtaccgaaggtcctacggtaccgttacgttacgtccggtacgtacccggtacggtaccgtcccgttacccccgttggttaccctaccgttccgtacccggtttacccccttaccccggttccttaccccgg

SEQ ID NO: 134367 - DNA, 730 bp, Homo sapiens
  misc_feature: GYAE6OF02HFL75.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtcccagggaggacagtcactctcacctgtcgcttaccaacactgggacgcacgtccaccgaggtcgtacttaactactaccctaaacgttcggttaccagacaacgaaaccgtagacaacgccaccgacggcactactaattatacgtaacaaacaaacaactacctcctaccgggacccctcgacccgtacttccgtcgaccggtccttcccgttccgggttacgggggtaacctaaacgtccgtaccgtcccgtacgaaccgtaccgttcggttaccgtgggttcggtcgaccgtacgccggttacggacgggtacggtcggtacgtacgtacttaacgttaccgtcttaccttaccgttacgtttacggttggggttcgttacggtcgtacggttcttacggttccggtcgggaccgggtacgggacctaacgggtcttaaccgtaccgtacgttacgtaccgaccgtaaccggtacgtaccggtacccgtccccgtacgttcccaccggttccgttcccggtccccgttcccttaccgttcccg

SEQ ID NO: 134368 - DNA, 906 bp, Homo sapiens
  misc_feature: GYAE6OF02GW040.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcgaggacgccctcactgactgtcgtcccgagggagggacagtcactctcaccgtgtcgtccttaccaacacgtggacgcacgtaccgaccgagtcgtaccttaactacgtaaccctaaacggttcggttacccagaccgaaacggtaaaacccgtaggaaccgaaaccgacccgaaccccggacgggacctacgttacttaattttaacgtaacgtaaaccaaaaacctaaaccaaacctaacccttacccggtaacccggtacccccgtccggttaaccccgtaccgtttaccaccggtaaccgggttccccttaccccggttaccggggttaacgggggacctaaaccggtccgtaccgtacccgtagtaaccgttcggttacgttcggttcgggttacggtacggtacctacgggtaccgtacggggaacggaacgggtacggtacgttacgtaacgttaacgttaccgtccgttaccttaccgttacggttttacggtttcgggtcggttaccgtgttacgggttacgttccggttacgggtttccggggaaccggggttacgggtaaccgttaaccggttacggtaaccggttacccggtttaacgttaccggtaccggtaaccggtaacccggtaaccggttcccgttacccccggtaccccggttccggttaaccccgttccggttttaccccgttacccggtttacccccctttaccccgttcccggtttaaccccgg

SEQ ID NO: 134369 - DNA, 705 bp, Homo sapiens
  misc_feature: GYAE6OF02FMF8G.17.33.C11.1.454.CMB.1.raw
  modified_base (356)..(356): a, c, t, g, unknown or other
  misc_feature (356)..(356): n is a, c, g, or t
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagcccctcactgactgtcgtcccccaggagggacagtcactctcacctgtgcttccaactactggagcagtcaccagtgcttactataccaaacttcggttcagcaacgaaacctggaacaagccacccgaggcactcattatataacaaacaaacaaacactcctacggacccctcgcccgtattccncgacgcctcccgtccgttcgggggaccaaacgctcgaccctgtaccactcggtcgtggtcgtgcgacgtccgtaggacgggacggagggtcgtacgtacttaacgtttaccgtacgtaccctttaccttaccgttacgttttagggttcggggttgtacggttggttacggtacgtttacggttcggggtaccggggaacgggtaaccggtaaacggtccgttaccgtacccggttacgttaacggtaacccgtaaccgacccggtaaaccggttcccggtaaccccggttccccccggttccggtacccttaccttacccggttacccgttacccccgttaccccccg

SEQ ID NO: 134370 - DNA, 683 bp, Homo sapiens
  misc_feature: GYAE6OF02GLCB0.17.33.C11.1.454.CMB.1.raw
tcagcgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggacgccctcactgactgtcgtccccgagggaggacagtcactctcacctgtcgccttaccaacacgtcggacgcagtaccacctagtcgtaccttaactactacctaaacgttcggttaccagcaaaaaacgaccgtggaacaacgccaccgaggcactactatttacaagtaacaaacaacaactacctaccgtccggaccctcgaccgtatcctacgacgtcctccgtcggtgggacaacgtctcgcctagacgtcgtcgtccgtaggtcgtacgcgtacgtcgtagggaccggtacggacggtctacgaacttacgtacctcgttaccttcgttcctttaacggttcgggtggtctcgttgtcgtacgttaggtccggggacggtaacgggaccagtccgttaacgtaccgtacgttaccgacgtaccgccggtaaccggtcccgtccccgaccccggttacgtccggtacccttccgggttccccgtttcccccgtacccgttacccggttaccg

SEQ ID NO: 134371 - DNA, 790 bp, Homo sapiens
  misc_feature: GYAE6OF02F71NX.17.33.C11.1.454.CMB.1.raw
  modified_base (146)..(146): a, c, t, g, unknown or other
  misc_feature (146)..(146): n is a, c, g, or t
  modified_base (164)..(164): a, c, t, g, unknown or other
  misc_feature (164)..(164): n is a, c, g, or t
  modified_base (213)..(213): a, c, t, g, unknown or other
  misc_feature (213)..(213): n is a, c, g, or t
  modified_base (215)..(215): a, c, t, g, unknown or other
  misc_feature (215)..(215): n is a, c, g, or t
tcagcgtagactagcacgaccggtgctcgatttagagtgagctcgttgggtttggggctggcgccagggtcccttccaatatcagcaccagtggcctggactcctctctttctcgttcctctcacttgctgccaggtccaagttcncaggactggtggtgactnaggacgccctacgactgacgtgtcgacccagggacgggacagtcactcncncctagtcgccgttaccaaacgtccgtacgggtagccgtagcctaaccaggtcgtacttacgtacgtaccgaaacttcggtaccacgtaccgaacgaaaccgtacggaaccgaacgaccgtacccgagggtacctacgtaccgttattaacgtaagtaaaccgtaaacaaaccgaaacctaaccgtccgtaaccgggtaaccccttacggaccctacgtttaaccgacgtaacccggtacccttccccgtaccggttacggggaaccgtaaacggccgttaccgacccgtaccgaaaccgtacgtaccggttccgtagggtacgttacgaccgtaacgtacgtacgggaaccgacggtagggtaccgtagtaccgtaacgtttaccgtacgtaccgttacgtcgttacgttaggtcggtcgttcgtacgtacgtcggttaaccggtcgggtacgggtaaccggaacgtacggtccgtacgtaccggtacgttacgtaaccgtacggtaaccgtaccggttcctacccggtacccgttccgtaaccgtccgtccgtttcccgtaaccccgttccccg

SEQ ID NO: 134372 - DNA, 640 bp, Homo sapiens
  misc_feature: GYAE6OF02GKJ4V.17.33.C11.1.454.CMB.1.raw
  modified_base (378)..(378): a, c, t, g, unknown or other
  misc_feature (378)..(378): n is a, c, g, or t
  modified_base (465)..(465): a, c, t, g, unknown or other
  misc_feature (465)..(465): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccaggagggacagtcactctacacctgtcgcttccaacacgtggacgcagtccaccagtgtaccttactataccaaactcggttacctagaccaacgaaacctggacaaagccaacccgagggacactactatttataacgtaacaaaaccaaacaaaccactacctacggacccctcgacccgtattccnctaacgcctcccttcggtacggggaccaaagctcgtcccgtagactacgtcgtacgtggtacgtcgacgacgtccgagtacggacgnggtactgaaccgttataccgtcgaccttactacgttaccgttggtcgttacgcgtgtagtcgtacgttcgggacggacggtaaccgaagcgtacggtacctacgtacgtcaccggacctacggtaccgtcccgtacccgttcggtacctacgttccgttacctcccctaaccccg

SEQ ID NO: 134373 - DNA, 860 bp, Homo sapiens
  misc_feature: GYAE6OF02GNO34.17.33.C11.1.454.CMB.1.raw
  modified_base (624)..(624): a, c, t, g, unknown or other
  misc_feature (624)..(624): n is a, c, g, or t
tcagcgtagactagcacgaccggtgctcgatttagagtgagctcgttggggtttgggggctggcgccaggggtcccttccaatatcagcaccatggcctggactcctctctttctgttccctcctcacttgctcgcccagggtccaattctcagactgtggtgactcgaggacgccctcactggactggtccgtccccagggagggacacgtccacttcctactaccgtgtcgtccttaccgaacacggttacgggacgtacctaacggtccaaccgtaggtcgtacctttaactacttaacccgtaaacgttcggtaccgaacgtaaccgaaacggtaaaaccggtacggaaaccgtaacgaccccgaaccccggaacggggtaccctaaccgttacgttaaacttttaacggtaaaaccgtaaaaccaaaaaccaaaacctaaaaccgaacccgttaccctaacccgggtaaccccctaccggtaccccgttacttacccgtaccgaccgttccccgttcccggttaccggggtaacgggtaaccgaaacgtccggtccgtaccctacggtaccgtaaccgttcgggttccgttgggtacggtccgtcggtacggtaccggngggtaacggaccggacggtaccgtagaaccgttacttaccgtcgtaccctttacttaccgttagttcggtagttcgtagttacgtcgttacgttacgggtaccggtacgggtaaccggtaaccgtcggtacgtaccgttacgttaacgttaccgtcggtaaccggtacgtaaccgtcccggtcccgtccccggttacgtcccgttaccctacccggtttcccgccccgttaccccg

SEQ ID NO: 134374 - DNA, 694 bp, Homo sapiens
  misc_feature: GYAE6OF02F80OU.17.33.C11.1.454.CMB.1.raw
  modified_base (228)..(228): a, c, t, g, unknown or other
  misc_feature (228)..(228): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggancagtcaccagtgcttactatccaaactggttccagcaacgaaacctggacaacgcaccgagggcactctatttatagtaacaaataaacaaacactacctacggacccctgcccgtattctcacggtcctcccgtcgttggggacaaacgctcgcccgtgaccactgttcgtggtcgtgacgagcccgtggacgggacggacggcgtacgtaacttaattaccgtcgtaaccttaccttactttacgtttgggttcggttgtcgttcggttcgtcgtttacggtaccgggtacggggtaccgggtaaccgtaacggtccgttacggttaacccggtttactttaacggtaccgaccgggtaacccgtaaccgggtcccgtaccccgggttaccccccgttggttaccctacccgtttcccgtttacccggtttaccccccttaccccgttccccgtttaaccccgg

SEQ ID NO: 134375 - DNA, 675 bp, Homo sapiens
  misc_feature: GYAE6OF02GJG6H.17.33.C11.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactcgactgtcgtccccaggacgggacngtcactctcacctgtcgcttaccacacgtggancacgtcaccagtcgcttacacgtaccaagtcgtccagtcaacgaacctgacagccaccgaggcactatattacgatacaaacaacacactccacgaccctnaccgtactcgacncgtaccncccgtacggtcgggaacaacgctaccggcctggacctagtccgtgtacggtgcacgaccgtacgtcggaacggacggtacgtcgtacgtaacgttacgtaacggttccgacgttacgttaccgtttacggttttcggtacggtcgttcgtacgttcggttacgttacgggtacgggtaccgggtaacggtaccgtaagtccggttaccggttaacgttaccgttacgccgtaaccgggtaccgtaacggcccgttacccgtcccggtacggttcccttaccgtaccgtttcccggtacccctacccgggttccttacccgg

SEQ ID NO: 134376 - DNA, 738 bp, Homo sapiens
  misc_feature: GYAE6OF02F009T.17.33.C11.1.454.CMB.1.raw
  modified_base (257)..(257): a, c, t, g, unknown or other
  misc_feature (257)..(257): n is a, c, g, or t
  modified_base (343)..(343): a, c, t, g, unknown or other
  misc_feature (343)..(343): n is a, c, g, or t
tcagcgtagactagcacgaccggtgctcgatttagagtgagctcgttgggtttggggcgtggcgccaggggtcccttccaatatcagcaccatggcctggactcctctctttctgttcctcctcacttgctgccacgggtccaattctcagacttgtcggtgactcaggagccctcactgactgtcgtcccaggagggacagtcactctcactgtcgaccttccaacactggagcagtcacctagtgtacttacctntacccaaactcggtttccacgcagaaacctcggaacaacgtccacccagggcacgtcacttatagtactaaacaaacgaaactacnccttggacccctcgaccccgtattcctacacggactcccgttcctacgggggtccgaaaagtcgtaccgacccttcggacctacccgttgttaccgtcggtgttcgtacgacgtcccttcggaagggtacgaacgggcttagaacgtacttttaaccgtgtacccgtttaccttccgtaacgtttttcgggtcgggttagtcccgttgttcggtacctttagggtttaccgggaccggggtaacggggtaacccggtacggtaccgggtccgtttaaccggggttctttaacggttaccaccggttaacccccgaaagggtttccggtaacccgtcccccggtcggtttcccggtaaccctttaccccgttacggtttaccccccttaccccccg

SEQ ID NO: 134377 - DNA, 828 bp, Homo sapiens
  misc_feature: GYAE6OF02JWGC9.17.33.C11.1.454.CMB.1.raw
tcagcgtagactagcacgaccggtgctcgatttagagtgagctcgttggggtttggggctggcgccaggggtcccttccaatatcagcaccatggcctggactcctctctttctgttcctcctcacttgctcgcccagggtccaattctcagactggtggtagactcgaggacgccctcactgactgtcgtcccgaggagggacagtcactctcgtaccgtgtcgtccttaccaacgacgtaggacgcgacgtaccgacctagtcgtaccttacctactaccaagttcggtaccacgacaacgaaccgtaggacaacgaccgacccggacggacctacgtacttaactttaacgaacgtaaaaccaaactaaaccgaaacctacccgtacccggtaccggtaccccgtaccgtacccgtaacttccgaccgtaccggtaccccttacccggttaccgggttacggggaacctaacggtcctaccggtacccgtacgtaccgacgtttccggtcggttggtcgtacggtcgacgtacggtacggaacggcggtacgagtacgttacttacgttaccgtcgttacccgtacttacggtttacggttcgggtacggttcggttacgttcggttacgttacccgggttacggttaccggggtaacgggtaccggggtaaaccacgggttcgttaaccggttaccgttacggtttaacccgggtacccgtaaccggacccgttaaccgggtcccgtttaccccgggaccccgtttcccgggtaacccttccccggtttaccggtttaccccccgggttccccgttacccccgg

SEQ ID NO: 134378 - DNA, 682 bp, Homo sapiens
  misc_feature: GYAE6OF02FUBHH.17.33.C11.1.454.CMB.1.raw
  modified_base (231)..(231): a, c, t, g, unknown or other
  misc_feature (231)..(231): n is a, c, g, or t
  modified_base (443)..(443): a, c, t, g, unknown or other
  misc_feature (443)..(443): n is a, c, g, or t
tcagcgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccaacactggancagtcaccagtcgcttactataccaaacttcggttccagtccaacgtaaaccgtcggaacaacgccaacccgagggaccaccgtacgtattttaataacgtaaccaaaacaaaccaaaacctactccgtcggacccctcgacccgtattcctcgacgtcctaccgtccgtaggggacaaagctacgcctgacctacgtcgttacgtgggttntcgacgacgtccgtacgggaacgggacgacgggtcgtacgtaacgttacgttacgtcgtaccttaccttacctttacgttttgggtaggttacgtcgttggttgtaccgttacggttcgggacgggtaacggaccgtaagtccgtacggtaccgttacgttacggtcaaccggacccggtacgtccgtacccggtccccgtacggtaccgtaccgttccgttccgttccccttaccccg

SEQ ID NO: 134379 - DNA, 731 bp, Homo sapiens
  misc_feature: GYAE6OF02GRCJR.17.33.C11.1.454.CMB.1.raw
  modified_base (171)..(171): a, c, t, g, unknown or other
  misc_feature (171)..(171): n is a, c, g, or t
  modified_base (229)..(229): a, c, t, g, unknown or other
  misc_feature (229)..(229): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctnactgactgtcgtccccaggagggacagtcactctcacctgtgcttccaacacgtggancagtcaccagtgcttacactaccaacgttggtccagcaacgaaacctggaacaacggaccaccgaagggccactcaatttaagagtaactaaaacaaaccaaacacctccgtacggacccctgcccgtattccgacgtcggccttccccgtaccgttcgggggaactaaacgtccgtaccgtacccgtagtaaccacgttcgttaccggtcggtggtacgaccggtaacggtcccgtagggaacgggaacggtacgggtaccggtaagtaaccgttacttaaccgtcgtacccttagttaccgtttacggtttaggggttcggtcgttcgtcggttacgtcggttacgtccggggtacgggaaccgggaacgtaacgggtctaacggtaccgtttcgtaacggtaccacgggtaacccacggtacccgtacccggtcccccgttacggtacccgttaccgttccctttaccggttacccccttacccggttcccttacccgg

SEQ ID NO: 134380 - DNA, 728 bp, Homo sapiens
  misc_feature: GYAE6OF02FY282.17.33.C11.1.454.CMB.1.raw
  modified_base (230)..(230): a, c, t, g, unknown or other
  misc_feature (230)..(230): n is a, c, g, or t
  modified_base (445)..(445): a, c, t, g, unknown or other
  misc_feature (445)..(445): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgacttgtgtccccagggaggacagtcactctcacctgtgcttccaacactggagcncgtcaccagtgacttactatacctaactcggttccagcaacgtaaaccgtggaacaacgtaccacccgagggccacgtctaattatacgtaacaaacaacaacacctcgtacgaccctcgccggtatcctcgaggtcctcccctacgggttcggggaacaagtctcggccttacgactagtcgtcgtaggtgtagcgacgtcgtaggaaccgggnggacggtctagtaacttagtactcgtaccgtacttacgttacgtttacggggttcgtcctggttacttacggttccgttacgggttaccgggggaccggggtaaccgggtaaaccgtaaccggtcggttaacccgggttacccggtttacccgttacgggtaaccggtaccggtaaccccgggaaccggtaccggttcccggtccccccgtttacggttacccgttacccggtttccggtaaccccggtttcccccgttacccccgttccccgtttaccccgg

SEQ ID NO: 134381 - DNA, 919 bp, Homo sapiens
  misc_feature: GYAE6OF02H84Q2.17.33.C11.1.454.CMB.1.raw
tcagcgtagactagcacgaccggtgctcgatttagagtgagctcgttggggtttgggggggcgccaggggtcccttccaatatcagcacatggcctggactcctctctttctgttcctcctcacttgctgcccgagggtcaattctcagactgtggtgaactcgaggacgccctcactgactgtcgtcccgaagggaggacagtcactctcacttcgtcgtccttaccaaacgacgtgggtacactacgtaccaaccgagtcgtacctttaactaacctaacctaaacgttcgggttaccacgacgaaacggaaaccgtaggaaccaaacggaccgaacccggaacggcctaaacgttacttaacgttttaacgtaaaccgtaaaacaaaaaaccaaaccgtaaaacctacccgttaccgacccggtaaccccgtacgacccggttaacttccgacgacgtccctacccggtcgggtacgggaaccaagtccgtcgtaccgtagacctacgttacggttcgttagggttcgtacggccgtaacggtacccgggtagggaaaccgggtacgggtaacgttacggttaacgttaccgtttaacgttaccgttaccgtttacccgtttaaacgttttaccgtttttaacggggtttacgggtttacgggttacgttaccggtttcggttaaccggttaccgtttaccggtttccggggggaaacccggtaacgggtaaccgtaacggtcccggttaaaccggtaaacccggttttacggtaaaccggttcccggtaaacccgggtcccggtaacccgggttcccggttaccccccgggtttaccccgtaacccggttcccggttaacccgttcccgggtttacccccggtttccccccgttaccccgttacccttacccggg

SEQ ID NO: 134382 - DNA, 880 bp, Homo sapiens
  misc_feature: GYAE6OF02GW67F.17.33.C11.1.454.CMB.1.raw
  modified_base (169)..(169): a, c, t, g, unknown or other
  misc_feature (169)..(169): n is a, c, g, or t
  modified_base (251)..(251): a, c, t, g, unknown or other
  misc_feature (251)..(251): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgaccagggtccaattctcagactgtggtgactcaggganccctcactgactgtcgtccccgaggagggacagtccactctcacctgtgtccttaccaacacgtggagcacgtcaccaggtnacttacaactacctaaacgttggttcacgacaacgaaacctaggaacaacgccaacccgagggacctactactaatttaacgtaacgtaaacaaaacaaaaccaaacctaccgtaccgtaccggtacccctccggtaccccgttacttcctacgaacggttcccttaccccggttacgggttacggggtaacctaaacggtccgttaaccgggtccccgttaacgtacccgtaacggtttccggttcgggtttacggggttcgggttaccggacccgtaaccggggaccccggttaaggggtaacggggtaaccgggtaccggttacggttaacccgggttaaaacctttacggttaaccgttacccgtaccccgtttttaaacgtttaccgttttacggttttagggtttcgggttacggtccgttaacggtcgttaacgtttaacgggtaccgggaagggggttaacccgaacggttaaacgtcccgggttaacgttacccgtttaacgttaaccgggtaccgtaaacccgtaccgggtaaaccggttccctaccccggttacccccggtttccggttaaccgtacccccgttttaccggttcccccggtttcccccggttaccccg

SEQ ID NO: 134383 - DNA, 694 bp, Homo sapiens
  misc_feature: GYAE6OF02GMDNO.17.33.C11.1.454.CMB.1.raw
  modified_base (447)..(447): a, c, t, g, unknown or other
  misc_feature (447)..(447): n is a, c, g, or t
tcagcgtagactagcacgaccggtgctcgatttagagtgagctcgttggggtttggggggcgccaggggtcccttccaatatcagcaccatggcctggactcctctctttctgttcctcctcacttgctgcccgagggtccaattctcagactgtggtgactcaggagccctcactgactgtcgtcccccgaggacgggacagtcactccgtcacctgtcgccttaccaacactggagctacggtcacctagtcgcttactactacccgtaactcggttccagactaacgaaacctggaacaacgccaccgaggcctacgtactattactaagtaacaaaccgaacaaccacctccgtaccggacccctcgacccgtattccacgtacgtcctacccgttcggtcggggacaacgtcctcgcctgtacacgtcgtcgtggtcgtacnccgtagtccgtaggacgggtacgcgggtaccttacgtacttaacgttccggtaccgttaccgttaccttaccggttttacgtttcgggtacgggtcgtacggttcgtacgtcgttacggtcggggtaccgggacggtaccacggtacgtcggtaccgttacgttagccacggtccgtaacggtcccgtacgtcccccgttagtaccgtcccggtaccgttcccggtcccctacccggtcttacccgg

SEQ ID NO: 134384 - DNA, 757 bp, Homo sapiens
  misc_feature: GYAE6OF02F8M04.17.33.C11.1.454.CMB.1.raw
  modified_base (232)..(232): a, c, t, g, unknown or other
  misc_feature (232)..(232): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggacgccctcactgactgtcgtcccgaggaggacagtcactctcacctgtgccttaccaacacgtggacnctacgtccaccgtagtcgtacttaactactacccgtaaaacgttggttaccagaccgaacgaaaccgtgggaaccaacgacccaacccgaggacctacgtactaatttacgtaacgtaaccaaaacaaccaaacctaccgtaccgtaccggtaccccgtacgacccgtacgttccgtaccgaccggtcccttacccgttccggttagggggaacctaacggtcgtaccgccgttagaccgtacgttcgtaccggtggtacgtcgacgtcgtaccgtaggacgggacggacgacgtagtacgtactaccgtcgtaccttaactttccgttacgttcgggtacgttcgtcgttcgtcgtacggttccggttaccggggacgggtaccggacgaacggtaccggtacgtaccggttacttacgggaccgtaaccgtacccggtaccggttcccttacccggtccccgttacggtaccgttcccgtttacccgttaccccgttccccttaccccgttcccgttacccgg

SEQ ID NO: 134385 - DNA, 764 bp, Homo sapiens
  misc_feature: GYAE6OF02JCI1O.17.33.C11.1.454.CMB.1.raw
  modified_base (172)..(172): a, c, t, g, unknown or other
  misc_feature (172)..(172): n is a, c, g, or t
  modified_base (234)..(234): a, c, t, g, unknown or other
  misc_feature (234)..(234): n is a, c, g, or t
tcagcgtagactagcacgaccggtgctcgatttagagtgagctcgttggggtttggggctggcgccaggggtcccttccaatatcagcaccatggcctgggactcctctctttctgttcctcctcacttgctgcccagggtccaattctcagactgtggtgactcgaggacnccctcactgactggtcgtaccccgaggagggacagtcacgtctcacctgtcgcttaccaacncgtaggagcacgtaccaccgagtgtccttaactactaccaaacttcggttaccacggacaacgtaaaccgtcggaacgaacgaccgaaccgtacggggcaactacttaagtttactaacgtaaccaaaactaaaaccaaacacctaccgtaccggtacccctacgaccgtacttaccgtactaaccggtcctacccgttcggtacgggggacctaaacggtcctccgaccgtagtacgtactcgtcgttcgtcgtcggctacggtacgtcggtaacgggacgtacggacgtactaacgtacgtttacacgttacctacgttccgttacgttcggtaggtcgtcggtcggtacgtaccgttacggttacgggtacccgggtaaggtaacccggtaacgtaccgtaccggttaccgttacgttaaccgttaccggtaacccggttacggaaccgttacccggtaaccccggtcccccggttcggtaccccgtaaccgtttacccggttacccgttacccccttaacccccgg

SEQ ID NO: 134386 - DNA, 802 bp, Homo sapiens
  misc_feature: GYAE6OF02F3JWZ.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtgtccttccaacactggagcagtaccaccagtcgcttactactaccaaacgttcggttaccaggacaacgaaacctggaacctaaagccgaacccgagggccaactcgtatttaataacgtaaacaaaaccaaaacaaacctaaccgttaccgtaccggaacccccgtcgtaaccccggtactttaccgtacccgtacgggtcccttccccgttacccgggttaacggggggaccctaaaacggtcccgtttccggacccttacggaaccgtaccgtttcgtcggttacggttcgggtacgaccgtacggtacccgtagggaacgggttaaccgggacggtaccgtaacgtaccttaaagttacccgtaccgtacccgttaccttaccgtttaccggtttacgggtcgggttactccggttaggttgtacgtttacgttccgggggacgggtaacggtacccggtaagtaccgttacggttaccgttacggttactccggaaccgtaacccggacgtcccgtcccggtcccccgttacggtccgtaccccgtttcccggtaccccctccccgttaccctccgttaaccgg

SEQ ID NO: 134387 - DNA, 966 bp, Homo sapiens
  misc_feature: GYAE6OF02G2JBK.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctcgcccagggtccaattctcagactgtggtgactcaggacgccctcactgactgtcgtcccgaggacggacagtcactctcaccgtgtcgtcttaccaactacgtggaacgtcacgtaccaccgtagtcgtaccttactaacctaccgtaaaacgttcggttacccagaccgtaacgtaaaccgtacgggaacaacggtccaaacccggaacggggtacctaacccgtacgttaaacgttttaacgtaaacggtaaaaccaaaaaaccaaaaccgtaaaaacccctaacccgttaccccgttaacccgggtaaccccccgttaccggtaacccccgttaacgttttcccgtaacccgggtaacccggtcccccgtttaacccccggtttacccgggggtttaccggggggaaaccccttaaaagggtccccggttaaacccgtaccccgttaccggaaccgtttaaccgttccggtttaccgggttaacgggttcgggttaccgtacccggtaccggtcccgggttaaaggggaaccggggtaacgggttaaccgggtacggttaaccgtaaaccctttaacggttaacccgttaccggttacccgttaacccgtttaccggtttaaccggttttggggttacgggttcggttacgttcgggttacgtaccgtttcgggttaccggggaacggggtacccggtaacgtaacggttaccgtaccggttacccgttaacgttaaccggtcccgtaaccggtacccggtacggacccgttccccggtaccccggttaccgtaccgttacccgttccgttaccccgttacccctaccccgg

SEQ ID NO: 134388 - DNA, 859 bp, Homo sapiens
  misc_feature: GYAE6OF02GJ28S.17.33.C11.1.454.CMB.1.raw
  modified_base (633)..(633): a, c, t, g, unknown or other
  misc_feature (633)..(633): n is a, c, g, or t
tcagcgtagactagcacgaccggtgctcgatttagagtgagctcgttgggtttgggggggtcggccgaggggtcccttccgaatatcagcaccatggcctggactcctctcttctgttcctcctctacttgctcgcccacgggtccaatctcagactgtggtgactcaggagccctcacctgactgtcgtccccgagggacggtaccagttccactccgtctacctcgtgtccttacccaaccgactgggagccagtaccacctaggtctacctaacttactaccctaacgttcgttaccgacgtacaagaaaccctagacgaacgaccgaacccgtacgggaccacgtcctaagtttactaactaaactaaaccaaaccaaaccgtacctaacccgtccggtaaacccctccggtaaccgaccttaccggttacaccggtccctaccccggtaccggttccgggggacaaaccggtcgttccgacccgtataccgaacttcggtcgtcggttcgtacgccgacgttaccggtggaccgggaaccggtcggaccttgtaaaccgtttaaacgtccgtccggttaacttcccgtacgtttaccgggttttcggtgggttaccctccgggttttnacccggttacggtttaccgggttaccgggggaccgggtaaccgaacccgggttaagtacccgggttaaccgtaccgttttacccgtaaccgggttacccgtaccccggtaaaccgggttacccggccccgtttaccccccggacccccgttttccgggtaaccccttaccccggtttaccggtttacccccgttccccccccttacccggtttacccttaccccgg

SEQ ID NO: 134389 - DNA, 969 bp, Homo sapiens
  misc_feature: GYAE6OF02GIOBZ.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcgagactggtggtgactcgaggaccgtccctacactcgactcggtcgtaccccgaggggaacgggacgtacgttacaccgttacctaccgtaccgttggtcgtacctttacccgaaacgtacgttacgggactccaacggttacccaaccgagtacgtacctttaacctaccttaaccgtaaacgtcggttaccacgaccaaacggtaaccgtacggtaacaaccgcccgaaccggaggtacctaacgtacttaatttaaccggtaataaaccgaaacaaacctaaccaccgttccgttaaccggacccctacgtaccgtactcctacggacgttccctaccccgttacgggttacggggaacctaacgtcctaccgtaccgtacggtactacggttccgttactggggtacgtacgccggtacggtaccggtaacggtacgggtaaccgggtaccggttacgtaccgttaacgttttaaccggtacccgttaaccgttaccccgtttaaccgttttaaccgggttttcggttttaccggggttaacgggttacgttccgttttaaggggaccgtttaaccgggttaaccggggttaccggggtaccggggtaagggtaaaccccgtacgggttaacccggttaccgttaacccgggttttaacggtacccgggttaccggtaaccccggttaccccgggtaaccgttccccggtttcccccgtaaccccccgggtttcccggtttaaaaccccgttaccggtttcccccggttaacccccgtttttcccccggttaccccgtttacccccggtttaaccccggg

SEQ ID NO: 134390 - DNA, 811 bp, Homo sapiens
  misc_feature: GYAE6OF02HOMBL.17.33.C11.1.454.CMB.1.raw
  modified_base (223)..(223): a, c, t, g, unknown or other
  misc_feature (223)..(223): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccagggaggacagtcactctcacctgtgcttccaacncgtggacgcacgtccaccgagtcgtcttaactactaccctaaacgttcggttccaggcaaggaaacctaggaacaacggaccaaccccggacgggacctaaccgttctaactttttaacgtacggttaaaaccaaaaaccaaaaccaaaaaccttaccgttacccgtaccgggtacccctaccggaccccgtaacctttccacgtaccggtccccttcccgtttacccggggttacgggggaacctaaacggtccttaccggtaccccttagacccgtaacgttccgtcgggttgggttacgtcgggacctacggaccgtagggacgggtaacggacggtacgtacgtaacgttacgttaccgtacgtacccttacgtttacgtttacggttttacgggttcggttacgtcggttacgttcgtacgttaacggttcccgggtacggggtaacgggtaaccgaaggtccgttaccggtaccggtttactttaaccggtacgaaccggtaacccggtagggaccccgtcccgtacccccggtaccggtaccgttccccggtaccgttccccggttacccccgttcccccg

SEQ ID NO: 134391 - DNA, 706 bp, Homo sapiens
  misc_feature: GYAE6OF02FS4JI.17.33.C11.1.454.CMB.1.raw
  modified_base (211)..(211): a, c, t, g, unknown or other
  misc_feature (211)..(211): n is a, c, g, or t
  modified_base (669)..(669): a, c, t, g, unknown or other
  misc_feature (669)..(669): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcagagccctcactgactggtctccccaggagggacagtcactctcacctgtncttaccaacactggagcagtcaccagtcgctactactaccaaactggttaccagtcaagtaaactggacaacgccaacccgaggccactactattagtaacgtaacaaacaacaacacttccacggacccctcgccgtaacttcgtaccacggtcccttaccctccgggttacggggacaacggtacgtcgtacccgtacgaactccgttacgggttccgtcgggttgtcgcgtacgtaccggttacggaacgggtacggtacgggaccttacggtaaaccgttacgtttaacccgtccggttaaccttccgttaacgtttacccggtttagggttcggttacgtcgttcggtaacgttcggttaccggttcgggaaccggtacgggtaaccgtaacgtcgtacgttaccgtacgttacgtaccgacggtaaccgacgtcccgtaccgtccccgtacnccgttacgtctcccggtaccccgtccttcccttaccg

SEQ ID NO: 134392 - DNA, 580 bp, Homo sapiens
  misc_feature: GYAE6OF02I9CC0.17.33.C11.1.454.CMB.1.raw
  modified_base (321)..(321): a, c, t, g, unknown or other
  misc_feature (321)..(321): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgctttccaacactggacgcagtcaccagtcgcttactatccaaactggttccagcagaaacctggacaagccaccaggcactcatttatagtacaaacaacaaacactccngacccctgcccgattctcagcctccctcgtggggacaaagctcgccctgactactcgtctaggtgtcgctagcctagaggacgaggctgaacttattacgtcgtccttaacgtcttacgttttgggtggttcgtccgttgtcgtcgtttacgttccgggacggtacgggaccaaggtccgtgaccgttattacgcgacgcctaagccgtccgccccgttaggtcctccgttacctccgtacccctcccttccttacccg

SEQ ID NO: 134393 - DNA, 861 bp, Homo sapiens
  misc_feature: GYAE6OF02JT70D.17.33.C11.1.454.CMB.1.raw
  modified_base (548)..(548): a, c, t, g, unknown or other
  misc_feature (548)..(548): n is a, c, g, or t
tcagcgtagactagcacgaccggtgctcgatttagagtgagctcgttgggtttgggctggcgccagggtcccttccaatatcagcaccatggcctggactcctctctttctgttcctcctcacttgctgcccagggtccaattctcagtactgtggtcgactcgaggacgccctacacgttgacttcgtcgtccccgaaggggacggacacgtccacctccgtaccgtaccgttggtcgtccttacccgaacgtaaccgttgggaaccgtcgaaccgttccaccgtagttacgtaccttaacctactccctaaaacggttcggttccgaacgaccgtaaacgtaaacccgtggaaccacgcccgaaccggacggtctaccgtattacgttaactacgaaaccaaacgaaacctaccgtacctccggtaaccggaccctcggtacctattccgacgaccgtcctaccccgttaggtaccgggaactaaccggtcgtaccctaccccgtacggtaaactcccggttagtaccggttggtaaccgggtacncggtaaccggtccgtacgggtaaaccgtaacgggtacggtaccgtaacgttaacgttacccgtaaccgtttacgttaaccccgttaaccgtttcgtttaccggtttacgggttcggttacggtccgtttacggttaccggtaccgttaacggttccgggaaccggggttaacgaaccggtaacgtccggtaaccggttaccggtaacgtttaccggtaaccggaaccgtaccggtaaccgttacccggttccccgtacccggtacccggttacctccccggtttaccggttccccgttaaccccgttccccgg

SEQ ID NO: 134394 - DNA, 669 bp, Homo sapiens
  misc_feature: GYAE6OF02HHDF0.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgcttccaacactggagcagtcaccagtgcttactatccaaatcggttccagcaacgaaacctggacaacgcacccgagggacacctctattataacgtaacaaaacaacaaacactcctacggaccctcgacccgtattctaccgacggcctcccgtccggttcgggggacaaacggtctacgccctagacctactacgttcgtggtgtcgcgacgccgtaggaacggacgacggtctacgtacttaactacgtcgtacccttacctttacgtttaacgtttgggttacggtcggtccgtgttcgtacgttacggttcccgggacgggtaacggaaccgaggtcctacggtaccgttacgtttacgtaccgtaaccgacccggtaacggtccctcccggtcccccgtacggtcctaccgttccgtacccgtttccccctaccccgtaccctttacccg

SEQ ID NO: 134395 - DNA, 871 bp, Homo sapiens
  misc_feature: GYAE6OF02FH54N.17.33.C11.1.454.CMB.1.raw
  modified_base (227)..(227): a, c, t, g, unknown or other
  misc_feature (227)..(227): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccggggtccaattctcagactgtggtgactcgaggacgccctacactgactgtcgtcccagggaggacagtcactctcactgtcgtctaccaacncgtggacgacgacgtaccaccgagtacgtccttaacgttaactaacccgtaaaaccgttcggttacccaacggtaccgaacggaaaacccgtacgggtaaaccaaacggacccgaaccccggtaacggggtacctacctttaccgttattttaacgtaaacggttaaaaccaaaacctaaaacctaaaaccgtacccttacccgtaccgggtaacccccgtccggtacccccgttaatttcccgtaccgttaccggtacccccgttccccgttaccgggttaccggggggtaacctaaaacggtcccgtaccgtacccgtaacgtacccgttaacggtttcgtcccggtttagggtcgaccgtaccgtacgggtacctaacggggtacgggaccggtaacggtcgtaacgttacggttaacgtaccgttacgtacccgtaccgttaacgtttcgggtttcgggtacgtcggtacgttggtccgttacgtttaccgggttacgggtaccggggaacgggtaaccctaaacggtccgttcgtaccggttacttaccggccgtaacgacccggtaccgtccccgtaccggtcccgttaccggtccgttaccgtttcccgttacccggtcccccttacgttacccccg

SEQ ID NO: 134396 - DNA, 818 bp, Homo sapiens
  misc_feature: GYAE6OF02HHVBH.17.33.C11.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (324)..(324): a, c, t, g, unknown or other
  misc_feature (324)..(324): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccgagggtccaattctcagactgtggtgactcagggcgccctcactgactgtcgtccccgaggagggacngtcactctcacctgtcgcttccaanacgtggagctagtaccaaccgtgtggtaccttactatacccgtaaactcggttccagtacaacgaaaccgtcggaacaacgccaccgtgggaccacgtntaacttataacgtaaccaaaactaaccaactactcccgtaccggtacccaccgaccgttacgttacttaccgacgtcccgttacccgtcgggttaccgggggaactaaaccggtcctaccgttacccaggtaacctacgttcggtacggttaggtcgtacggtaccacggttacccgtagggaccgggaacgtaccggtcgttaacgtaccgttaacttaccggtaccgttacccgttacgtttaccggtttaaccgggtttggggtttacccggtacggttaccggttacggtttccgggttaaccgttcggggtttaccggggaaccgggtaccgggaaccccgttaaggcccgttaacgggtttaaccgttacgttaccgggttaccaaccggggttaccccgacgggttccccgttacccgggtcccccgttacggttacccgtaccctttccggttacccttcccccgggttaccctccccgttaccgg

SEQ ID NO: 134397 - DNA, 768 bp, Homo sapiens
  misc_feature: GYAE6OF02GES7W.17.33.C11.1.454.CMB.1.raw
  modified_base (281)..(281): a, c, t, g, unknown or other
  misc_feature (281)..(281): n is a, c, g, or t
tcagcgtagactagcacgaccggtgctcgatttagagtgagctcgttgggtttggggctggcgccaggggtcccttccaatatcagcaccatggcctggactcctctctttctgttccctcctcacttgctgcccttttttttagggccaattctcagactggtggtgactcaggacgccctcactgactgtcgtccccgagggagggacagtcactctcacctgtgccttaccaactacgtggagcagtcaccgagtcgcttacactaccaactgtccanacacgaacctggacaacgccaccgaggaccactctattataacgtaaccaaacaaactaaacacgtacctacgaccccgtcgacccctacttcgtacgacggcccttacccgtcggttacgggggaccaaacggcgtacgtccctggacctacgtcgttcgtagggttcgtcgaccgtacggtcgtacgggaacgggacggacgggtccgtaacggtaacttaccgtttaccgttccggtacccttaccgttaccgtttaccgtttgggttacgggtcggttccgttaggttcgtacgtttacggttaccggggaccgggtaaacgggtacccgaacgttaccgtaccggtttaccggttaaccggtttaacggtcccggtaacccggtaaccccggttaacggtacccggttaccccggtcccccggtttaccgggtacccgttacccgtttacccggtttccccggttaccccccgttcccccgg

SEQ ID NO: 134398 - DNA, 761 bp, Homo sapiens
  misc_feature: GYAE6OF02JM5E2.17.33.C11.1.454.CMB.1.raw
tcagcgtagactagcacgaccggtgctcgatttagagtgagctcgttggggtttggggctggcgccaggggtcccttccaatatcagcaccatggcctggactcctctctttctgttcctcctcacttgctgcccgagggtccaattctcagactgtggtgactcgaggacgccctcactgactgtcgcccgagggaggacagtcactctcactgtcgtaccttaccaacgacgtggacacgacgtaccactggtctaccttaactactaaccgttaacgttcggttaccacgtaaccgaaacgaaccggtaggaaccaacgacccgacccggaaggacctactacttaagtttaacgtaacgttaaaaccaaaacaaaaccaaaccgttacccgtaccgtacccgggtaacccctccgttacccgtacttaccgtaccgtaccggtccctaaccccggttcggtaccggggtaaacaccggtcgttaccgtcccgtaacgaccttacggtccgttcgtcggtcggtactacggacgtaccgagggacggtacggtcgtactaacgtaccttagttaccgtcttaccttacgttcgtttacgtttggtacggtcgttacgttcgtgttaccgttaacgggtcggggaacgggtacggacggtaccgtcgttaaccgtacgttaacgtacggtacccgaccgtccggacgtacccgtccgtccccgttgacccgttccgtccgttaccctccccggtaaccc

SEQ ID NO: 134399 - DNA, 764 bp, Homo sapiens
  misc_feature: GYAE6OF02IOY3W.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtccccgaggaggacagtcactctcacctgtgcttaccaacactggagccagtccaccgagtcgacttaactactaccaaacgtcggttaccagacgaacgtaaaccgtagaacaacgaccacccgaggaccactacgtactttagtaacgtaaccgaaaaccaaaccgaaaaccaccttacccgtacccggtaccccctacggtaccccgtacgtttaccgtaccgaacggtccctccccgtttcccgggttacgggggaacctaaacggccgttaccgtccccgtacgaaccctccgttacggttccggttaggtacggtccgaccgtaccggtaccgtagggacgggaacggtacgggtacctagtaacccgttaagtttacctacgttacccgttaccttaccgtttaaccggtttggttcgggtcgtcgttacgttcggtaccgttcggttacgggaccgggtacggaaccgtaacggtaccgttacgtaccgttacgtttacggacgtacccgaccgaccggtccgtccccgtcccgtacggtccttacccgtccgttcccgtccctaccccg

SEQ ID NO: 134400 - DNA, 962 bp, Homo sapiens
  misc_feature: GYAE6OF02JKYUZ.17.33.C11.1.454.CMB.1.raw
  modified_base (113)..(113): a, c, t, g, unknown or other
  misc_feature (113)..(113): n is a, c, g, or t
  modified_base (128)..(128): a, c, t, g, unknown or other
  misc_feature (128)..(128): n is a, c, g, or t
  modified_base (134)..(134): a, c, t, g, unknown or other
  misc_feature (134)..(134): n is a, c, g, or t
  modified_base (162)..(162): a, c, t, g, unknown or other
  misc_feature (162)..(162): n is a, c, g, or t
  modified_base (182)..(182): a, c, t, g, unknown or other
  misc_feature (182)..(182): n is a, c, g, or t
  modified_base (248)..(248): a, c, t, g, unknown or other
  misc_feature (248)..(248): n is a, c, g, or t
tcagcgtagactagcacgaccggtgctcgatttagagtgagctcgttgggtttggggctggcgccaggggtcccttccaatatcagcaccatggcctggactccctcttcttnttctcctctctactncgtccncgacgtactatctacagactggtggtancacgaggacctccctactanacgtcttcggtcccgtacccggaaggggtacggaacctacggtcctacctccgtacctaccggttnccggttacctaacccaaaacgtcggtacgggaacgacggttacctaccgtaaccgttgggacctttaacctaaacgttccggttaaaaccccttaaaggtttacccggacgtaacgtaaaccggtaaaaccgtaaaccggtaccgaaacggaccgtaaccccaaccgggggaccgttaaacctactaacgttttaaaccgtttacggtaaaaaccgtaaaccaaaaaacctaaaccaaaccttacccggttaacccggaaccggttaccccaccgggttaacccgtacttaccctaggggaccccttccgtaccccggttttaggggaccggaaacttacgtcggtaacccgttcctaaactcccgttcgtacggtttcggtacgtcgtaccggaaccgttccggtaccggttaacggggaccggggtaaacggtcgtaacccgtttacggttaaacgttaccttaacgttacccggtccttaaaccgtttaacggtttccgggttaggttgggtaacccgttgggttaaccgttcggtaaccggtttacggttaacccggggggtacgttaaccggaacggttaccgggtacgttaaccgggttaccgttaacgttaccgtaccggttaacggacccggttaaccggtcccgtaccccggttaccggccgttaacccggttccctccggtttccccgtcccccgtttacccgg

SEQ ID NO: 134401 - DNA, 654 bp, Homo sapiens
  misc_feature: GYAE6OF02FWTQC.17.33.C11.1.454.CMB.1.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggancagtccaccngtgcttactatccaaactggttccagcagaaacctggaacaagcaccagggcacgtcattatagtaacaaactaaacaaacactccacggacccctacgacccgtacttcctcgtaacgcctccccgttccgttcggggggacctaaaacggccgtacgtcccgttacgaccgtaacttcgttccgtggttacgtacgcacggtacctacggacggacggaggccgtgaacttattacgtcgtaccttactcgttacgtttagtcggttgcttagtcgtacgttagtcgggtacgggtacggaccgtagtcgtacgaccgttacgttacgtccgacgtcccgaaggccgttaaccgcccccgttacggttcccacgttaccgttcccgttaccccgtaccccgttcccgttacccg

SEQ ID NO: 134402 - DNA, 719 bp, Homo sapiens
  misc_feature: GYAE6OF02JGIDX.17.33.C11.1.454.CMB.1.raw
  modified_base (305)..(305): a, c, t, g, unknown or other
  misc_feature (305)..(305): n is a, c, g, or t
  modified_base (493)..(493): a, c, t, g, unknown or other
  misc_feature (493)..(493): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactactcctaaacgtggttccagcaagaacctggaacaagccaccgaggcactcgatttanacgtaacaaacaaccaaacactacccgtacggacccctcgacccgtattcacgacggtccttacccgttaccggttacgggggacctaaacggtcctacggtcccccttagaccctacgttcgtacgttcgggtcgtcgcgtacgccgtacggacgggaacggtacgggtctaggtactaactttacncggtacccttacttccgttaacgttttgggtacggttgtaccgtgttctcggtttacgtccgggtacgggtaagggaccgtaaaggtccgttaccgggtacccgtttacttaacgggttacccgtaaccggtacccggaaggttccccggtaccccggtaccccccgtttcgggtacccgtttacccgtttcccggtttccccgttacccccccttttacccccgg

SEQ ID NO: 134403 - DNA, 837 bp, Homo sapiens
  misc_feature: GYAE6OF02FVM58.17.33.C11.1.454.CMB.1.raw
  modified_base (588)..(588): a, c, t, g, unknown or other
  misc_feature (588)..(588): n is a, c, g, or t
tcagcgtagactagcacgaccggtgctcgatttagagtgagctcgttgggtttggggctggcgccaggggtcccttccaatatcagcacccatggcctggactcctctctttctgttcctcctcacttgctgcccagggtccaattctcagactgtggtgactcaggagccctcactgactgtcgtccccagggagggacagtcacgttctcacctgtcgccttacccaaactaccgttagggacgaccgacgttacaacccgtagtcgacctttaactacttacccaaacgttcggttaccgacgtaccgaaacgtaaacccgtcgggaacaacggaccctaacccgaggggacctactaccgtaatttacgtaaacgttaaccaaaaccgaaacctaaaacctaccgtacccgttaaccgggttaccccctacgggttaaccccctaactttaccgtaccgtaaccggttccccttacccggtttaccggttacggggggaacctaaacgtacccgttcggacccgtaccgtactaaccgttgttaccgtcgggtgtacgactaccggcgtaagggcggtaacggngtaccgtagtaactacgttacgtacgtaccttaccttcgttacggtttgtacggtacgttcgtaggtttacggtcttacggttacccgggacgggttaaacggacccggtaaagtccgtaccggttacccggttccgttaaacgggttcccggtaaccgtaacccgtacggttacccgtaccccggttaccccggttccggttaccctacccggtttaccccgtttacccggtaccccttaacccccgg

SEQ ID NO: 134404 - DNA, 751 bp, Homo sapiens
  misc_feature: GYAE6OF02FW2D2.17.33.C11.1.454.CMB.1.raw
  modified_base (237)..(237): a, c, t, g, unknown or other
  misc_feature (237)..(237): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggacgccctcactgactgtcgtccccagggagggacagtcactctcacctgtcgccttaccaacacgtggacncgagtcaccagtcgtacttactactacctaaactcggttaccagcaacgaaaccgtcggaacaacgaccacccgagggacaacctcgtactttaagtaacgtaaaccaaaactaaaccaaactacctacccgtacggtaccccctacggtccccgtacttacctccggaacggtcccttacccgttaccggttacgggggaacctaaacggtccgtccgaccgtacgactacgtcgttacgtggtacggttcgacgtacggtccgtacggacggaacggcggtacgtacggtaacttacttaccgtcgtacccttacttaccgttacggttttcgggtacggttcgtcgttacggtgtaccgtttacgggttccgggtaccgggtaacgggtaccgaacggttccgtacggtaccgtttacgttaacggttccgtaccgaacccggtaacggttcccgtaccggtcccccgttcggtaccttaccgttccgttacccgttcccccgttaccccg

SEQ ID NO: 134405 - DNA, 645 bp, Homo sapiens
  misc_feature: GYAE6OF02HPYZQ.17.33.C11.1.454.CMB.1.raw
  modified_base (180)..(180): a, c, t, g, unknown or other
  misc_feature (180)..(180): n is a, c, g, or t
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (596)..(596): a, c, t, g, unknown or other
  misc_feature (596)..(596): n is a, c, g, or t
tcagcgtagactagcacgaccggtgctcgatttagagtgagctcgttggggtttgggggggcgccgaggggtcccttcaatatcagcaccatggcctggactcctcttctttctcgttcctctctacttgctcgccgtacggtactattctacagcgtggtcggtagactcgagggaccnccctacacgtgtcgtcggtaccgtacccggagggacggactatccacctctctctggtactacctaccaacgtgaggacnctactcaacgtgtctactaactactacgactcgtacanaccgaaactacgagacactaccgacgcgtactactattataacgaactaaaacaacaacacgtacncgaccgactacnctacnccacgtccgtcctcggcgggtacganacgcgtcnctagcgttactggttcgtacggtgccgtacgacgtcgggtacggaacggagtcgtcgtaactacgtactcgacttccgtaacgtttcgttaggttggtcgtgtcgtgttacgtcggttacggcgggaacggacgagtcggactaaggtcttacggtacgacgtccggaacgccggttcccnccggttccgtacgcttaccggtccttaaccgtccctacctccttaacgg

SEQ ID NO: 134406 - DNA, 894 bp, Homo sapiens
  misc_feature: GYAE6OF02HGSIL.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgacgtgtcgtccccgagggacgggacagtcactctcgacctgtcgtccttaccaacacgtgggacactacgtacaccagttcgtacctttacgtactaccaaacgttcggttaccacggcaacgaaaaccgtgggaacaacggccaccccgagggacctaccgttcttaactttacgaacgttaaaccaaaacaaaccaaacctaccgttacccgtaccggacccccttacggaccccgtactttccgtaccgaaccggtcccgttaccccgttaccggggttaccgggggaccgtaaacggtcccgttacccggccccgttaacgtaaacccgtcggtttaacgttccggttggttcggtccgtaccgtacgtccgtacgggaaacggtaccgggacgtacgttacgtacgttacttacgtccgtaccgttaacctttcgtttaccggttttgggtcggtttcggtccggtttaggttccggttacggttttaccggttaccgggggtaccggggttaaccggggtaaccgttaacgggtacccgtttaccgggttaccgtttaacccgtttaacggtaccgtaacccggtaccccggtaaacggttaccccgggttaccccgttaaccccccggtttcggtaaccccgttttacccgttccccggttttaacccccgttaccccccgtttacccccgtttaccccgtttaacccccggg

SEQ ID NO: 134407 - DNA, 939 bp, Homo sapiens
  misc_feature: GYAE6OF02HH3V3.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagtactggtggtgactcaggacgtccctctacgtcgactgtcgtccccgagggagggtacagttcactcctcaccgttgtcgtccttacccaacgtaacgtggggactaccgtaacggttccaaacccgtacggttcgtaccttttaaccttaaaccgttaccctaaaaaccgtttcggggtttaacccaaggacccgaaacgtaaaacccggttacggaaaccgaaaccggaccccgtaaccccgaacggggcctaacccgtaccgttaattttaaccttaaaccgtaaaccaaaaaccaaacctaaaaccgtacccgtaccgtaaccccgggtacccctacggtaacccctaccttccgtaccaacggtcccttccccgtacggttacggggacctaacggtaccttccgtacccgttacgaactcgtacggttcgtgtacggtcgacccggtcgtacccggtaggtacgggaccggtaagggtccgtaaaggttaacgtttaaaccgttaaccggttacgtacccgtttacgtttaccggtttacgggttttcggttcgggttacgttccggttaccgggttacgtttaaccgttacggggtttacggggaaccgggttaaccggggaaacctaaaccggtacggttaccggtaccggttttaaaccgtttaaccggtaaccggtacccgggtaaccgggtaaccggtcccggttaccccggttaccccggttaacggtcccttaccccggtttacccggtttaccccgttacccccttaccccccgg

SEQ ID NO: 134408 - DNA, 687 bp, Homo sapiens
  misc_feature: GYAE6OF02G6MKP.17.33.C11.1.454.CMB.1.raw
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggagccctcactgactgtcgtccccaggaggtacagtcactcgtcactgcgtcttccaacacgtgancngtcacngtcgctactancctaagtcgtcatcacgaactgacaagccaccgtaggaccatcctagttactacgaactaaacgaaccaacgtacctacccgtccggtaaccctcgtaccccgtacttcgtaccgtacgtcccttacccgttccgggttacgggggaacctaaagtccgtccgtcccgtacgaaaccgtcgttacggttccttacgggtacgtacggtacgaacgtaccggtcggaacggggtaacggtccggtactacggtaaccttacgttaccgttaccgtcgttaacttccgttaccgtttggtacgttgtacgttagtacgtcgttaacggtcgggaccgggtacggaccgtagtacgtacgtaccgtaagttcggaacgccggacgtacgtcccgtacggtccctacggtacccgtctaccgttcccgtcccttaccccg

SEQ ID NO: 134409 - DNA, 747 bp, Homo sapiens
  misc_feature: GYAE6OF02JQ7N2.17.33.C11.1.454.CMB.1.raw
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
tcagcgtagactagcacgaccggtgctcgatttagagtgagctcgttgggtttggggggcgccaggggtcccttccaatatcagcaccatggcctggactcctctctttctgttcctcctcacttgctgcccaggtccaatttctcagactgtggtgactcaggcgtccctcactgactgtcgtcccaggtacgggacagtcactctccacgtgtctctcaacncgtggactcagtacacctaggtctcttactacnccgtaaacttcggttaccagacctaacggtaacctaggacctaacgacctaccggaggtaccacttcgaattttacgaagtaaccaaaaacaactaaaactccgttaccaccggtaccccttacgacccttacgtactccgtaaccggtcctacccgtttccggtaggggacctaacgactttcgaccctctaacgtaccgtgtcggttagtcggtcgtaacggtctaccgtgggaaacgcggtacgtccgtagttaaacccgtattaccggtccgtacctttacgtttaccgttcggtttacggtcgttaaggtcccgttagtttccggtaacgttccgggtacgtaccgggggttaacgaacccgttgtaccgacggtttacctacggtttaacgccggtacggtaccaaccgggttccccgtcccggttccgtaacccgttacgtccttacccggttccccgttaacccggtccccttaccgtccgg

SEQ ID NO: 134410 - DNA, 686 bp, Homo sapiens
  misc_feature: GYAE6OF02G2ETU.17.33.C11.1.454.CMB.1.raw
tcagcgtagactagcacgaccggtgctcgatttagagtgagctcgttggggtttgggggcgccaggggtcccttccaatatcagcaccatggcctggactcctctctttctgttcctcctcacttgctgcccagggtccaattctcagactgtggtgactcaggagccctcactgactgtcgtccccagggagggacagtcactctcacctgtcgtccttccaacactggacgcagtcaccagtgtcttactataccaaacgtcgttccagcaacgaaacctggacaacgcaaccaggcactcatttataacgtaacaaactaacaaacacctaccgtcggacccctgacccgattctacgtagtcccttcccgtaccggttcggggactaaacgtctacgcctacgactcgtacgtcgtaggtgtacgcctaggtccgtaggaacgggacggacggtccgtaggtaacttaagttaccgtacgtacccttctttaccgttaccgtttgggtagtcgtcgtagtcgtacgttcggtacggggtacggtacgggtaaccgaacgtcgtacgtaaccggttacgttacgtcggtaccgtaccggtaacggttccctcccggtccccgttacggtacccgttaaccttcccggttccccttcccccgttaccccttacccgttaccccg

SEQ ID NO: 134411 - DNA, 729 bp, Homo sapiens
  misc_feature: GYAE6OF02JTT2E.17.33.C11.1.454.CMB.1.raw
  modified_base (167)..(167): a, c, t, g, unknown or other
  misc_feature (167)..(167): n is a, c, g, or t
  modified_base (251)..(251): a, c, t, g, unknown or other
  misc_feature (251)..(251): n is a, c, g, or t
tcagcgtagactagcacgaccggtgctcgatttagagtgagctcgttgggtttgggggcgccaggggtcccttccaatatcagcaccatggcctggactcctctctttcctgttcctcctcacttgctgccagggtccaattctcagactgtggtgactcgaggacnccctcacgtgactgtcgtcccagggaggacacgtcactctactcctgtcgtacctaccaacgactcgggacacagtccaaccgngtcgtacttacgtactacctaactcggtacctacgacgaacgtaacctaggaacaacgacctaaccgacggccactactacttacaacgtaacaaactaaacgaactacctaccgtacccgacccgtccgacctacttcctaccgacggtccttacccgttcccgtacgggggtacaaacggtccgtaccgtacccggacgtaaccgtacgtttaaccggtcgtacggttagtacgtacgtaccgtcgtacggtacgggaacggaccgtcgtaggttaccgttacgtaccgttacgtaccttaccttaacgttcgtttacggttggttcgaccgtttgtacgttacgtcggttacggtacggtacgggtaactaacgtccgtacggttactacgttacgtacgccgtaacgtacggtccgtacccggtcccgtcgtaccttaccgtcccttacccgtacccgttcctaaccgttcccg

SEQ ID NO: 134412 - DNA, 702 bp, Homo sapiens
  misc_feature: GYAE6OF02FMM4O.17.33.C11.1.454.CMB.1.raw
  modified_base (215)..(215): a, c, t, g, unknown or other
  misc_feature (215)..(215): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagccctcactgactgtgtccccaggtaggacagtcacgtctcacctgngcttccaacgactggacgcagtcaccagtgtcttactacgtaccaaactggttccgaacgcgaacgtaaaccgtggacaagaccacccaaggggcaacgtacatttacgacgtaaccgaaacgaaacaaacctactccgtaggaacccctcggacccgtattcctcgaacgtcgtacccgtccgttgggggtaaccaacgcgtcgcctgaccacgtntcgtggngtcgtcgacgtcgnggacggtaaccgacgggtcgtcgtaacgttaacttacgttacgtaaccgttaccgttcgttaaccggttttcgggtacggttacggtacgtcgttacgtacgttacgttaccggggacgggtaacgggaccgtaacgtcggtaccgttaccggtacgttaacggtcctaacggtacccgtaacggtccgttacccggaccccggttccgtacccggttacgttaccggttcccgtaccccggttccccg

SEQ ID NO: 134413 - DNA, 934 bp, Homo sapiens
  misc_feature: GYAE6OF02HY87C.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgccagggtcaattctcagactgtggtgactcaggacgtccctcactgacttgtcgtccccgagggacgggacacgtcacctctacactgtcgtccttacccaacgtacgtcgggacgctacgtacacctagtcgtaccttaacttactaccgtaaaccttcggttacccagaccaacgaaccgtacggaaccgaacgccgaaccccgagggccgtaacctactacttttaagtaacgttaacaaaaccgaaactaaaacctaaccttaccccgtacggtacccccgtacgtaccccgtacgttcctacgacggcccttaccccgtcccggttttacgggggaaccgtaaacggccgtaccgtacccgtacggtaaccgtaacgtttcggttccgttacgggtggttccgggtaccacggtacccgttaagggcggggtaacgggtaaccgggtccgtacggttaaacctttacgttaacgtttaccgttacccgtttaccgtttaaccgtttacgtttttaacgggggtttcgggttcggtaccgtttcgggtttacgttaccgtttacgggtttcccggggaaccggggtaccggggtaaaacccggttaacggtaccggttaacccgggtaccgttttaaccggttttaacggtacccggttaaccggtaaccccgtaaccgggggtaccccttcccggggttaacccccccgtttaccggggttacccttaacccggtttccccgtttaaccccgggtttttacccccccgttaccccgtttaccccccgttttaaccccggg

SEQ ID NO: 134414 - DNA, 648 bp, Homo sapiens
  misc_feature: GYAE6OF02F8J6S.17.33.C11.1.454.CMB.1.raw
tcagcgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtcgtccccaggaggacagtccactctcacctgtgcttccaacacgtggagcagtcaccgagtcgcttactataccaaactcggttaccagcaagaaaccgtcggaacaagccaccgagggccactcatttatagtaacaaacaacaaacactaccgtacgaccctcgccgtacttcgacacggtcctccgtcgttcggggacaacgtcgtcgcctagactacgtcgtacgtggtagtcgcacgcgtggacggacgagcgtagtacttacgttcgtcgtaccttacgttacgttacgtttgggtggttgtccgttgttcgtacgttacggtcgggtacgggacgggtaccgaacgtcgtacgtaccgttacgttacgtcgaccggtaccgacggtacccgtcccggtaccccgtttccggaccgttaccgttcccgttaccgtttcccccgtacccgttccctttacccgg

SEQ ID NO: 134415 - DNA, 823 bp, Homo sapiens
  misc_feature: GYAE6OF02IXY2G.17.33.C11.1.454.CMB.1.raw
  modified_base (235)..(235): a, c, t, g, unknown or other
  misc_feature (235)..(235): n is a, c, g, or t
  modified_base (523)..(523): a, c, t, g, unknown or other
  misc_feature (523)..(523): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtaccccagggacgggacacgtcactctccacctgtcgtccttaccaacncgtcggacgtcgacgtccaccgagtcgtacttactaactaccctaaaacttcggtttaccacgaccgtaaacgtaaacccgtaggaaccaacggacccaacccgaggggaccaaccgttctaattttaacgtaaacggtaaaccaaaaacctaaaccaaaaccgtacctacccgtaccgggaacccccttcggacccctaattcccgtacgaccggtcccttacccgtccgggttacggggaaccaagtcctaccggtccctagaccttacgtcggtcgtggttacgngaccggtacgtccggtaaggacgggtacggacggtacgtacgtaaccttacgttaacgttaccggtaccctttaacgtttaccgttttacggttccgggtggttcggttccgttagggtttccgtaaccgtttcggttaacccggggtacgggtaaccgggtaaaccgtacgggtaccgttcccgggtaccgttaacgttaaccggtccggtaacccgtaccggtaaccgttcccgtaaccccggttccccgttaccgtcccgttcctttccccggttccccgttaccccggtccccccg

SEQ ID NO: 134416 - DNA, 804 bp, Homo sapiens
  misc_feature: GYAE6OF02JBQ7U.17.33.C11.1.454.CMB.1.raw
  modified_base (316)..(316): a, c, t, g, unknown or other
  misc_feature (316)..(316): n is a, c, g, or t
  modified_base (767)..(767): a, c, t, g, unknown or other
  misc_feature (767)..(767): n is a, c, g, or t
tcagcgtagactagcacgaccggtgctcgatttagagtgagctcgttggggtttggggctggcgccaggggtccttccaatatcagcacatggcctggactcctctctttctgttcctcctcacttgctgcccagggtccaattctcagactgtggtgactcaggagccctcactgactggtcgtccccgaggagggacagtaccacgtctcaccgtgtcgcttaccaacacgtggagcaaggtccaccagtgcttactatacccaacgtcggttccagtcaagaaacctggacaacgcgaccgagggtcacgtanattttacgaacgtaacaaaaccgaacaaacctaccttcccgaccggtaccccttacgacccgtattacctacgaaccggtcccttacccgttaccgggttcgggggaacctaaacgtccgtacgccccgttagaaccttaacgtccggttacggtttcggtacgtacggtccgacggaccggtaaggtcgggaaccggtagggtacgtaacggttaaccgttactttaccgttaccggtacctttacctttaacggtttacccgttttcggggaggtttaccgtacggtttcggttcggttacgtttaccgggttttaaccgggggacccggttaaggggaaacccgttacggtcccggttaacggttacccgtttaccgttaaggttacccgggtaccgaacccgggtaaccgtaccggtttacccgggtaccccgttaccggtaacccncccggtttttccggtaccccgttcccccggtaccccc

SEQ ID NO: 134417 - DNA, 590 bp, Homo sapiens
  misc_feature: GYAE6OF02IXTVW.17.33.C11.1.454.CMB.1.raw
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (389)..(389): a, c, t, g, unknown or other
  misc_feature (389)..(389): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagcgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttccaacactggagcagtcaccagtgcttactactaccaaacgtcggttccagcaagaaaccgtcggacaacgcaccgacggacactctatttatagtaacaaacaacaaacactccacgacccncgccgattcncgacgcctccgtcgtcggggacaacgctcgcctagacncgtgtcgtggtagtgcacgcgagacggacgngctanacgtattactcgtccttacttcgttacgtttggtggtcgtcgtgtcgtacttacggtcgggacgggtacggaccgaagtcgtacggtaccgttcgttaacggcgtaccgaccggacgtccgtacggccccgttcggtcctaccgtccgtttccgtccccgtcccc

SEQ ID NO: 134418 - DNA, 754 bp, Homo sapiens
  misc_feature: GYAE6OF02HNH8F.17.33.C11.1.454.CMB.1.raw
  modified_base (168)..(168): a, c, t, g, unknown or other
  misc_feature (168)..(168): n is a, c, g, or t
  modified_base (173)..(173): a, c, t, g, unknown or other
  misc_feature (173)..(173): n is a, c, g, or t
  modified_base (250)..(250): a, c, t, g, unknown or other
  misc_feature (250)..(250): n is a, c, g, or t
tcagcgtagactagcacgaccggtgctcgatttagagtgagctcgttgggtttggggctggcgccaggggtcccttcaatatcagcaccatggcctggactctctctttctgttcctcctcacttgctgcccagggtccaattctcgagtctgtggtgactcgagganccctnactgactgtcgtcccagggagggactcgtctacgtcgtaccgaccgttgtcgacctttaccaaactacgtgggaacncgaagttaccaccgtaggtacgtacctttaacttaacgtaccaaaacgttcggttaccaacgcgaaacttaacggtacggacaacggcctaaccgaacggtctacctataactttagtaacgaaaccaaacaaaccaacgtacctcgtacggtaacccctcggccctaacgttcgtacgtaacgtcccttacccgtaccgggttagggggacctaaacgtcgtaccgttccgacgtaaccgacgttcgtcgtccgggttagcgaccgtcggtaaccgtggaacggtacggacgtcggtagtaccggttaacttcgtcgtacctacgttacgtttacggttacggttggttcgtagttcggttcgtacttacggttaccggggacgggtaaccgggtaactacgggacttacggtaccgttacggttaacgtcggtaacggccggaaacgttcccggaccggtcccgttcggtacgttacctcgtttaccgtccccgttaacccg

SEQ ID NO: 134419 - DNA, 644 bp, Homo sapiens
  misc_feature: GYAE6OF02IWOCU.17.33.C11.1.454.CMB.1.raw
  modified_base (215)..(215): a, c, t, g, unknown or other
  misc_feature (215)..(215): n is a, c, g, or t
  modified_base (402)..(402): a, c, t, g, unknown or other
  misc_feature (402)..(402): n is a, c, g, or t
tcagcgtagactagcacgaccggtgctcgatttagagtgagctcgtttggggtttgggggggcgccaggggtcccttccaatatcagcaccatggcctggactcctctctttctgttcctcctcacttgctgcccagggtcaaattctcagactgtggtgactcaggagccctcactgactgtgtccccaggagggacagtcactctcacctgtncttacaacacgtggagcagtcaaccagtcgtacttactactacctaaacgttcggttaccaggacaacgaaaaccgtcggaacaacgccaacccgaggcactctattatagtaacaaacaaacaaacactaccgcgaccctcgacccgtattcgcacgcctcccgtcgttggggacaagtctcgccncgacacgttcgtcgtggtcgtgcacgcgtggacggacggagcgtcgtactacttactcgaccttacttacttacgttttggtcggttcgtcgttgtcgtcgttacgttcgggacgggaacgggaacgtaggtccgtacgtaaccgtttcgttaacgtaccgacggaaccgtaacggtccgtcccgaccccgttacggtaccctacgttccgttccgttcccccgtcccgttacccttacccg

SEQ ID NO: 134420 - DNA, 754 bp, Homo sapiens
  misc_feature: GYAE6OF02HW59C.17.33.C11.1.454.CMB.1.raw
  modified_base (169)..(169): a, c, t, g, unknown or other
  misc_feature (169)..(169): n is a, c, g, or t
  modified_base (174)..(174): a, c, t, g, unknown or other
  misc_feature (174)..(174): n is a, c, g, or t
  modified_base (228)..(228): a, c, t, g, unknown or other
  misc_feature (228)..(228): n is a, c, g, or t
tcagcgtagactagcacgaccggtgctcgatttagagtgagctcgttgggtttgggggggcgccaggggtcccttcaatatcagcaccatggcctgggactcctctctttctgttcctcctcacttgctgcccagggtccaattctcagactggtggtgactcaggganccctnactgactgtcgcccgagggagggactagtcactctcactgtcgccttaccaacncgtggacgcgtacgtaccaaccgtaggtcgtacctttaactactacctaaacggttcggttaccgacgtacgaaagaaccgtaggaaccaacgccgtaacccgagggacacgtactattagtaactaacgaaacaaactaacacctaccgaccggaccctcggccttactcctacgaccgtctacccgttcgggttacgggaacgaacgtcgtcctaccgacgtactacgtcgtcgtaggtcgtacgcgacgtccgtagggacggacggtggtacgtacggtaaccttagttacgtaccgtacttacggtttacgtttacggtttgggtcgttggtcgttcggttacggttaccggtacggttaccggggtaccgggtaacggtaccgtacgggtccgttacggttacccgtacgttaaccggtacacccggtaccggtaaccggtcccgtaacccggttccccggtaccgttaccggttaccgttcccggttacccgttaccccgtccccttacccgttacccgg

SEQ ID NO: 134421 - DNA, 616 bp, Homo sapiens
  misc_feature: GYAE6OF02JSGTL.17.33.C11.1.454.CMB.1.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (301)..(301): a, c, t, g, unknown or other
  misc_feature (301)..(301): n is a, c, g, or t
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
  modified_base (374)..(374): a, c, t, g, unknown or other
  misc_feature (374)..(374): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (527)..(527): a, c, t, g, unknown or other
  misc_feature (527)..(527): n is a, c, g, or t
  modified_base (586)..(586): a, c, t, g, unknown or other
  misc_feature (586)..(586): n is a, c, g, or t
tcagcgtagactagcacgaccggtgctcgatttagagtgagctcgttgggtttggggcgtggcgccgaggggtcccgttccaatatcagcaccatggcctggactcctctctttctgttcctcctcacttgctcgcccagggtccaattctcagactgtggtgactcaggacgccctcactgctgtcgtacccagggagggatagcactcaccacctgtctccttaccaactcggtgacgctagcaaccgngttnaccttactctaacctaaaggttcggttacacgacaacgtaaaccgnggtaacaacgccncccggaagcctaactctatttacggaacaanaaacgaacaactaacctccggacgccccngacccacttcgacgaccgtcctcccttcgggaggtacacgccgtgccctanaccgtctgtccgtggttcncgtaacncgcgtgacgaaggtcngtactaagtcttgctcttcctgttccgtttgngtntcgngtccgntttaaacgtccgggnaaaacgggtcacgtcgacgtcctaagtcggtacacgaccgacggtcctccgccccgttntaaaccgtcctaccgtctacccctacccgg

SEQ ID NO: 134422 - DNA, 708 bp, Homo sapiens
  misc_feature: GYAE6OF02HZK3C.17.33.C11.1.454.CMB.1.raw
  modified_base (362)..(362): a, c, t, g, unknown or other
  misc_feature (362)..(362): n is a, c, g, or t
tcagcgtagactagcacgaccggtgctcgatttagagtgagctcgttgggtttggggctggcgccaggggtcccttccaatatcagcaccattgcctggactcctctctttctgttcctcctcacttgctcgccagggtccaattctcagactgtggtgactcgaggagccctcactgactgtccgtccccgagggacgggacacgtccactcctaccgtaccgtgtcgtccttaccaaccgtacgtaggacgactacgtccaactagtctacttaacgtactaaccgtaaacgtcggttaaccacgactaaaccgtaaccgtagaacacgccaacccggtacggctactacttaagtttanaacgaaacaaaccgaacaaacctacctcccgtaccggtaccctacgcccttaactcgccgacgtccctccggtcggtaggactaacgcgtacgccgtacgactcgtcgtcgtggttcgtcgcgtactcgggtggaacgggtgaacgtcgagttaactacgttcctacgtaccttcgtcgtttacgttgggtacggtctcggttacgacgtttagtcggtacgggcgggtaaaccgcgtaacggtcgtaccggtacgtttacgtaccggactacccggacccggtaacgtccccggttccggtccctcgttcccgaacctttcccgttaccccttccctaaccccgg

SEQ ID NO: 134423 - DNA, 689 bp, Homo sapiens
  misc_feature: GYAE6OF02H3Q2O.17.33.C11.1.454.CMB.1.raw
  modified_base (151)..(151): a, c, t, g, unknown or other
  misc_feature (151)..(151): n is a, c, g, or t
  modified_base (156)..(156): a, c, t, g, unknown or other
  misc_feature (156)..(156): n is a, c, g, or t
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (302)..(302): a, c, t, g, unknown or other
  misc_feature (302)..(302): n is a, c, g, or t
  modified_base (376)..(376): a, c, t, g, unknown or other
  misc_feature (376)..(376): n is a, c, g, or t
  modified_base (408)..(408): a, c, t, g, unknown or other
  misc_feature (408)..(408): n is a, c, g, or t
  modified_base (550)..(550): a, c, t, g, unknown or other
  misc_feature (550)..(550): n is a, c, g, or t
  modified_base (646)..(646): a, c, t, g, unknown or other
  misc_feature (646)..(646): n is a, c, g, or t
tcagcgtagactagcacgaccggtgctcgatttagagtgagctcgttgggtttgggggcgccaggggtcccttccaatatcagcaccatggcctggactcctctctttctgttcctctcacttgctcgccaggtccaattctcagctgtgngactnacggagccctacactgacttgccgtcccgagggacggacngtacacctctacncgtgtcgcttaccgaactacgtggaacnccgtagtccgaccagttcgaccttacgtaccacttaaacgttcggtacacgtacaacggtaaacncgaacgaacgccgacggaccggctactacgtattaactaagtaacaaacgtaacaacgtcttccgaccgtaccncgtaccgtacttcgacgtacgtccgttaccgnggttacgggaacacgtccgtacgtccgtacgactgtacggtcgtaggtcgcggtaacgaccgtcgtacggacggttagcgtacgtacgtacgttacgtacgtacctacgttaccgttacttaggttcgggtagcggttacgnggttacgttacgtacgggtccggtacggaccgggaacttaccgaggttaccgtaggttaccacggttcaaccgtccgacgtccgtcccgtacccgngttacccgccggttccttacccggtcctcccgttaccgtaccg

SEQ ID NO: 134424 - DNA, 734 bp, Homo sapiens
  misc_feature: GYAE6OF02HNNTU.17.33.C11.1.454.CMB.1.raw
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggacgccctcacctgacgtggtcgtccccgagggagggaccaggtccacgtctcacgtgtacgcttaccgaacacgtggacgtcacggtcaccgagtgtacttacctaactcctaaacgtggttaccagtacaacgaaaccgtgaacaacgaccgaccgacgggtacaactacgtatttaactaacgtaaccaaaaccaaacaaaccgaccttaccgtaccggtaacccctacgggacccttaacgttacccgtacgaccggtcccttcccgttaccggttacggggggtaacaaacggtccgtacgtaccccgtagtaacccgtacgttcggttaacgttcggggttacggtcgtacggaaccggtccggtacggaacgggtaacggtacggcgtacggtacttaaacgttctaccgtccttaccgttacgttacggtttggtacgtgcgttacgtagcgttacggtacgggcggtacgacgttacgcgtatacgtactacgccgtagcccgtaggaccgtcggaccccgtcgtactacctccgttaccgtccccttcctaccgttaccg

SEQ ID NO: 134425 - DNA, 703 bp, Homo sapiens
  misc_feature: GYAE6OF02IF1F4.17.33.C11.1.454.CMB.1.raw
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
tcagcgtagactagcacgaccggtgctcgatttagagtgagctcgttgggtttggggggcggccaggggtcccttccaatatcagcaccatggcctggactcctctctttctgttcctctcacttgctgcccagggtccaattctcagactgtggtgactcagganccctnactgactgttacgcccagggcggacagtcaactcctnacgtgngacttccaacgacgtggcgancggtacaccgtancggtcttaacctntaccaaaacttcggttacccgagaccaacggaaaaccttcgggaacaacggcctaaccgtacggggcaccgtaccattttaagacttaaccaaaacaaagtaaaccaaccttccgaaccgttacccgagcccttagacttccgacgtccgttaccctcggttaggggacgaacnccggtcncccgngtacacgttcgacttggcgtttancgacggtccgtacggacggtaaaggcggacgtacgtacgtacttacggtaccacctaaccgttacgttacttcgggtacggttgtaccgtggttcgtaaggtctacgggttacggacgggtacgaacgtacgcgtccgtacgtacgttacgacgaccggaccgttacggcccgttacccgtacgtacccgtaacccgttccgttcgtcccctacccgttcccgtttaacccg

SEQ ID NO: 134426 - DNA, 711 bp, Homo sapiens
  misc_feature: GYAE6OF02IGDQT.17.33.C11.1.454.CMB.1.raw
  modified_base (232)..(232): a, c, t, g, unknown or other
  misc_feature (232)..(232): n is a, c, g, or t
  modified_base (456)..(456): a, c, t, g, unknown or other
  misc_feature (456)..(456): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtcgcttccaactacgtggacnccagtccaccagtcgcttactactcctaaagtggttaccaggacaacgaaaccgtcggaactaaggaccaacccgagggaccacgttactaacgttttacgaacgtaaccaaaacaaacaaaacctacttacccgtacggaacccccttgaccccgtaattcctacacggtcctcccgtacggttcggggacaacgtctacgccctagactactgtcgtcggtncgccacgtccgtagacggaccgagtcgtagtactacgttaccgtcgtaccgttactaccgttacgttttcgggtacgttcggtctttacggtcgtacgttacggttaccgggaccggggtaaccggtaaccgtaagttccgtaccggtaccgtttacgttaaacggtccttaaccggacccgtaacggttcccgtacccgtaccccggttccgggttaccacccgttcctttacccggttcccccttaaccccgg

SEQ ID NO: 134427 - DNA, 848 bp, Homo sapiens
  misc_feature: GYAE6OF02G33ZX.17.33.C11.1.454.CMB.1.raw
tcagcgtagactagcacgaccggtgctcgatttagagtgagctcgttgggttggggctggcgccaggggtcccttccaatatcagcaccatggcctggactcctctctttctgttcctcctctacttgctcgcccgagggtaccaattcctacagtactggttgggtagactcgaggacgtccctcactgactgtccgtcccgagggaggactcgtcactctcgactgtactcctcaactgtgactgacgtcactggtctactactactacctaacgtcggtacaacgtacgaacgtaacgtacgaactaacgaaccaccggaggtacctacttactaagtttacaacgaaccaaaaccaaacgtaacctacctccgtaccgaccgacgtaccgttatccgacgtcggtacccttcccggttacgggtacgggactaacggtccgtaccggtaccgtagtaacccgtacggttccggttggtacggggttcgtacggtaccgtacgggtaccggtacggggaacccggtacgggtaccggtacgtttaacgggtaaaccgtttaccgtttaaaccggtcccgggtttacccttaacggtttaccggttttaacccgggtttggggtttaccgggtacggtttccggttagggtttaccgttaccggttcggtaacccggggtaccggaaccgggtaaaccgtaaccggttaaccggtacccggttaccggttaacgttaaccggtaaccgtacccggtaaccggttaaccccgggtccccgtaacccggttccggttaccgttaccgtaccccgtttaccccggttacccgtacccccgtttaacccg

SEQ ID NO: 134428 - DNA, 713 bp, Homo sapiens
  misc_feature: GYAE6OF02G9D36.17.33.C11.1.454.CMB.1.raw
tcagcgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcgaggacgccctcactgactgtcgtcccaggaggacagtcactctcacgtgtcgccttaccaacacgtggacgcacgtccacctagtcgaccttaacctataccctaaacttcgggttaccagaccaacgaaaaccgtcggaacacgccgacccgaggcactctaattataacgtaacaaaaccaaacaaacctacctaccgaccggtaccccgtcgtaccctacttccgtaccgcgtcctccccgttacgggtcggggaacaacgtcgtaccgcctacggaaccacgttcgtcggttagggtcgtacggcgtaccgaccgtaggacgggtacggacggtcctagtacttactacgtccgtaccttacgtacgtttcgttggtcgtagtcgtgtcgtacgtcgtaggggaccggacggacgtacacggtaccgtaccgtacgttacgtcgtaacccgacccggtacggtaccctccccggtccccggttaccgttacccgttaccgttcccgtttcccccggtacccccgttccccgttccccgttaccccgg

SEQ ID NO: 134429 - DNA, 753 bp, Homo sapiens
  misc_feature: GYAE6OF02F7HRW.17.33.C11.1.454.CMB.1.raw
  modified_base (167)..(167): a, c, t, g, unknown or other
  misc_feature (167)..(167): n is a, c, g, or t
  modified_base (236)..(236): a, c, t, g, unknown or other
  misc_feature (236)..(236): n is a, c, g, or t
tcagcgtagactagcacgaccggtgctcgatttagagtgagctcgttgggtttgggggcgccaggggtcccttccaatatcagcaccatggcctggactcctctctttctgttccctcctcacttgctgcccagggtccaattctcagactgtggtgactcgagganccctcaactgactgtcgtccccgaggagggacagtcactctcgacctgtcgcttccaactacgtggacncgacgtccaccgagtcgtcttaacgtataccaaattcggttccagacaacggaaaacctggaaaccaacgaccaaccccgagggacacctacgtatttagtacgtaacaaaacaaacaaacacttaccgtcggaccccgtcgacccgtacttacctacgacggtccttcccgtccggtacgggggaacctaaagccgtcgacccgtacgtaccgacgttcgttaccggtggttacgtacgcgtacgtaccgtaggacgggtacggacggtcgtacgtacttacgttacgtaccgtaccttacgttccgtttaacggtttgggtacggtcgttgttcggtcgttaccgtacgtttaccggggaccgggtaacggtaaccgtaacggtcccgttaaccggttaacgtttaccggttaactaccgtaccggtaacccgtaccggttccgtacccggtaccccgtaccggtcctaccgttacccgttcccgttaacccccgttacccctccgtttaccccg

SEQ ID NO: 134430 - DNA, 975 bp, Homo sapiens
  misc_feature: GYAE6OF02IZPAD.17.33.C11.1.454.CMB.1.raw
  modified_base (184)..(184): a, c, t, g, unknown or other
  misc_feature (184)..(184): n is a, c, g, or t
  modified_base (639)..(639): a, c, t, g, unknown or other
  misc_feature (639)..(639): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccacgggtcctaattcctcagacttggtggtacgacctcgaggaccgcccctnaccttagcgttggtccgacccgaagggacgggaccaggtaccacgttcctacctacgtgtcgtccttacccactacggtacggacgactaacgtccaccgtagttacgtcctttaactaacctaaccctaaacggttccggttaaccaacggacgtaaaccgttaaacccgtaacgggtaaccaaaccgggacccctaaaaccccgggtcggggaaaccctacccgtttaactttaaccgttttaaaggtaaaccctaaaaaaccaaaaacccttaaaaaccctaaaccctaaccccggttcccgtaaccccgggttaaacccccttccccgggtaaccgtttacccggttaccctaacccgggtacccggttaccccgtttccccgggttttacccgggtaaaccgggggtaacccgtaacggtacccgttccgttaacccgacggttaacccnccgtttcggtttacggtcggtcgttacgaccgtacgtcggacggtacgggaggtcggtacgtacgttaacttaacgttacctaccgttaccgttacgtttaccgttcggtttaggttacggtcgttacggttggttacgttccggttaacgggttaccgggtaaccgggaacggtaaccgttaccggtacgttaccggttaaccgtttaacggtacccggtacggtaacccgggtaaccggtcccggtacccgtaccccggtacccggttacccggttaccgttccccggttcccgtttaccccccgggttaccccgttcccggttacccggtacg

SEQ ID NO: 134431 - DNA, 742 bp, Homo sapiens
  misc_feature: GYAE6OF02G5SPC.17.33.C11.1.454.CMB.1.raw
  modified_base (81)..(81): a, c, t, g, unknown or other
  misc_feature (81)..(81): n is a, c, g, or t
  modified_base (107)..(107): a, c, t, g, unknown or other
  misc_feature (107)..(107): n is a, c, g, or t
  modified_base (188)..(188): a, c, t, g, unknown or other
  misc_feature (188)..(188): n is a, c, g, or t
  modified_base (479)..(479): a, c, t, g, unknown or other
  misc_feature (479)..(479): n is a, c, g, or t
tcagcgtagactagcacgaccggtgctcgatttagagtgagctcgttgggttggggctggcgcaggggtccttccaagtancagcaccataggcctggactcctctntttcctgttccttcctctacttggactgaccgagggtaccaattctacagaccgtgtcgggtagaccgtcaggacgccctnactgactcgtccgtacccgaggtagggcacggtctactctcaccgtgtctccgttaccaaacgtacgtggaactcgtacgtaccaaccgaggtactcttaacgtactaaccaaagttcggttaccaagtccgtaaacgaaccgttacgaaccgaacgtccgaacccggaggtaccctaagttaccgtaactttagaaccggttaaccaaacggtaaactaaaccgccgtaccgtaccggtaacccctggttacccagtttccgacgaccgtcctaccgtcgggtacgtaanacgtcgcgacctgaaactcgtctacgtagtcgacgactcggaacgtcggaacggcgtacgtagtaaacgtaccgttaacgttccgacgtaaccgtttaggtaacttttggtaccgggttgtaggttacgttacgacggtttcctaacgggtaccggttacgggaaccgtacggtaaggacctacgtagttccgttaacgcggtaaccgtccgacggtacttcccggtaccgtcgtcgaaccgttcccgtagttccccgtcccg

SEQ ID NO: 134432 - DNA, 831 bp, Homo sapiens
  misc_feature: GYAE6OF02IAXU0.17.33.C11.1.454.CMB.1.raw
  modified_base (128)..(128): a, c, t, g, unknown or other
  misc_feature (128)..(128): n is a, c, g, or t
  modified_base (165)..(165): a, c, t, g, unknown or other
  misc_feature (165)..(165): n is a, c, g, or t
  modified_base (244)..(244): a, c, t, g, unknown or other
  misc_feature (244)..(244): n is a, c, g, or t
tcagcgtagactagcacgaccggtgctcgatttagagtgagctcgttgggtttgggggcgccaggggtcccttccaatatcagcaccatggcctggactcctctctttctgttcctcctcacttgctncccagggtccaattctcagactgtggtgactcagganccctcactgactgtcgtccccaggagggcagtccactctcacctgtcgcttccaaactactggacgctaggtccaaccngtcgtacttacgtaatcccctaaaacttcggttcctacgacgaacgtaaaacccgtggaaacaacggtacccaccccgaacgggacctaaccgtcgtaactttaataacgttaacaaaaccaaaaccgaaacctaacctaccgtaccggtaccccccgtacggtccccggtaacttaccgtcgtaaccggtccttccccgttaccggttacgggggaccgtaaaacgggccttaccgaccccgtacggtaacctaacgtttccgttccgtcggttcggtcgtacgtaccggtcccggttacgggaacggaccggtaaacgggtccgttacgttaccttaacggttaacccgttacgttcccgttacctttaccgtttacggtttcgggtcgggtttacgtcggttcgttcgtacgttacgggttccggtaccggggtacggaacccgtacggtaccgtacgtaccgtttccgtaaccgtcgtaaccgggtacccggtaacggtcccggttcccgtaccccccggttaccgttaccgtccctttacccggttccctttaccccgtaccccgttaccccgtttacccgg

SEQ ID NO: 134433 - DNA, 999 bp, Homo sapiens
  misc_feature: GYAE6OF02FIZH2.17.33.C11.1.454.CMB.1.raw
tcagcgtagactagcacgaccggtgctcgatttagagtgagctcgttgggtttggggctggcgccagggtcccttccaatatcagcaccatggcctggactcctctctttctgttcctcctcacttgctgcccagggtcaattctcagactgtggtgactcaggacgtccctcactgactgtcgtccccgaggaggactagtcacgtctcaccgtgtcgtcttaccaactacgtaggacggctaacggtcctaaccgaggttacgtaccttttaactaccgttaccctaaaaccgtttcgggttaccaaggtaccgtaaaccggtaaaaccccgtagggtaacctaaaccggtaccccgaaccccggtagggtaccctaaccgttaacctttaagttttaaaacgttaacgttaaaccaaaaaacccgtaaaaacctaaacccgtaaccgttacccgtaacccggtaacccccgttacggtcccccgttaaactttccgtaccggaaccggttcccgtttacccccggttacgggtttacggggggaacctaaaaccggtcgttaacccgacccgttaacggtaacccgtaacggtttcggtcccgttaagggtccgggttacgaccggtaaaccggttccggtaacggtaacggggtaaccggtacggtaccgttaaccggtaacgttttaaccgtttaaccgggtaccttacccgtttaccggtttaccgtttacggttttaacggggtcggttacgttaccggttacgggttaccggttacgtttaaccggggtttcccgggggaaaccgggttaaaccggggtaaacccttaaccggggtaccgttaaccggggttacccgttaaacggtttaacccgttaccggaacccgggtaaacccggtaccggttacccggttacccggttacccccggttaccgggtaaccctttaccggtttaccccgtttacccgggttcccccctttaaaccccgg

SEQ ID NO: 134434 - DNA, 906 bp, Homo sapiens
  misc_feature: GYAE6OF02IIFFJ.17.33.C11.1.454.CMB.1.raw
tcagcgtagactagcacgaccggtgctcgatttagagtgagctcgttggggtttgggggggcgccagggggtcccttccaatatcagcaccatggcctggactcctctctttctgttcctcctcacttgctcgcccagggtccaattctcagactggtggtgactcgaggacgccctcactgactgtcgtcccgaggaggacagtcactctcactgtactccttaccaacacgtggacgacctagtaccaaccgtaggtcgtacctttaactacgtaacctaaaacgttcggttaccaacgacgaaacgtaaaccgtaggaaccaaacgaccaacccgacgggacctaaccgttactaagtttaacgtaacgtaaaaccaaaaaccaaacctaaaacctaccgtacccgtaaccggtaccccctacggtacccttacttaccgtaccgtaaccggtcccttaccccgttaccgggttacgggggaaacctaaacggttcccgtaccggtacccgttaacggaaccttaaccggttacgttacgggttcggtacgggtaccggtacgtaccggtaccggtacgggaaccgggtaaccgggtacggtacgttaaccgttaaccggttaactttaccgttaccgttaacccgttaccctttaacgtttacgggttttacgggttcgggttacgtcggtttacgttacgttacggtttacgggtaccggggtaaccggggtaacgggttaaaccggtaacggtacggttaaccggtacccggtttaacgtaccggttaaccggacccggtaaaccggtaccgggttacccgtaccccggttcccccgttacggttacccttaccggttcccctttacccggtaccccttaccccttaccgttaaccccgg

SEQ ID NO: 134435 - DNA, 758 bp, Homo sapiens
  misc_feature: GYAE6OF02GR1SJ.17.33.C11.1.454.CMB.1.raw
  modified_base (364)..(364): a, c, t, g, unknown or other
  misc_feature (364)..(364): n is a, c, g, or t
  modified_base (631)..(631): a, c, t, g, unknown or other
  misc_feature (631)..(631): n is a, c, g, or t
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggagccctcactgactgtcgtaccccgaggagggacagtcactctcacctgtgccttccaaacactggagcacgtcaccaggtcgtacttactataacctaaacgttcggttaccacggacaacgaaaccgtggaaccaaggaccctacccgacgggactactagtaattataacgtaacctaaaacaacgaaacctaccnccgtacgaacccctcgaccgtattctaccagtccctaccttccggtcggggacaacgccgtacgccgtagaacctacgttggtacgttgggtagtcgaaccgagtccgtaggtaccgggaaggtacggtaccgtagtacttaaccgttacttaccgttaccttaccgtttacggtttaaccggttttcgggttacgggtcgtccggtttagtaccgtacgtttaaccggtcgggtacggggaaccggggtaacgtaacggtacccgngggttaacccttcgggtttaacgtaccgtaacgtacccggaacggttcccgtaaccccgtccccgtttaccggtacctacccggtttaccgttaccctttacccccggtaccctcccgtttacccgg

SEQ ID NO: 134436 - DNA, 772 bp, Homo sapiens
  misc_feature: GYAE6OF02FNEZD.17.33.C11.1.454.CMB.1.raw
tcagcgtagactagcacgaccggtgctcgatttagagtgagctcgttgggtttggggggcgccgaggggtcccttccaatatcagcaccatggcctggactcctctctttctgttcctcctcacttgctgcccgagggtccaattctcagactggtggtgactcaggacgccctcactgactgtcgtccccaagggagggacagtcactctcacctgtcgtccttaccaacgtacgtagggacgtacgaacggtaccaacgtacgtcgtacttaactaccgtaacctaaacgttcggttaccgagaccgaaacgtaaaccgaggtaaccgaacggccaaccgaacgggcctactcttaagttaactaacgtaaacaaaaccaaaccaaaccaccttacccgtaccggtaaccccgtcggtaccccgtacttccgtacgtaccggtacccttcccgttaccgggttacgggggaacctaaacggtccgtaccggtcccgtacgaccgtaaccgtttcggttacggttcgggtacggtcgtaccgtacgggtaccgtacgggtaacgggtacggtacgggtacgtacgttacgtaaccgttacgtaccgtaccttcttacgtttacgttcgggtaggtcgtgtcgtgtacgttacgggtcgggtaaccggagaaccgtacgacttacggtaccttacgtacgtcaccggtaccgtacgtccgtcccgtacccgtctacgttacctcccgttaccgtcccctccttcccttaccg

SEQ ID NO: 134437 - DNA, 828 bp, Homo sapiens
  misc_feature: GYAE6OF02HE124.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcgaggacgccctcactgactgtcgtccccaggaggacagtcactctcacctgtcgcttccaacacgtggacgacagtaccaccgagtcgtaccttaactactacctaaaacttcggttaccacgtcaaacgaaaccgtaggaaccaacggaccaaccccgaacggggacctaaccgttactaacttttaacgtaacggttaaaccaaaaacctaaaaccaaaacctaaccgttaccccgtaaccggtaaccccccgtacggacccccgttaacgtttacctaccgaacggtaccccttaccccgttccgggtttaccggggggtaactaaaacggtaccgtcggtaccccctagtaacccgtaaccgttcgttaccgtttacggttacggtcggacccgtaccgtaccgttacgggaacgggaaccggtaacggccgtaagtaaccgtaacttaccgtcgtaccttaccttaccgttacgttttgggtcgttagcgttcgttacgtcgtttacggttcgggtacggggtaaccgggtaaccgaacggtaccgttacggtacccggttacgttaacggtaccgaaccgtaccgtaaccggtacccgttcccggtcccccgttacggtaccgttaccgttacccgttacccgttcccccgttcccccg

SEQ ID NO: 134438 - DNA, 773 bp, Homo sapiens
  misc_feature: GYAE6OF02H3ERF.17.33.C11.1.454.CMB.1.raw
  modified_base (308)..(308): a, c, t, g, unknown or other
  misc_feature (308)..(308): n is a, c, g, or t
tcagcgtagactagcacgaccggtgctcgatttagagtgagctcgttgggtttggggctggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttcaacactggagcagtcacagtgcttactatccaaactcggttccagcagaaacctggacaacgccaccgtaagggccactcgtaattttaanacgtaacaaaacaaacaaactaccgtaccacggtacccctcgacccgtacttaccgtccaacggcccttcccgtccggttacgggggaacctaaaacgtccgttacggtccccgtacgacctaccgtggttaccttagggttcgttcggccacggtacccgttacggaacgggtaacggacgggccgttacgaacgtttaacttaacgtcgttaccccttaacgttcccgtttaacgttttcgggtaggttcgtacggtttagttcgtaccgttaggttaccgggtcgggttaaccgggaaccaaaacgggttccgttaccgggtaaccggtttaaccgttttaaacgggtccttaacgggtaaccccgaaaccgggttccccgtttaacccggccccccggtttaccggggttcccttaacccccgggtttactttccccggttacccccgtttaacccccccg

SEQ ID NO: 134439 - DNA, 686 bp, Homo sapiens
  misc_feature: GYAE6OF02GMIA4.17.33.C11.1.454.CMB.1.raw
  modified_base (236)..(236): a, c, t, g, unknown or other
  misc_feature (236)..(236): n is a, c, g, or t
  modified_base (660)..(660): a, c, t, g, unknown or other
  misc_feature (660)..(660): n is a, c, g, or t
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtcgtccccagggacgggacagtcactcgtcacctgtgccttccaacacgtggacncagtcaccagtgcttactactccaaactcggttccagcagaacctggacaagcaccgagggcactcacttatacgtactaaacaacgaaacactccgtacgaccccgtgcccgtattctacgacggcctcccgtccggttggggacctaaacgtcgtcgaccccgtgaccgtactcggtcgtaggtcggtacgtccgacggtaccgtggaacgggtacggacgggacgtcggtaacgttagttaccgtcggttacccttacgtcctttaacggtttcggttacgggttacgttcgtcggttacggtacgtttaacggttccggggtcgggtaaacgggtaaccgaacgggtccgtacgggtacccgttagttacggtaccggaaccggtacccgacggtccgtaccggtccctccggttaaccnccgtttacgtccgtaccccttacccg

SEQ ID NO: 134440 - DNA, 747 bp, Homo sapiens
  misc_feature: GYAE6OF02GY79B.17.33.C11.1.454.CMB.1.raw
tcagcgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactggtggtgactcgaggacgcccctcactgactgtcgtccccagggagggacagtcactctccacctgtcgccttaccaactactggacgcacgtaccacctagtacgtacttacctactacctaaacgttcggttaccagacgaacgtaaaccgtggtaacaacgaccgaccggagggacctactaccttaatttacgtaaataaccgaaaaacctaaaccgaaaacctaccgttacccgaccgggtaacccctcgtaccccgttacttccgtacgaccggtcccttacccggttcggtacgggggacaacgtccgtaccgcctacgactaacgttcgtacgttggtgacgcgacgtccgtaggaccgggtacacggtcgttaacgtacgtttaactccgtccgttaccttaaccgttcgttttaacggtttggttacggtcgtacgttcgttcgtacgttcggtcgggtacgggtaaccggacacggtacgttacgaccgttagttacgacggtaccggcccggtacggtcccttccccggccgttaccggtcctaccgtttccgtaacccgtccccttacccgtaccgttaccg

SEQ ID NO: 134441 - DNA, 732 bp, Homo sapiens
  misc_feature: GYAE6OF02JQK8I.17.33.C11.1.454.CMB.1.raw
  modified_base (132)..(132): a, c, t, g, unknown or other
  misc_feature (132)..(132): n is a, c, g, or t
  modified_base (172)..(172): a, c, t, g, unknown or other
  misc_feature (172)..(172): n is a, c, g, or t
  modified_base (626)..(626): a, c, t, g, unknown or other
  misc_feature (626)..(626): n is a, c, g, or t
tcagcgtagactagcacgaccggtgctcgatttagagtgagctcgttgggtttggggcgtggcgccaggggtcccttccaatatcagcaccatggcctggactcctctctttctgttcctcctcacttgctnccaggtccaattctcagactgtggtgactcaggagccctnactgaccttgtcgtccccgagggagggacctaggtccactcctccaccgttggtcgtccttaccaccgtaactgggacgtaccaaggtccaccgaggtccactttactactacctaacgtcgtaccgtacgacacgtaacctcggacaacgccacccacgggcactacgtacttaatacgtaacaaaccgaacaaacctaactacctacggtaacccctccgacccgtactcgtactcggacccgtccgtcgtacgggggactaaacggcctcggtaccctagtccgaacttcggttccgtacggttagtccgaccgtcggtacccggtacgtacgggacgacgggtacgtaccgtacttacttaacgtcgtacctaccgttaccgttacgtttcggttcggtacgttcttgtacgttcttacgtcgggttaccgggacggtacggtaaaccgngttaccgtaccggttacgtaccggtacgtaaccggtaccggtaccggtaccgttcccgtacccggtccggttacccgaccgtttacgtcccgttacccctccccgg

SEQ ID NO: 134442 - DNA, 709 bp, Homo sapiens
  misc_feature: GYAE6OF02HRUCN.17.33.C11.1.454.CMB.1.raw
tcagcgtagactagcacgaccggtgctcgatttagagtgagctcgttgggtttggggctggcgccaggggtcccttccaatatcagcaccatggcctggactcctctctttctgttcctcctcacttgctgcccagggtccaattctcagacgtgtggtgactcgaggcgccctcactagactgtcgtcccgaggaggacagtcactctccacctgtctcttaccaacacgtggacgactagtccaccgagtcgtacttaactacgtacctaaacgttcggttaccagacaaacgaaaccgtagggaacaacgacccgaacccggaggaccaactcttaattttaacgaacgtaaaaccaaaaccaaaccaaaccgtacctccgtaccgacccctcgaccctattcgacgcgtccctccgttcggtacgggacaacgcctcggtcctagacctgtcgtcgtacggtcgtacgacgtacgccggtaggaacgggacgtcggtacgtacgtaacgtttacgtacgttccgtacccgtttactttccggtttaggtttcggggtgttacggtccgttaggttccgtacgttacggggttccgggaacggggaaccggtactaaccgtcggtaccgtacgtttacgtaacgccggaccgtacgaccggtccgaccgtcccgtacggccttccgtaccttcccgaccccttccg

SEQ ID NO: 134443 - DNA, 860 bp, Homo sapiens
  misc_feature: GYAE6OF02G62B9.17.33.C11.1.454.CMB.1.raw
  modified_base (212)..(212): a, c, t, g, unknown or other
  misc_feature (212)..(212): n is a, c, g, or t
  modified_base (264)..(264): a, c, t, g, unknown or other
  misc_feature (264)..(264): n is a, c, g, or t
tcagcgtagactagcacgaccggtgctcgatttagagtgagctcgttggggtttggggggcgccaggggtcccttccaatatcagcaccatggcctggactcctctctttctgttcctctcacttgctgcccaggtccaattctcagactgtggtgactcagggtacgccctcacctgtacgtcgtcgtaccccagggaagggacagtaccnctctccacgttgtcgaccttacccaacgtacgtggacgccgaggtccaaccnggttcgaccttaccgtactaaccgtaacgttcggttaccacgtaccgaaacgaaaccgttacggaaccgaacggaacccaaccccgagggtccaacctaccgttaatttaacgttaacgttaaaccgtaaaaaccaaaaccgtaaaacctacccgtaccgtttacccggacccctccgaccgttactaccgtaccgacgtccttcccggtaccggtacggggacctaacgtccgtacccgaccgttgaccgtacgttcggttaccgttgggttcgtacgggtacctcggttaccggaggggttaaccgggaaccggtaacgggtacgttacgtaaccgtttaccgtttaaccgtccggttaacccgtttacgtttaaccgtttccgttttgggggttaccgttcggtccgttggttaccggttacgttccgggtacggggtaccggtaaccgggttaacgtaaccgtcggtaaccggttaccgtaaccggttactacccggtaccgtaaccggtacgtcccggtacccgttccccggttcccgtaccgtcccgttccgtttacccggtcccccgttacccggttacccttacccgg

SEQ ID NO: 134444 - DNA, 490 bp, Homo sapiens
  misc_feature: GYAE6OF01BUA5A.9.57.F02.1.454.CMB.1.raw
  modified_base (414)..(414): a, c, t, g, unknown or other
  misc_feature (414)..(414): n is a, c, g, or t
tcagtgatacgtctcacgaccggtgctcgatttagctcgatatagttgggtttggggctctgcttcagctgtgggcacaagaggcagcactcaggacaatctccagcatggcctggtctcctctcctcctcactctcctcgctcactgcacagggtcctggggccagtctgtcctgacgcagccggcctcagtatctgggtcccagggcagagggtcaccatctcctgcactgcgaacagctccgacgtcgcgacaccttatattgtacactggtatcaagtacttccagggacagcccccagactcctcatctattctaacaccttccgaccctcacgggttcctgaccgattctctggctcccagtctgcacctcacgccctccctggccgtcactgggctccagtctgagntgagctgattatactgcctactcctatcgacagcagcctgagagtgtgtatcggcggaggaccaagctggtacccg

SEQ ID NO: 134445 - DNA, 511 bp, Homo sapiens
  misc_feature: GYAE6OF02I9A63.9.57.F02.1.454.CMB.1.raw
  modified_base (284)..(284): a, c, t, g, unknown or other
  misc_feature (284)..(284): n is a, c, g, or t
  modified_base (319)..(319): a, c, t, g, unknown or other
  misc_feature (319)..(319): n is a, c, g, or t
  modified_base (460)..(460): a, c, t, g, unknown or other
  misc_feature (460)..(460): n is a, c, g, or t
tcagtgatacgtctcacgaccggtgctcgatttagctcgatatagttgggtttgggggctctgcttcagctgtgggcacaagaggcagcactcaggacaatctccagcatggcctggtctcctctcctcctcactctcctcgctcactgcacagggtcctgggcccagtctgccctgactcagcctccctccgcgtccgggtctcctggacagtcggtcaccatctcctgcactggaaccagcagtgacattggtgcttataactatgtctcctggtaccaacngcacccaggcaaacgtccccaaactcatgatttangaggtcaataagcgcctcgtcgggtccctgatcgcttctctggctccagtctggcaacgacggcctccctgaccgtctcgtcggctccgaggctgacgatcggaggctagtatttattactcgacagtctacattatgacncggccacccatatgtacgttcgggaacgtcgggacctacggtccaccgtcg

SEQ ID NO: 134446 - DNA, 694 bp, Homo sapiens
  misc_feature: GYAE6OF02IE1L2.9.57.F02.1.454.CMB.1.raw
  modified_base (174)..(174): a, c, t, g, unknown or other
  misc_feature (174)..(174): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
tcagtgatacgtctcacgaccggtgctcgatttagctcgatatagttgggtttgggggctcgtcgcttcagcctgtgggccacaagaggcagcactcgaggacaatctccagcatggcctggtctcctctcctcctcactctcctcgctcgactgcacgagggtcccgtggacntctcgtcngacgcncggccgtccagagtctcggtccggccgaggcaggtcgtccactctcctcgtgactcgcgaacgaacgcgtccgtaccggacgtccggactaccttaacttattagttacgtaactcgttagtacctaaacgtaacgttacctacgggaaccggacaccccgacccgacgtacccttccataccttacttacttaaccaacccttacccgtaccccgtcctacggggttacccggttccacggtaaccttctttcctcggcgttacccctcgtacgtttcgcgtaccctcctaccggcccttccccgtcggtccgtacccgtacgtcgggtccggtcctaacccggttgttcggacggtaggtacgtacggtacgtcgtaagtttaacgtttactacgtccgacgtcgtaccgtcgaaccttaccttccttacggtagttccggtttcgggttggtccggtcgggacggtacggactacgtcgtacccggttcgttaccgtcgaccg

SEQ ID NO: 134447 - DNA, 727 bp, Homo sapiens
  misc_feature: GYAE6OF02GFW3A.9.57.F02.1.454.CMB.1.raw
tcagtgatacgtctcacgaccggtgctcgatttagctcgatatagttgggtttgggggctctgcttcagctgtgggcacaagaggcagcactcaggacaatctccagcatggcctggtctcctctcctcctcactctcctcgctcactgcacagggtcctggggccagtctgtcctgacgcacgccggcctcagtactcgtcgggtccccagggcagagggtcaccatcctcctgcactgacgaacagcctccgacgtcgcgacctaccttatattgtacactggtatacaagttaccttccgagggacaccgccccagacctcctacattctacttactaacctacccgttacccgacccgtcggtacggggtttccctacggacccgtactttcctaccgtcgggtacccttacccgacgttccgtccgggtccctacccttcgaaccgttccccttaccccggttacgggtcccgttaccgtaaccggttccgggggccccttaccggacggtttccggttacgggacgggtacgttcgggacgggtcttagggtaactttacgttaaccgtcgtacccgtacgttcctaaccgtaccttacccgtttacgtcgttaacggtttccggttttcggggttacggtttccggggtacggggtaaccgggtaccgtaacggttccgtaccggtaccccggtttccgttaccggtaccgtaaccccgg

SEQ ID NO: 134448 - DNA, 762 bp, Homo sapiens
  misc_feature: GYAE6OF02HZ91A.9.57.F02.1.454.CMB.1.raw
tcagtgatacgtctcacgaccggtgctcgatttagctcgatatagttggggtttgggggctctgcttcagctgtgggcacaagaggcagcactcaggacaatctccgacgcatggcctggtctctctcctctcactctctcgctcactgcacagggtcctggggccagtctcgtcctaggaccgcacgcccggtcctcgatacgttccgtcgggtccccagggcaggtacggtacaccgtactccgtcctgcctaacgcgtaaccgaacacgcctaccggcgtccgacctaccttacctagttacgttcgtacctacgtacgtactaccgtaacgttcctacggacggtactaccgaccccgtagtcctcctacgtctacttacttacctaaccgtcccgttacccgtacccgttacggtcggggtttacctacgtaccggtacttccgtcgtcggtccttacccgtagtcccgtaccgtaccgacccgttacgtacccggtccccgttacccggtcgggtacccgtcgtacggttaccggtacccttaccgttacggttccgtaaggtacccggtattaccggggacgttaccggttacgtaagtttacctaaccggttcgtaacccgtagttacccggttaactaccgttaccgtttcggttacggtccggtttacgggtttttcgggaaccggttcgggaaccggttacgggacccgttaggtccgttaccgtcccgttacccttccggaccgtaccgg

SEQ ID NO: 134449 - DNA, 747 bp, Homo sapiens
  misc_feature: GYAE6OF02JX7EY.9.57.F02.1.454.CMB.1.raw
  modified_base (218)..(218): a, c, t, g, unknown or other
  misc_feature (218)..(218): n is a, c, g, or t
tcagtgatacgtctcacgaccggtgctcgatttagctcgatatagttgggtttgggggctctgcttcagctgtgggcacaagaggcagcactcaggacaatctccagcatggcctggtctcctctctcctcactctcctcgctcactgcacagggtcctggggccagtctgtcctgacgcacgccggctcagtactcgtcgggtccccgagggcaggnggtccaccatcctacctgcctacgtgaccgaacacgtccgtaccggacggtcgaccggtaccaaccgtttatacttcggtaacctacggttacggttactaccgtaaacgttaccttaccgaagggaccaccgtccccctaggtaccttccgtactacgttacttaacttacctaaacctacccttacccggtacccttacggtaccgggggttttcctacggaaccgttacgttcctaccggttaccggtccctaccggtagtttcccggtacggacccttacccgtacaccgttccccgtcccggttacgggtcccttacgaaccggtcggtaccgttaccgacggttcgtacgggacgttacgtaacgggtcggtacttagtacgttacgttacgcgtaccctagtaccctaacgtacgttacctttaccgtagttccgttgggtttacgggtcggttaccggggacggtaaccggtacgacggttccgtaccggttacccggttccgtacggacccgtaaccggg

SEQ ID NO: 134450 - DNA, 165 bp, Homo sapiens
  misc_feature: GYAE6OF01CNJ5E.16.71.G05.1.454.CMB.1.raw
  modified_base (155)..(165): a, c, t, g, unknown or other
  misc_feature (155)..(165): n is a, c, g, or t
tcagtgtactactccacgaccggtgctcgatttagtgtcgtcgcaagagagagggaccaagcgtggagatcaaacgaactgtggctgcaccatctgtcttcatcttcccgccatctgagagtagtacactgagcgggctggcaaaggcgcatagnnnnnnnnnnn

SEQ ID NO: 134451 - DNA, 596 bp, Homo sapiens
  misc_feature: GYAE6OF01CYO8I.16.71.G05.1.454.CMB.1.raw
  modified_base (591)..(596): a, c, t, g, unknown or other
  misc_feature (591)..(596): n is a, c, g, or t
tcagtgtactactccacgaccggtgctcgatttagtgtcgtcgcaagagagaggggtccctgagactctcctgtgcagcctctggattcacctttgacagctatgccatgacctgggtccgccaggctccagggaagggctggaatgggtctcaggtattactggtggtggttataccacatactacgcagactccgtgaagggccgttcaccatctccagagacaattccaaagaacacactgtatctgacaaaatgaacagcctgagagccgacgacacggccataatattactgtgacgaaagccaccggctagttagccaacccatactactttgactacgtgggccaagggaacccctggtccaccgtcctcctcacgccctaccaaccgaaacgggcccctaatccggttcccttcccccgtcggcccctacccctccctacccaacgacgccacccgtcgtcggggccacgacggcccggcccgtcgggcctcggcccgttcgggtaccgaacggtaccttaccgttcccggagtaacgtaccacgtggacggccgggcgtggacgaacgggccgcgagtacgnnnnnn

SEQ ID NO: 134452 - DNA, 538 bp, Homo sapiens
  misc_feature: GYAE6OF01BSP0H.16.71.G05.1.454.CMB.1.raw
  modified_base (200)..(200): a, c, t, g, unknown or other
  misc_feature (200)..(200): n is a, c, g, or t
  modified_base (376)..(376): a, c, t, g, unknown or other
  misc_feature (376)..(376): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccaggcaccctgtctttgctccgaggggaaanagcccaccctctcctgcagggccagtcagagtgttaccagcaggtactagcctggtaccagcagaacctggcctggctcccaggcctcctcatctagtgtgcatccagcagggccagtggacatcccagacaggttcagtggcaggtggtctgggacagacttcactctcaccctnagcagacgtggacgtcctagaagtagtttgactagtgtaattactgtacagtctagtagtggtaggtctacttacgtacgtttcggaccgtagggtaccgaagtcgtaggtagacgtacgaaacgtacgtggtacgacgtcgaccactagtctgtcgttacg

SEQ ID NO: 134453 - DNA, 512 bp, Homo sapiens
  misc_feature: GYAE6OF01A5W5N.16.71.G05.1.454.CMB.1.raw
  modified_base (367)..(367): a, c, t, g, unknown or other
  misc_feature (367)..(367): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaacctggcctggctcccaggctcctcatctatggtgcatccagcagggccactggcatcccagacaggttcagtggcaggtggtctgggacagcttcactcncacctcagcagactggacgctagaagtatttgctagtgtattactgtcagtcagtagtggtagggtctaccttacgtacgtttggaccgtacggggaccaggcgtaggagtagtacgaagacgtgtacgcgtgcacatctgtctc

SEQ ID NO: 134454 - DNA, 544 bp, Homo sapiens
  misc_feature: GYAE6OF01ARVSS.16.71.G05.1.454.CMB.1.raw
  modified_base (201)..(201): a, c, t, g, unknown or other
  misc_feature (201)..(201): n is a, c, g, or t
  modified_base (377)..(377): a, c, t, g, unknown or other
  misc_feature (377)..(377): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagcccaccctctcctgcagggccagtcagagtgttaccagcaggtacttagcctggtaccagcagaacctggcctggctccaggctcctcatctatggtgcatccagcagggccacgtggcatcccagacaggttcagtggcaggtggtctgggacagacttcactctccaccctnacgcagactggacgcctagaagtatttgactagtgttattactgtcagcagtagtggtaggcctaccgttactacgtttcggaccgtagggacctaaggtcgtagggaacgtacgtaccgaaacggtacgtggtacggctacgaccaccgtattcgtgttccttacg

SEQ ID NO: 134455 - DNA, 558 bp, Homo sapiens
  misc_feature: GYAE6OF01EQYF0.16.71.G05.1.454.CMB.1.raw
  modified_base (199)..(199): a, c, t, g, unknown or other
  misc_feature (199)..(199): n is a, c, g, or t
  modified_base (367)..(367): a, c, t, g, unknown or other
  misc_feature (367)..(367): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgcctcaggggaanagccaccctctcctgcagggccagtcagagtgttaccagcaggtacttagcctggtaccagcaagaaacctggcctggctcccaggctcctcatctatggtgcatccagcagggccactgacatcccagacaggttcagtgcaggtggtctgggacagacttcactcncacctcagcagactggagtccgtagaacgtagttttgctagtgttattacgtgtcagcgtagtagtaggtacgggtacctaccgttacgtacgttttcgggaccgtaggggaccctaaaggtcgtagggaagtaacgtaacgaaacgtaacgtggtacggtcgtacggacctacctatcttgtccttaccg

SEQ ID NO: 134456 - DNA, 520 bp, Homo sapiens
  misc_feature: GYAE6OF01B99YT.16.71.G05.1.454.CMB.1.raw
  modified_base (200)..(200): a, c, t, g, unknown or other
  misc_feature (200)..(200): n is a, c, g, or t
  modified_base (300)..(300): a, c, t, g, unknown or other
  misc_feature (300)..(300): n is a, c, g, or t
  modified_base (376)..(376): a, c, t, g, unknown or other
  misc_feature (376)..(376): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccaggcaccctgtctttgtctccaggggaaanagccaccctctcctgcagggccagtcagagtgttaccagcaggtacttagcctggtaccagcagaacctggcctggctcccaggctcctcatctatggtncatccagcagggccactggcatcccagacaggttcagtggcaggtggtctgggacagtacttcactcgtcaccctnacgcagactggagcctagaagtatttgctagtgttattactgtcgagcagtagtggtacggtctaccgttacgtacgttttggaccgagggacctaggcgtaggagacgtacaaacgactggtgcgtcgacactatctgtctac

SEQ ID NO: 134457 - DNA, 515 bp, Homo sapiens
  misc_feature: GYAE6OF01DMTPM.16.71.G05.1.454.CMB.1.raw
  modified_base (200)..(200): a, c, t, g, unknown or other
  misc_feature (200)..(200): n is a, c, g, or t
  modified_base (299)..(299): a, c, t, g, unknown or other
  misc_feature (299)..(299): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccaggcaccctgtctttgtctccaggggaaangccacctctcctgcagggccagtcagagtgttaccagcaggtacttagcctggtaccagcagaaacctggcctggctcccaggctcctcatctatggtncatccagcagggccactggcatcccagacaggttcagtggcagtgggtctgggacagactttcactctcaccctcagcagactggagcctgaagtatttgcagtgtattactgtcagcagtagtggtagggctaccttacacttttcggccgtaggggaccaagcgtaggagagtacgaaagtaactggttggctcgcaaccgatcttgtctttac

SEQ ID NO: 134458 - DNA, 505 bp, Homo sapiens
  misc_feature: GYAE6OF01ADUVZ.16.71.G05.1.454.CMB.1.raw
  modified_base (202)..(202): a, c, t, g, unknown or other
  misc_feature (202)..(202): n is a, c, g, or t
  modified_base (373)..(373): a, c, t, g, unknown or other
  misc_feature (373)..(373): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgttaccagcaggtacttagcctggtaccagcagaacctggcctggctcccaggctcctcatctatggtgcatccagcagggccactggcatcccagacaggttcagtgcagtggtctgggacagacttcactctcaccctnagcagactggacgcctgaagtatttgctagtgtattactgtcagcagtagtggtacggctaccgttactacgttttggaccgtagggaccagcgtaggagagtacgaacgactgtgctgcacatctgtcttc

SEQ ID NO: 134459 - DNA, 514 bp, Homo sapiens
  misc_feature: GYAE6OF01EQGLA.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaaacctggcctggctcccaggctcctcatctatggtgcatccagcagggccactggcatcccagacaggttcagtggcaggtggtctgggacagacttcactctcaccctcagcagactggacgcctgaagtattttgctagtgtattactgtcagcagtagtggtagggctaccttactacgtttggccgtacggggaccaagtcgtggagtagtacgaaagaacgtgtggctcgacacatctgtcttc

SEQ ID NO: 134460 - DNA, 517 bp, Homo sapiens
  misc_feature: GYAE6OF01ASHJ0.16.71.G05.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
  modified_base (374)..(374): a, c, t, g, unknown or other
  misc_feature (374)..(374): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaacctggcctggctcccaggctcctcatctatggtncatccagcagggccactggcatcccagacaggttcagtggcaggtggtctgggacagacttcactctcaccctnagcagactggagccgtagaagtatttgcgtagtgtattacgtgtcagtcagtagtggtaggtctaccttactacgtttcgaccgtagggaccgagcgtggagagtacgaagaacgtgtaggctacgtacactatctgtcttac

SEQ ID NO: 134461 - DNA, 512 bp, Homo sapiens
  misc_feature: GYAE6OF01ECX1H.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgttaccagcaggtacttagcctggtaccagcagaaacctggcctggctcccaggctcctcatctatggtgcatccagcagggccactgacatcccagacaggttcagtggcagtggtctgggacagacttcactctcaccctcagcagactggagcctagaagtatttgctagtgttattactgtcagctagtagtggtaggtctaccttactacgtttggaccgtacgggaccaagcgtggagagtacgaaacgactggtggctgcacatctgtcttac

SEQ ID NO: 134462 - DNA, 682 bp, Homo sapiens
  misc_feature: GYAE6OF01E31U0.16.71.G05.1.454.CMB.1.raw
  modified_base (231)..(231): a, c, t, g, unknown or other
  misc_feature (231)..(231): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcggtcgtcgtttctaggtcggctaatttaaaggtgtcagtgtgagtgcagctgttggagtcgtggggagcttggcacngccgtgggggtccctgagctctcctgtgcagcctgtggacttccacctttgacagtctatcgccagtcgaccgttcgggtcccgcccgaggccgtaccggaggggaacggggcgtagggtaacgtggggttcctacggtaaggttagtttacgtggggttcggttaggtttaactaacccacgtaactttaaccgaccgacgacgtaccgttccgggtacgggtaaccgggtcccggttaccgacctaactcccgttacccaaggaacgtaacctaaaccgttacccaaagtaaaccaacgtaaccttggtaacttacgtacgaaccaaagttaacgaaccgacgtaccgtaggacgacgacccgaaccgaccggaccgaccaaattacgtaacttacgtagtcggaaccgaaacgtcccgacggacgtaagttcgtacccaaccgttaac

SEQ ID NO: 134463 - DNA, 528 bp, Homo sapiens
  misc_feature: GYAE6OF01CP2G7.16.71.G05.1.454.CMB.1.raw
  modified_base (301)..(301): a, c, t, g, unknown or other
  misc_feature (301)..(301): n is a, c, g, or t
  modified_base (378)..(378): a, c, t, g, unknown or other
  misc_feature (378)..(378): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaacctggcctggctcccaggctcctcatctatggtncatccagcagggccactggcatcccagacaggttcagtggcaggtgggtctgggacagtacttcactctccaccctnagcagactggagcctagaagtatttgctagtgttattacgtgtcagtctagtagtgggtaggtctaccttacgtacgttttggaccgtagggaccaagtcgtaggagacgtacgaaacgtaacgtggtacggtctcgcacatctgtcttc

SEQ ID NO: 134464 - DNA, 808 bp, Homo sapiens
  misc_feature: GYAE6OF01CX9GB.16.71.G05.1.454.CMB.1.raw
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccaggcaccctgtctttgtctccgaggggaaanagccaccctctcctgcagggccagtcagagtgttaccagcaggtacttagcctggtaccagcagaacctggcctggctcccgaggcctcctcatctatggtcncactccagcgacgggccacgtcggaccactacccgaaggtacctagggtttaccgaaggttcgggaccgtaaggggttcggggttccgtagggggtaacctacgggtaacccttttccgaacccgtttccccgttacccgtaacccccttacgtaacgggacccgtaacgggtaccgttacggggtaaccgtaccccggttaaggttaaacggtttacgtttttacggaccgttaacgggtttaggttaacctttaccggttacgtttacgtaacgttccggttaagggtttaacggtttacgggggttaacgggtacccgtttaacccgttttaacggttacccggttttttacggggacccggtaacgggggtaaccctaagggttaccggttacgggtaaacgtaaccggtaaccggtaaaaccgggttacggttcgggttaccggtaccgtacggtaaccctaacccgtacgtttaccggttcgtttccccgtttaaccg

SEQ ID NO: 134465 - DNA, 569 bp, Homo sapiens
  misc_feature: GYAE6OF01DNPYV.16.71.G05.1.454.CMB.1.raw
  modified_base (200)..(200): a, c, t, g, unknown or other
  misc_feature (200)..(200): n is a, c, g, or t
  modified_base (299)..(299): a, c, t, g, unknown or other
  misc_feature (299)..(299): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaattgtgttgacgcagtctccaggcaccctgtctttgtctccgaggggaaangccaccctctcctgcagggccagtcagagtgttaccagcaggtacttagcctggtaccagcagaacctggcctggctccgaggctcctcatctatggtncatccagcaggccactggcatcccagacaggttcagtggcaggtggtctgggacagtacttcactctcacctcagcagacgtgacgtcctagaagtatttgctagttgtattacgtgtcagtctagtagtagggtacggtctaccgtttaacgtacgttttacgggaccgtacggggtaacctaaggtacgtagggaacgtacgtaaccgaaacggtaaacgtcggtacggaccgtacggtaccaaccgtattccgttcgttcttacccg

SEQ ID NO: 134466 - DNA, 591 bp, Homo sapiens
  misc_feature: GYAE6OF01CM79B.16.71.G05.1.454.CMB.1.raw
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaagagccaccctctcctgcagggccagtcagagtgttaccagcaggtacttagcctggtaccagcagaacctggcctggctcccgaggcctcctcatctatggtncnctccagcgacgggccacgtggccactcccgagacgaggttcaggtcggctaggtcgggtctagggaacaggtaccttcgacttctacccaccctcgacgcgacgtacgtacggacgccgtagtaagtagtttagcgtagtgttattacgtgtacagacgtagtagtggtaggtcgtaccgttacgttacgtttacggaccggtacgggtacctaaggtcgtaggagtacgtaacgtaaacggtacgttcggtacggtacgtacgtaccactattcttgttcttaccg

SEQ ID NO: 134467 - DNA, 588 bp, Homo sapiens
  misc_feature: GYAE6OF01BEZKS.16.71.G05.1.454.CMB.1.raw
  modified_base (203)..(203): a, c, t, g, unknown or other
  misc_feature (203)..(203): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccaccctctcctgcagggccagtcagagtgttaccagcaggtacttagcctggtaccagcaagaaacctggcctggcctcccaggcctcctcatctagtggtcgctatccagcgacgggccacgtcggcactcccgagacaggttcagtggcaggtggtcgnggacagtacttcactcnccacctcacgcagtacgtgacgtctagaagttagtttcgacgtagttagttacttacgtcgtacagtacgtagttaggtagggtacggtacctaccgtttacgttaccggttttcggaccggtaacggggaccgtaaggtcgtaggtaacgtaagtacgtaaacgtagtcggtacgcttacgcaccgtatccgttgtcgttaccg

SEQ ID NO: 134468 - DNA, 523 bp, Homo sapiens
  misc_feature: GYAE6OF01EIJ7Q.16.71.G05.1.454.CMB.1.raw
  modified_base (201)..(201): a, c, t, g, unknown or other
  misc_feature (201)..(201): n is a, c, g, or t
  modified_base (507)..(507): a, c, t, g, unknown or other
  misc_feature (507)..(507): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccacggagaaattgtgttgacgcagtctccaggcaccctgtctttgtctccaggggaaagngccaccctctcctgcagggccagtcagagtgttaccagcaggtacttagcctggtaccagcagaaacctggcctggctccaggctcctcatctatggtgcatccagcagggccactggcatcccagacaggttcagtggcagtggtctgggacaggacttcactctccaccctcacgcagaccgtggacgtccgtagaagtattttgctagttgtattactgtcgagtacgtagtagtagggtacggctaccgttactacgttttggccgtagggaccagcgtggagacgtacaacgactggcggntcgcacatctgtcttc

SEQ ID NO: 134469 - DNA, 557 bp, Homo sapiens
  misc_feature: GYAE6OF01DBCA6.16.71.G05.1.454.CMB.1.raw
  modified_base (199)..(199): a, c, t, g, unknown or other
  misc_feature (199)..(199): n is a, c, g, or t
  modified_base (400)..(400): a, c, t, g, unknown or other
  misc_feature (400)..(400): n is a, c, g, or t
  modified_base (437)..(437): a, c, t, g, unknown or other
  misc_feature (437)..(437): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccaggcaccctgtcttgtctccgagggaaangccacctctcctgcagggccagtcagagtgttaccagcaggtacttagcctggtaccagcagaaacctggcctggctcccaggcctcctcatctatggtgcatccagcgagggccacgtggctatcccagacgtaggttcaggtcggcaggtgggtcgtgggacaggtacttcacgtcctcaccctcacgcagactggacncctaggaagtatttgacgtagttgttatacgtgtacngctagtagtggtacggtcctaacgttactacgtttcggaccgtaaggggacctaaggtcgtaggagacgtaccgaaagtacgttggtacgtctacgacctacctagtccgttgtcttacg

SEQ ID NO: 134470 - DNA, 570 bp, Homo sapiens
  misc_feature: GYAE6OF01BTKMO.16.71.G05.1.454.CMB.1.raw
  modified_base (202)..(202): a, c, t, g, unknown or other
  misc_feature (202)..(202): n is a, c, g, or t
  modified_base (380)..(380): a, c, t, g, unknown or other
  misc_feature (380)..(380): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagagtgttaccagcaggtacttagcctggtaccagcagaacctggcctggctcccaggctcctcatctatggtgcatccagcagggccacgtggcatcccagacaggttcaggtggcaggtgggtctgggacagtacttcactctccaccctnacgcagactggacgcgtagtaagtatttagctagttgttattacgtgtacagtactagtagtgggtacgggtacctaccgttacgttacgttttcgggaccgtacggggaaccaaggtcgtaggaacgtacgtaacgtaaacgtaacgtggtacggtcgtcgtaccacctaagttccttcgttcttaccg

SEQ ID NO: 134471 - DNA, 563 bp, Homo sapiens
  misc_feature: GYAE6OF01BMZEW.16.71.G05.1.454.CMB.1.raw
  modified_base (202)..(202): a, c, t, g, unknown or other
  misc_feature (202)..(202): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagagtgttaccagcaggtacttagcctggtaccagcagaacctggcctggctccaggctcctcatctatggtgcatccagcagggccacgtgacatcccagacctaggttcagtggacaggtgggtctgggacagacttcactcnccaccctnagcagctggagcctagtaagtatttgctagtagttattactgtacagtactagttagtagggtaggtacctaccgtttactacgttttcgggaccgtacggggacctaacggcgttcgggaagtacgtaccgaaacggtacgttcggtaggtcctacggaccaccgtatcttcgttcttaccg

SEQ ID NO: 134472 - DNA, 513 bp, Homo sapiens
  misc_feature: GYAE6OF01CTUDQ.16.71.G05.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
  modified_base (374)..(374): a, c, t, g, unknown or other
  misc_feature (374)..(374): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaaacctggcctggctcccaggctcctcatctatggtncatccagcagggccatggcatcccagacaggttcagtggcagtgggtctgggacagacttcactctcaccctnagcagactggagcctagaagtattttgctagtgtattactgtcagcagttagtggtaggctaccgttactacgttttggaccgtaggggaccaagcgtaggtagagtacaaacgactggtggctgcacatctgtcttac

SEQ ID NO: 134473 - DNA, 668 bp, Homo sapiens
  misc_feature: GYAE6OF01DI4Q0.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagagtgttaccagcaggtactagcctggtaccagcagaaacctggcctggcctccaggctcctcatctatggtgcactccagcgacgggccacgtggcactcccgagacgtaggttcaggtggacgaggttgggtcgtggggaacacggtacttccgaccttcgtaccaccccgttacgaacggtaccgaacggtaccgttaggggaccgtacccgttaaggtaaacggttacgtttttcgggaccgttaagggtttacggtttaaacgtttaccgtggttaccaaggttaccggtaagtttaggtacgggtacgggtacccttaccgtttaacgttaccgttttcggaccggtacggggtaaccaaggtcgtacgggtagtacgtaacgaaacggtacgttgggacgtcgtacgactaacctagttcgtcgttcttaccg

SEQ ID NO: 134474 - DNA, 521 bp, Homo sapiens
  misc_feature: GYAE6OF01B92OH.16.71.G05.1.454.CMB.1.raw
  modified_base (201)..(201): a, c, t, g, unknown or other
  misc_feature (201)..(201): n is a, c, g, or t
  modified_base (504)..(504): a, c, t, g, unknown or other
  misc_feature (504)..(504): n is a, c, g, or t
  modified_base (516)..(516): a, c, t, g, unknown or other
  misc_feature (516)..(516): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctcgaggggaaanagccaccctctcctgcagggccagtcagagtgttaccagcaggtacttagcctggtaccagcagaaacctggcctggctcccaggctcctcatctatggtgcatccagcagggccactggcatcccagacaggttcagtggcaggtgggtctgggacagacttcactctcaccctcagcagactggacgcctagaagtattttgctagttgtaattacgtgtcagctagtagtggtacggctaccttacgtacgtttggaccgagggaccaggcgtaggagacgtacgaacgtacgtggtcgntcgcacatcgtntctac

SEQ ID NO: 134475 - DNA, 599 bp, Homo sapiens
  misc_feature: GYAE6OF01A98CI.16.71.G05.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctcaggggaaangccacctctcctgcagggccagtcagagtgttaccagcaggtacttagcctggtaccagcagaacctggcctggctccaggcctcctcatctatggtncatccagcagggccatgacatcccagacaggttcagtggcaggtcgggtctagggacacgtacttcgaccttctaccacccttcgacgcacgtacgtcgggacgacgttaggtaagttatttcgactacggttacgttattacgttcgtacgtacgtacgtaaggttagtacgggtacgggtacctaccgtttaacgtacgttttacgggacccgtacggggtaccaaggtcgtaggaacgtacgtacgaacgtaacgtcggtacggcgtacgtacctacgtactcgttcgttcgttaccg

SEQ ID NO: 134476 - DNA, 525 bp, Homo sapiens
  misc_feature: GYAE6OF01C4P68.16.71.G05.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaaacctggcctggctcccaggctcctcatctatggtncatccagcagggccatgacatcccagacaggttcagtggcagtgggtctgggacagacttcactctcaccctcagcagactggagcctgaagtattttgcagtgtattactgtcagctagtagtggtagggctaccgttactacgttttcggccgagggacctaaggcgtaggagaagtacaaacgtaactggtacggtctcgaccacctatcgtgtcttacc

SEQ ID NO: 134477 - DNA, 624 bp, Homo sapiens
  misc_feature: GYAE6OF01CGRWA.16.71.G05.1.454.CMB.1.raw
  modified_base (195)..(195): a, c, t, g, unknown or other
  misc_feature (195)..(195): n is a, c, g, or t
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (368)..(368): a, c, t, g, unknown or other
  misc_feature (368)..(368): n is a, c, g, or t
tcagtgtactactccacgaccggtgctcgatttagtgtcgtcgcaagagagagggggagagctgctcagttaggacccagagggaaccatggaaacccagcgcagcttctcttcctcctgctactctggctccagataccacggagaaattgtgttgacgcagtctcaggcacctgtctttgctcgaggggaaangccacctctcctgcagggccagtcagagtgtacagcaggtactagcctggtacngcagaactgctggctccagctctcatctatggtncactccagcgagggccactgacactcccagacaggttcagtcggacaggtggtctagggactaggtacttcactctaccaccctnacgcgacgtacgtcggacgtcctagaacgttatttagacgtagttagttaacttacgtgtacaacggtctaaggttagttacgggtaacgggtaccttaaacccgtttacgttaccggtttttcgggaacccggtacggggtaacccgtaaaggtccgtaagggtaagtaaacgttaaaccggaaaacggttaacgttcgggtacggtaccgttacggaccgtaaaccctacgtttccttaggttcctttaacccg

SEQ ID NO: 134478 - DNA, 578 bp, Homo sapiens
  misc_feature: GYAE6OF01DY9RI.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtcgtgggggaggcttggcacagcctggggggtccctgagactctcctgtgcagcctctggattcacctttgacagctatgccatgacctgggtccgcaggctccgagggaagggctggaagtgggtctcgaggtattacgtggtggttggttataaccactatactacgcaagactcgtgaacgggtccgttcaacctatctacccagaacgactaacttccaagaaccacactgtatctgacaaatgaaacagtcctagagtacgaccgacgaaccgaaccggaccaataacgttaacttaaccgtggttacggaccgtaaaacggcccgaaaccggactaggtttaacgtccaaccccttaaacg

SEQ ID NO: 134479 - DNA, 559 bp, Homo sapiens
  misc_feature: GYAE6OF01DQJ5H.16.71.G05.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaaacctggcctggctcccaggcctcctcatctatggtncatccagcagggccactggcactcccagacaggttcaggtggcaggtggtctgggacagacttcactctcaccctnagcagacgtggacgcctagtaagtagtttgactagtgttacttacgtgtcagtctagtagtgggtacgggtacctaccgtttactacgttttcggaccgtacggggaaccaaggtcgtaggagtacgtaccgtaaacgtacgttggtacggtctacgaccacctattcgtgttccttaccg

SEQ ID NO: 134480 - DNA, 631 bp, Homo sapiens
  misc_feature: GYAE6OF01AIUV5.16.71.G05.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctcccagataccaccggagaaattgtgttgacgcagtctccaggcaccctgtctttgtctccgaggggaaangccaccctctcctgcagggccagtcagagtgtaccagcaggtacttagcctggtaccagcaagaacctggcctggctccgagctcctcatctatggtncatccagcgacgggccacgtggcatcccagactagggttcaggtcggcagggtcgggtactggggacaggtacttccgacttcctaccacccgttcacgtcacgacgtcggacgccgttaggtaacgttattttcggactaggttacgttaactttacgtacggttacacggtactaggttacgttgggtacgggtaccttaaccgtttacgttaccggttttcgggacccgtaacggggtaacctaaggcgttacgggaagtacgtaaccgtaaaacggtacgttggtacgggactacgaccgtaccgtagttccgttgttccttaccg

SEQ ID NO: 134481 - DNA, 640 bp, Homo sapiens
  misc_feature: GYAE6OF01EQPTG.16.71.G05.1.454.CMB.1.raw
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (315)..(315): a, c, t, g, unknown or other
  misc_feature (315)..(315): n is a, c, g, or t
  modified_base (526)..(526): a, c, t, g, unknown or other
  misc_feature (526)..(526): n is a, c, g, or t
  modified_base (582)..(582): a, c, t, g, unknown or other
  misc_feature (582)..(582): n is a, c, g, or t
  modified_base (605)..(605): a, c, t, g, unknown or other
  misc_feature (605)..(605): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcggtcgtcgttttctaggtcggctaattttaaaggtgtccagtgtgaggtgcagctgttgagtgtggggagctggcacagccgtgggggtccctgacgactcctcctgtncngcctctggattcacctttgacagctatcgccatcgaccgttcgggtcccnccgaggcctccggaaggggaacggggtctaggggaagttcgggtcctaggtaggttaactttacggtggggttcggtggtttaactacccgtaacgtataaccgttacgccgaacggtaccgttcccggtaggtaacgggtcccgttacaaccctattccgacccaagacgtaacaaccttcaaacggtaaccacgtacttacgtattccngaacctaataggaacccaggtccctaggacgacgtccgaagaccacggccaagttntacttaacgtgtacgcgaaaccnccgtaacggtactacggttacgtcccaaccgtaac

SEQ ID NO: 134482 - DNA, 587 bp, Homo sapiens
  misc_feature: GYAE6OF01DFDYZ.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagagtgttaccagcaggtacttagcctggtaccagcagaaacctggcctggctcccaggcctcctcatctatggtgcatccagcgagggccacgtggcactccccagactaggttcagtggctagggtcgggtcgtgggacaggtacttcactctccaccctcgagcagacgtcggacgtccgtagtaagtagtttgctagttgttacttactgtctagtctagtagttggtacgggtcctaaccgttacgttacgttttcggaccggtacggggacctaaggcgtagggaacgtaacgtaaccgaaacgtaacgttcggtacggtcgtacgaccaacgtacttcgttcgttctttaccg

SEQ ID NO: 134483 - DNA, 527 bp, Homo sapiens
  misc_feature: GYAE6OF01BHSF5.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaacctggcctggctcccaggctcctcatctatggtgcatccagcagggccacgtggcatcccagacaggttcagtggcaggtggtctgggacagacttcactctcaccctcagcagactggacgccgtagaagtattttgacgtagtagttattactgtcgagtctagtagtaggtacgggctaccttacgtacgttttcggaccgtacgggaccgagtcgtaggagtacgtacgaacgacgtgtacgctgcacatctgtctc

SEQ ID NO: 134484 - DNA, 577 bp, Homo sapiens
  misc_feature: GYAE6OF01DQHCQ.16.71.G05.1.454.CMB.1.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangcccaccctctcctgcagggccagtcagagtgttaccagcaggtacttagcctggtaccagcagaaacctggcctggcctccaggctcctnatctatggtgcatccagcagggccacgtgcatcccagacaggttcagtggcaggtggtctgggacagtacttcacctctaccaccctcgacgcagactggacgtccgtagaagtatttgctagtgttattactgtacagtcgagttagtgggtacggtacctaccgtttactaccgttttcgggacccggtacggggtaaccaacggtcgtaggtagtaacgtaacgaaaccggtaacgttaggtcgggacgtacggaccctacgtacttcctgttcttaaccg

SEQ ID NO: 134485 - DNA, 595 bp, Homo sapiens
  misc_feature: GYAE6OF01AZSFG.16.71.G05.1.454.CMB.1.raw
  modified_base (203)..(203): a, c, t, g, unknown or other
  misc_feature (203)..(203): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccaccctctcctgcagggccagtcagagtgtaccagcaggtacttagcctggtaccagcagaaacctggcctggctcccaggcctcctcatctatggtgcatccagcagggccacgtggcactcccagacaggttcagtgcaggtggtctgggacagacttcactctccaccctcagcagacgtggacgcctagaagttactttagcttagtgttaacttacgtgtactagtacgtagttagttaggggtacggtacctaaccgtttacgttacgtttttacgggtacgtaacggggtaaccctaaggtaccgtagggtaagtacgtaaccgaaacggtacggttcggtacggtacgtacgaccgtacctattccgttaggtcctttaccg

SEQ ID NO: 134486 - DNA, 559 bp, Homo sapiens
  misc_feature: GYAE6OF01D2BET.16.71.G05.1.454.CMB.1.raw
  modified_base (201)..(201): a, c, t, g, unknown or other
  misc_feature (201)..(201): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaacctggcctggctcccaggctcctcatctatggtgcatccagcagggccactgcatcccagacaggttcaggtggctaggtggtctgggacagacttcactcncaccctnacgcacgactggacgtccgtagaacgtagtttcgactagtgttattactgtcagtcgtagtagtagggtaggctaccgttacgttacgttttacgggaccgtacggggtaaccgaaggtcgtaggaagtacgtaccgaaacgtacgttcggtacggacgtcgtaccacctatcttgttcttacg

SEQ ID NO: 134487 - DNA, 678 bp, Homo sapiens
  misc_feature: GYAE6OF01EU985.16.71.G05.1.454.CMB.1.raw
  modified_base (234)..(234): a, c, t, g, unknown or other
  misc_feature (234)..(234): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccagcacctgtcttgtctcgaggggaagcgccacctctcctgcagggccagtcagagtcgtaccngcaggtacttagctggtaccagcaacgaacctggcctggcctccgaggcctcctcatctagtggtgcacgtccagccgacgggccacgtcggcactaccccgaagacgtacgggttcaaggtcggacgtagggtcggggtcgtacggggaactaacgtactttaccaccgttcctacccgtaccctcgaacgaccgacgtaccgtacgggacgtaccgtaggtaaacgttacgttttacggacgttaggtttacgtttaactttaccgttacggttacgaggtacgtaggttaggttacgggttaacgggtaccttaaccgtttaaccgttacggttttccgggaaccggtacggggtaacctaaggtcggtagggaacgtacgtaaccgtaaacggtacggtcggtacggtacgtacgacctactagttcgttgttcttaccg

SEQ ID NO: 134488 - DNA, 811 bp, Homo sapiens
  misc_feature: GYAE6OF01B6H6X.16.71.G05.1.454.CMB.1.raw
  modified_base (237)..(237): a, c, t, g, unknown or other
  misc_feature (237)..(237): n is a, c, g, or t
  modified_base (335)..(335): a, c, t, g, unknown or other
  misc_feature (335)..(335): n is a, c, g, or t
tcagtgtactactccacgaccggtgctcgatttagtgtcgtcgcaagagagagggggagagctgctcagttaggacccagagggaaccatggaaaccccagcgcagtcttctcttcctcctactactctggctcccagataccaccggagaaattgtgttgacgcagtctccaggcaccctgtctttgtcctccgaaggggaaagacgcccaccctctcctgcgagggccagtcagngtacgttaccagcaggtacttagccgtggtaccagacaacgaaaccgtcggccgtggcctcccgacggtcctccctactacttccgtagtcgggttcnccaactcccaaggccgaacgggcctaactcgggaccaacgtccccgaagaccgtacgggttacaggttcggccgaaggggtttcggggtacgtaggggaacacggttacctttaccgaccgtttccctaccaaccccgttacaacggtccgtaacgtaaccgtagggaccgtaccgttaaggtaaacgttatttttacggacttaaggtttacgtttaacgttaccttacgggtacctaaggttaccggttaaggttaacgggttacggggttaaccggtacccgtttaaccctttttaaacccgggttacgtttttacccgggggaacccggttaacccgggggtaacctaaaggtcccgggttaaagggaaccggttaaaccgtaaacccggtaaaacggtaaccggttcggtaccggtccgtaacggtacccgtaactacggttacctttccgttaccgtttcgtaaccccgg

SEQ ID NO: 134489 - DNA, 742 bp, Homo sapiens
  misc_feature: GYAE6OF01EPE7P.16.71.G05.1.454.CMB.1.raw
  modified_base (197)..(197): a, c, t, g, unknown or other
  misc_feature (197)..(197): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaattgtgttgacgcagtctccaggcaccctgtctttgctcgagggaancgccaccctctcctgcagggccagtcagagtgttaccagcaggtacttagcctggtaccagcagaaacctggcctggctccgaggctcctcatctatggtgcatccgagcgacgggccagtcggacactcccgagaccgtaggttccaggtcggtcagggttcgggtcgtcggggaactaggtacctttccgaaccttccgtaccctacccctacgacggaccgtaacggtaccgttagggaccgtaccgttaggtaaacggtttacgtttttacggaccgttaaggtttacgtttaacgtttacgtacgttaccgtacggtacgttaagggttaacggttacggggtaacgggtaccctttaaacccgttttaaccggtttaaccggtttttacggggacccggtaaaccggggggtaaccctaagggttaccggttacggggtaaacgtaacggttaaacccgtaaaaccggtaccggttagggtaccgggtacgtaccggtaacctaacccgttaacttccgtttacgttccgtttaacccg

SEQ ID NO: 134490 - DNA, 844 bp, Homo sapiens
  misc_feature: GYAE6OF01DDSBX.16.71.G05.1.454.CMB.1.raw
tcagtgtactactccacgaccggtgctcgatttagtgtcgtcgcaagagagagggggagagctgctcagttaggacccagagggaaccatcggaaacccagcgcagcttctcttcctcctgctactctggcctccagataccaccggagaaattgtgttgacgcagtctcgaggcaccctgtctttgtctcgaaggggaaagcgcccaccctctccgtgcgacggccagtcagagtgtacagcgtaggtactagcctaggtaccagacaagaaccgtggcctcggacctcccgaggtcctcctactacttcgtagtggtacgacctacgttccgacggccggacgggccctaacggtcggaccaaccgtaccccgaaggtaaccgtagggtttaccgaagggttccggacgttacgggggtcgggttaccggtaggggaaacctacggttacccgtttacccaaccctttcccggttaacccccaaacccgttccggaaacgggtaccgtaaccgggttaccggtacggggtaacccgttaacccggtttaaggttaaacgttttacggtttttacggaaccgttaacgggttttaacgtttaaacgttttaaccggtggtttaaccgaacggttacgttaaacgggttacgggtttacggggttaacccgggtaaccctttaaccggttttaacccgtttacgggttttaacccggggacggggtaaaccggtaacccggtaaggtccggttaaggaacggtaaaccgtaaccggtaaaggttacgtcgggtacggtaccgttacgtacccgtacgttacttaccggttcgtccctttaaccg

SEQ ID NO: 134491 - DNA, 581 bp, Homo sapiens
  misc_feature: GYAE6OF01DAMF3.16.71.G05.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccaggcaccctgtctttgctccgaaggggaaanagccaccctctcctgcagggccagtcagagtgttaccagcaggtactagcctggtaccagcagaaacctggcctggctcccaggctcctcatctatggtncatccagcagggccactggcatcccagacaggttcagtgcaggtggtctgggacagacttcactctcgaccctcagccagactgggacgacctaggaaacgtattttgactagttgttaattactgtacagtctagtagtgggtaggcctaacctttactacgttttggacccggtaggggaacccaaggtcgtacgggaagaacgttaccgaaaacgtaaccgttgggtcggtaccgttacggaccctaaccctagttccgtttacggtcctttacccg

SEQ ID NO: 134492 - DNA, 543 bp, Homo sapiens
  misc_feature: GYAE6OF01BTTI1.16.71.G05.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
tcagtgtactactccacgaccggtgctcgatttagtgtcgtcgcaagagagagggggagagcgtgctcagttaggacccagagggaaccatggaaaccccagcgcagcttctcttcctcctgctactctggcctcccagataccaccggagaaattgtgttgacgcagtctccaggccacctgtctttgctcgaggggaaangccacctctcctgcagggccagtcagatgttaccagcaggtacttagcctggtaccagcagaacctggcctggcctcccaggcctcctcatctagtggtcnccatccagcagggtccacgtggccactcccagactaggttcaggtggctaggtcggtctgggacagtacttcactcncaccctnagcagctggacgctagaagtatttgacgtagtgttattactgtcagtctagtagtggtacggtactaccgttacgtacgttttcggccgtacgggtaccgaggtcgtaggagtacgtacgaacgtacgtgacgcgtacgcacctatctgtcttacc

SEQ ID NO: 134493 - DNA, 579 bp, Homo sapiens
  misc_feature: GYAE6OF01CD08L.16.71.G05.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (374)..(374): a, c, t, g, unknown or other
  misc_feature (374)..(374): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctccngcagggccagtcagagtgttaccagcaggtacttagcctggtaccagcagaacctggcctggctcccaggcctcctnatctatggtncatccagcagggccatggcatcccagacgaggttcagtgacaggtggtctgggacagtcttcactcacaccctnacgcagacgtggacgcctagaagttagtttgcgtagttagttacttactgtacagtcgtaagttagtgggtacggtacctaaccgtttacgtacgttttacgggaccgtacggggtaacctaacggtcgtacggtaagtacgtaaccgaaaacggtacgttggtcggtacttacggacctaaccgtattccgttgttccgttacg

SEQ ID NO: 134494 - DNA, 696 bp, Homo sapiens
  misc_feature: GYAE6OF01DSPRV.16.71.G05.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagatacccaccggagaattgtgttgacgcagtctcaggcacctgtcttgctcgagggaangccaccctntcctgcagggccagtcagngtntaccagcaggtactagcctggaccagcagaacctggcctggcctccgaggcctcctctatctagtggtcgctactccgagccgtacgggccacgtcggacactccgagtaccgtaggttcgaggtggacgtagggtcgggtacgtagggactacggtacctttacgacctccgttacccacccgtcgaacgccgaacggtaccgtagggacgttacccgttaggtaaacggtttcgttttaggacgttaacggtttgttaacctttacggtacgtaccgtaggttaccgtaaggtttacggttacggggtaaccggtaccgttaaacccgttttacgttaacgggttttaccgggaacccgggtacgggtaaccgtacgggtacgtacggaacgtaaccgtaacggtaaacggtacggttacggtcggtaccttaccgggacttaccgtattccgttagtcccgttaccg

SEQ ID NO: 134495 - DNA, 540 bp, Homo sapiens
  misc_feature: GYAE6OF01BFBYC.16.71.G05.1.454.CMB.1.raw
  modified_base (536)..(538): a, c, t, g, unknown or other
  misc_feature (536)..(538): n is a, c, g, or t
tcagtgtactactccacgaccggtgctcgatttagtgtcgtcgcaagagagaggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagcacccatactacttgactactgggccagggaaccctggtcaccgtctcctcacgcctccaccgaacgggcccagtcgtccttccccgtggccacccctcctaccaacgacgccaccgtcgtggggccacacgccggccctgggctcgccgtggcaaggacctacgtcgagtacgtacacgtgacggcgggcgtgggacgtaagggccgacgagtacgcannngc

SEQ ID NO: 134496 - DNA, 638 bp, Homo sapiens
  misc_feature: GYAE6OF01EBRQW.16.71.G05.1.454.CMB.1.raw
  modified_base (196)..(196): a, c, t, g, unknown or other
  misc_feature (196)..(196): n is a, c, g, or t
tcagtgtactactccacgaccggtgctcgattttagtgtcgtcgcaagagagagggggagagctgctcagttaggacccagagggaaccatggaaaccccagcgcagcttctcttcctcctgctactctggctcccagataccacggagaattgtgttgacgcagtctccaggcacctgtcttgtctcgagggaangccaccctctcctgcgagggccagtcagagtcgttaccagctaggtacttagcctaggtaccagcaagaacctggcctggcctccaggcctcctcatctagtggtgctatccagccgagggcccacgtcggcactccccgagaccgtaggttccaggtcggacgtagggttcgggtcgtaggggaaccaggtacctttcgaccttcctaccgaccctgacgtcgacgtactggacgtcgtagtaagtacttttcgacttaggttagttaattacgttcgtacaacgtacgtaaggttacgtgggttaacggaccttaaccgttaacgtttaccgtttcgggaccgacgggtaacctaggcgttaaggacgtaacgtaaccgaaacgtaacggtggtacggtaccgttacggacctacctagttccgttcgttaccgttaccg

SEQ ID NO: 134497 - DNA, 670 bp, Homo sapiens
  misc_feature: GYAE6OF01AQT3A.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaanagccaccctctcctgcagggccagtcagagtgttaccagcaggtacttagcctggtaccagcaagaacctggcctggcctcccaggcctcctcatctagtggtgcatccagccagggccacgtggcactcccagtacctaggttcaggtcggcgtaggtgggtctaggggacctaggtacctttcgacttcctacccgaccctgacgtcacgtacgtcgggacgtccgtaaggtaagttacgtttacgacgtagttacgttaacgtttaacgttcggtaccaggtacgtaaggttaggttacggggtaacgggtaccttaaccgtttaaccgttacgttttcgggaacccggtaacggggtaaccgtaacggtacgttacgggaacgtaacgtaacccgtaaaacggtaacgttgggtaaccggtccgtacgtaccgtaccgtaccgttcgttcgttcgtttaccccg

SEQ ID NO: 134498 - DNA, 616 bp, Homo sapiens
  misc_feature: GYAE6OF01C5JR0.16.71.G05.1.454.CMB.1.raw
  modified_base (518)..(518): a, c, t, g, unknown or other
  misc_feature (518)..(518): n is a, c, g, or t
  modified_base (527)..(527): a, c, t, g, unknown or other
  misc_feature (527)..(527): n is a, c, g, or t
tcagtgtactactccacgaccggtgctcgatttagtgtcgtcgcaagagagagggggagctctgagagaggagcccagccctgggattttcaggttgttttcatttggtgatcaggactgaacagagagaactcaccatggagtctgggctgagcgtggtctttttcttggtggtcttaagttttaaaaggtgtccagtgtgaggtgcagctgttggagtcgtgggggagcgttggcacgagccggtggggggtccctgagctcgtcctgtgcagcctctggtattctacctttgacagctatgacctatcggaccttcgggcccgaccgacggcctaccggaaggggaacggggctagggaagtcgggtactcgaggttattacggtggtggtaggttaactacgactaagtacctacgacaacgccgttaccggtagggaacgggtcccgtttacgaacctactacctacccgaagaagaaccaacttaccaaagaaccacactagtactcgtaanaacaagtanaacacgtccgagaacgaccgaccgaacgtaccgacgacctaatagttactacgtagacgacgaacgccgtacggactagtacaccacta

SEQ ID NO: 134499 - DNA, 724 bp, Homo sapiens
  misc_feature: GYAE6OF01C6R7V.16.71.G05.1.454.CMB.1.raw
  modified_base (100)..(100): a, c, t, g, unknown or other
  misc_feature (100)..(100): n is a, c, g, or t
tcagtgtactactccacgaccggtgctcgatttagtgtcgtcgcaagagagagggggagagctgctcagttaggacccagagggaaccatggaaaccccngcgcagcttctcttcctcctgctactctggctccagataccaccggagaattgtgttgacgcagtctccaggcaccctgtctttgtctccgaggggaaagacgcccaccctctcctgcgagggccagtcagagtgttaccagcaggtacttagccgtaggtaccagacacgaacctggcctggctcccgaggtcctcctcatctataggtcgacatccgacggcgacgggtccacgtcggacactccgaagacgtaggttcaggtggcgtaggtcgggtcgtaggggaacctacggttaaccttcgaccgttcctacccgtaccccgtcgtaggaccgaacggtacgtaacgggcgtacccggttaagtaacggtttacgttttaggaccgttaggtttacggtttaactttacggtacgttacctaaggtacgttaagggttaacggttacggggtaccgggttaacccttaaccggtttaaccgttaacggttttccggggaacccggtaacgggggtaacctacggtaggtaacgggtaacggtaaccgtaaccggtaaacggtacgttgggtaccggtattacccggacttaacccgtgtttacccgtgttcccttaccg

SEQ ID NO: 134500 - DNA, 652 bp, Homo sapiens
  misc_feature: GYAE6OF01DANCS.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgcccaccctctcctgcagggccagtcagagtgttaccagcaggtacttagcctggtaccagcagaacctggcctggctcccagcctcctcatctagtggtgcactccaggccgacgggcccaacgtcggacacgtcccgaagaccgtaggttcgaggtggacgtaggtgggtcgtacgggactacggtacctttcgacttcctccaacccgtcgacgccgtagaccgtagggactccgtagtaagtacttttggacttacggttagtttacttacgtcgttacgtacgtacgtaaggttagtacgggttacggtacccttaaccgtttacgttaccggttttcgggaccggtacggggaccgtaagtccgtagggtaacgtaacgtaacgaaacgtacgttcggtacggtacgtcggtacctacccgtattccgtcgttccgtttaccg

SEQ ID NO: 134501 - DNA, 588 bp, Homo sapiens
  misc_feature: GYAE6OF01C0O0T.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgccaccctctcctgcagggccagtcagagtgttaccagcaggtacttagcctggtaccagcagaaacctggcctggctcccaggctcctcatctatggtgcatccagcgacgggccacgtcggcactcccagacaggttcagtcggctaggtcgggtctgggacagtacttcactctccaccctcacgcagacgtggacgcgtagtaacgtatttgctagtgttacttactgtacgtagcgtagtagtacggtaggtcctaccgttacgtacgtttcggaccgtacggggacctaaggtcgtagggactaacgtaccgtaaacggtaacgttcgggtacggtaccgttacgaccctaaccgtatttaccgttgttccctttaccg

SEQ ID NO: 134502 - DNA, 544 bp, Homo sapiens
  misc_feature: GYAE6OF01EVZ29.16.71.G05.1.454.CMB.1.raw
  modified_base (201)..(201): a, c, t, g, unknown or other
  misc_feature (201)..(201): n is a, c, g, or t
  modified_base (355)..(355): a, c, t, g, unknown or other
  misc_feature (355)..(355): n is a, c, g, or t
  modified_base (414)..(414): a, c, t, g, unknown or other
  misc_feature (414)..(414): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaacctggcctggctccaggctcctcatctatggtgcatccagcagggccagtggcatcccagcaggttcagtggcaggtgggtctgggacnggtacttcgactcctccgaccctcgagcagacgtggacgcctagaagtatttgctagtntattactgtcagtctagtagtggtacggctaccttatacgtttggaccggtagggaccgagtcgtagggaagtacgtaacgaaacggtacgtggtcggtactacggtacctacattcttcgtcgttaccg

SEQ ID NO: 134503 - DNA, 606 bp, Homo sapiens
  misc_feature: GYAE6OF01A0GQ2.16.71.G05.1.454.CMB.1.raw
  modified_base (600)..(600): a, c, t, g, unknown or other
  misc_feature (600)..(600): n is a, c, g, or t
  modified_base (603)..(606): a, c, t, g, unknown or other
  misc_feature (603)..(606): n is a, c, g, or t
tcagtgtactactccacgaccggtgctcgatttagtgtcgtcgcaagagagaggggtccctgagactctcctgtgcagcctctggattcacctttgacagctatgccatgacctgggtccgccaggctccaggggaaggggctggaatgggtctcaggtattactggtggtggttataccacatactagcagactccgtgaagggccggttcaccatctccagagacaattccaagaacacactgtatctgacaaatgaacagcctgagagccgacgacacggccatatatactgtgcgaaagcaccggcagttacgcacccatacctactttgacttacgtcggggcacggggaaccctggtccaccgtctcctcacgcctccaccgacgggccctagtccgttccttccccctcggcccacccttcccctaccaacgaccgccctacccgtccggttacgggggcctaccgacggcccgggtaccccgtcgggtccgtcgcccgtcgggtacctaacgggtaccttacccgttaccgtacggttaccgtactaccgtaggacgggccgggcgtgggaccgtaaggccgacgacgtagnagnnnn

SEQ ID NO: 134504 - DNA, 736 bp, Homo sapiens
  misc_feature: GYAE6OF01EGH7Y.16.71.G05.1.454.CMB.1.raw
  modified_base (200)..(200): a, c, t, g, unknown or other
  misc_feature (200)..(200): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtcttgtctcgaggggaaancgccaccctctcctgcgacgggccagtcagagtcgttaccagcaggtacttagcctggtaccagcaacgaaaccgtggcctggcctcccgaggtcctcctcattcgtagtggtcgctacgtccagccgacgggcccacggtcggacctaacgtccccgaaggacgtacggttacgagggttcggaccgtaggggttcgggtcgtacggggtaaccaggttacctttaccgaccttccctacctacccgtacgacgactaacggtaccgtaggtacgtacccgtaggtaaacgttagttttacggaccgtttaagggttagttaacgtttacgtacggttaccgtacggttaccggtaaggttacggtttacgggggttaccggttacccgttaaccggttttaccgttaaccggttttacgggacccgggtaacggggaaccacgggtacgtacgggtaaacgtacgttaaaccgaaacggttacgtaggtaccggtactacgtaccgtaaccttacgttcgttgttccgttaacc

SEQ ID NO: 134505 - DNA, 672 bp, Homo sapiens
  misc_feature: GYAE6OF01C10I1.16.71.G05.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtcttgtctcaggggaaangccaccctctcctgccagggccagtcagagtgtaccagcaggtacttagcctgtaccagcagaaacctggcctggcctccagctcctnatctatggtncactccgagcgagggccacgtcggacatcccagacaggttcagtggacgtaggtcgggtctgggactagtacttcgaccttccgtacctaccctcgacgacgtaacgaccgtacgggacgccttaggaagttacgttttcgacgtacggttagttaactttacgtacgttaccgtagtactaaggtttaacgttacggggttacgggtacccttaaccgtttaacgttaccggtttttcgggacccggtaacggggaacccgtaagtaccggttagggtaacggtaaacgttaaccggtaaaacggtaacggttcgggtacggtaccgttacggtacctaaacccgttagtttccgttacggttcctttaacccg

SEQ ID NO: 134506 - DNA, 577 bp, Homo sapiens
  misc_feature: GYAE6OF01AU2B8.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcgttaccagcaggtacttagcctggtaccagcaagaaacctggcctggctcccaggctcctcatctatggtgcatccagcagggccacgtggcactccccagaccgaggttcaggtgggctaggtgggtctggggactagtaccttcaccttcctccaacccctgacgacacggtacgtcggacgtccgtagtaacgttatttcggacgtagttagttattacgtgtcagctagtagtggtacggctaccgttacttacgtttggaccgtacgggaccgaaggtcgtagggagtacgtacgaaacggtacgtcgtacggactacgaccaccattctgttcgttac

SEQ ID NO: 134507 - DNA, 533 bp, Homo sapiens
  misc_feature: GYAE6OF01EXPIU.16.71.G05.1.454.CMB.1.raw
  modified_base (201)..(201): a, c, t, g, unknown or other
  misc_feature (201)..(201): n is a, c, g, or t
  modified_base (404)..(404): a, c, t, g, unknown or other
  misc_feature (404)..(404): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaacctggcctggctccaggcctctcatctatggtgcatcccagtccgagggcccacgtggcactcccagacaggttcagtggacaggtgggtctgggacagtacttcactctcaccctgagcagctggagcctagaagtntttgctagtgtattactgtcagctagtagtggtaggctaccgttactacgtttcggaccgtagggtaccagcgtaggaagtacgtacgaaacgtacgtggtacgctacgacctactatcgtgtcttacg

SEQ ID NO: 134508 - DNA, 709 bp, Homo sapiens
  misc_feature: GYAE6OF01C601G.16.71.G05.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagtgtactactccacgaccggtgctcgatttagtgtcgtcgcaagagagagggggagagctgctcagttaggacccagagggaaccatcggaaacccagcgcagcttctcttcctcctgctactctggcctccagactaccaccggagtaaattgtgttgacgcagtctcaggcacctgtcttgtctccgaagggaancgcccacctctcngcgacggccagtcagagtgtaccagcgaaggttacttacgccgtaggtaaccagaccaacgaaaccgtcggccgtcggtcctcccgacggtcctcctacacttcgtagtcggtcgacacgtccagcgacggcctacgtcgaccactaccgaagacgtacggttcgaggtcggtacgtagggtcggtacgtacgggacgtacgtacttacgaccttcctacccacccgtagaacgacgtacgtacggtacggacgtacgtaggtaacgttacgtttacgtacgtagttagttacgttacgtacgtacgtacgtactaggggggggggggggggggggggttactacgggtacggtaccgttaaccgttaaccgttaccgtttacggtaccggtaacggggtaaccgtaacggtacggtacggtaacgtaacgtaacgtaaacgtaacggtacggtacggtacgtacgtaccgtactacgttcgttcgttcgttaccg

SEQ ID NO: 134509 - DNA, 556 bp, Homo sapiens
  misc_feature: GYAE6OF01DNLFJ.16.71.G05.1.454.CMB.1.raw
  modified_base (464)..(464): a, c, t, g, unknown or other
  misc_feature (464)..(464): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctgttggagtcgtgggggaggcttggcacagccgtggggggtcccctgacgactctcctgtgcagcctctggattcacctttgacagctatgccatcgacctgggtcccgccaggctccgaggggaagggctggaagtgggtctcgaggttattacgtgggtggttggttataccacatactacgcagactcgtgaacgggtccgttcaccatctccagacgacaattccaaagacacactgtactctgacaaatgaaacngtcctagagacgccgaacgaccgacggccaagttatacttacgtggtcgaaccgtaaagcccgtaccggactagttacgcccaaccctaaac

SEQ ID NO: 134510 - DNA, 656 bp, Homo sapiens
  misc_feature: GYAE6OF01DJ84Y.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcacctgtctttgtctccgaggggaaagcgccacctctcctgcagggccagtcagagtcgttaccagcaggtaccttagccgtaggtaccagacaacgaaacctcggcctggcctccgaggcctcctcatctagtggtcgcactccgagcgacgggccacgtggacacgtcccgagtaccgtacggttcaggtcggcgtagggttcgggttacgtaggggaccaacgttacttaccgtacctccgtacccacccgtcaacggtacgaacgtaccgtacggacgtaccgtaggtaacgttagttttcggacgtagttgttaactttacgtgtacagtacgtagtaggttaggtacggtaccttaccgttacgttacgtttacgggacccggtacggggaccgtaacggtcgtacgggtaagtacgttaacgaaaacggtacggtcggtacggtactacgctaccgtattccgtcgttcgttacc

SEQ ID NO: 134511 - DNA, 665 bp, Homo sapiens
  misc_feature: GYAE6OF01DF2VE.16.71.G05.1.454.CMB.1.raw
  modified_base (170)..(170): a, c, t, g, unknown or other
  misc_feature (170)..(170): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
tcagtgtactactccacgaccggtgctcgatttagtgtcgtcgcaagagagagggggagctctgagagaggagcccagccctgggattttcaggttgttttcatttggtgatcaggactgaacagagagaactcacatggagtctgggctggagcggtgtgttcgtaggngactaatttaaggntcngtgtgngtgctgctgtggagtggtggggcgtgttggcagcgccggtggggggtcctagacggtcctcttccgtgtggccacggcccttcggtaggaactttcaacctttcggacaggtcctntcgctacgtcgtccgtcggccncggacgccgacggagggtaggcgtaggtaggtcggtacgagtacgttgtggttgggtgttacgtactactactactacgacgtcgtacgttccggtacgggtacggtaccggtccgtacaccgtacgtactacgaacgaactaaccaacgtaacgaaactactaacctagttacgtactaagtacgaacgtaacgtaccaacggtctacgtacgaacggtaccgaccggtaaccgacgaacgttaacctaagttacgttaccgtaggtacggaaccggtaacgtacggacccgttaacggttacgtaaaccggtaaccctaacgtaccttaacg

SEQ ID NO: 134512 - DNA, 571 bp, Homo sapiens
  misc_feature: GYAE6OF01AJDO9.16.71.G05.1.454.CMB.1.raw
  modified_base (289)..(289): a, c, t, g, unknown or other
  misc_feature (289)..(289): n is a, c, g, or t
  modified_base (397)..(397): a, c, t, g, unknown or other
  misc_feature (397)..(397): n is a, c, g, or t
  modified_base (422)..(422): a, c, t, g, unknown or other
  misc_feature (422)..(422): n is a, c, g, or t
  modified_base (452)..(452): a, c, t, g, unknown or other
  misc_feature (452)..(452): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaacctggcctggctccaggcctcncatctatggtgcatccagcgagggccacgtggcactcccagactaggttccaggtcggctagggtcggtacgtggggaacaggtaccttccacttcctaccgaccctnacgccagacgtggacgctagaagtntttgctagtgttactacttgtacgtacgtntaggtagtgggtaggtaccgtacgttaccgtacgttttacggaccgtagggaccgtaagcgtacggaagacgtaccgaaagtacgtggtacgactcgaccacctatcgtgttcttaccg

SEQ ID NO: 134513 - DNA, 721 bp, Homo sapiens
  misc_feature: GYAE6OF01CVONP.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttgtggctattttaaaggtgtccagtgtgaggtgcagctgttggagtcgtgggggaggcttggcacagccgtgggggggtccctggagacctctccgtgtgcagtcctctggattcctaccttttgaccagctatcggccatcgaccgtcggggtcccgccgacggcctcccggagggggaacggggtcgtagggaagttcggggtcctacgtaggttaatttaccggtgggttgggttacggtttacttaacccgaactaacgttaccgtaaccgcgtaacggtacctcccgggttaggaaccggggttccccggtttaccaacccgtacgttcccgtacccaaggaacgtaaccgtaactttaacccgaaagaacccaacctaacgtgttaactcctagtaactaaacttacgaacgacgtcccgtaggaacgaccgacccggaacgaccgtaaccgacctaattaacgttaacgttaccgttggtaccggaaccgtaaaacgtacccgtaacccgggaccttaagggtttaccaaccccgtaacccgttaaacg

SEQ ID NO: 134514 - DNA, 551 bp, Homo sapiens
  misc_feature: GYAE6OF01BWT2D.16.71.G05.1.454.CMB.1.raw
  modified_base (203)..(203): a, c, t, g, unknown or other
  misc_feature (203)..(203): n is a, c, g, or t
  modified_base (381)..(381): a, c, t, g, unknown or other
  misc_feature (381)..(381): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccaccctctcctgcagggccagtcagagtgttaccagcaggtacttagcctggtaccagcagaaacctggcctggctcccaggctcctcatctatggtgcatccagcagggccactggcactcccagacaggttcagtggcaggtgggtctgggacagacttcactcctacaccctnacgacagacgtggacgtcctagaagtagttttgcgtagttacgttattactgtcagtcagttagtggtacggctaccgttactacgttttggtacgtacgggaccaggtcgtaggtagtacgtacgaaacgtacgtgtcggctacgtaccacctatcgttcgtcttaccg

SEQ ID NO: 134515 - DNA, 723 bp, Homo sapiens
  misc_feature: GYAE6OF01B4EHW.16.71.G05.1.454.CMB.1.raw
  modified_base (198)..(198): a, c, t, g, unknown or other
  misc_feature (198)..(198): n is a, c, g, or t
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctcagccaccctgtcttgtctccgaagggaancgccctaccctctcctgcgacgggccagtcgagtagtcgtaacngcgtagtactagccgtgtaccagcaacgaactcggctggctacccgagtcctcctcatcgtagtcggtacnctactaccgagccgaacggggtccaacgtcggacctaactacccgaaggtacgtacggttacgaggtacggtccggtagggttcgggtacggtacggacgtacgtaccgttcctacgtccctaccctaccgtcgacgacgtaagtacgtacgggacgtaccggtaacgtaaggtttactttcgacgttaaggttacgttaacgttaccgttagacgtagtacgtaagggttaacgttacgggtaacggttacccttaacgtttaccggtttacggtttaccggaccggggttaaccgacggttaaaggtcccggttaaaggtaccggtaacgtaaaccggtaaacggttaggttcggtacgggtacctaacggaccgtaacttaccgttcgttaccggttcttaaccccg

SEQ ID NO: 134516 - DNA, 674 bp, Homo sapiens
  misc_feature: GYAE6OF01AU689.16.71.G05.1.454.CMB.1.raw
  modified_base (272)..(272): a, c, t, g, unknown or other
  misc_feature (272)..(272): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttctgtggctattttaaaaggtgtccagtgtgaggtgcagctgttggagtcgtgggggaggcttggcacgagccgtggggggtccctgacgactctcctgtgcacgcctntggacttcacctttgacagctatcgccatcgaccgtcgggtcccgccgacggcctccggaaggggaacgggtcgtaggaagtcgggtctcgaggttagttacgtgggtggtaggttaactaccgactactacgtacgacagtaccgtccggtacggaacgggtcccgttacaaccgtcttacctacccgaagaacgaactaacttaccgaaacgtaaccacgtacctagtaacttcgtacgaactaaacgtacgaaaccacgtaccgtaggaacgaccgacccggtaaccgaacccgtaccggaacctaagttaacttaacgttaccgtaggttccggaaaccggaaacggcccgtaacccgggtaacgttaacggttaaccgtaccctaacccgtaaaccg

SEQ ID NO: 134517 - DNA, 614 bp, Homo sapiens
  misc_feature: GYAE6OF01DQ9TU.16.71.G05.1.454.CMB.1.raw
  modified_base (598)..(598): a, c, t, g, unknown or other
  misc_feature (598)..(598): n is a, c, g, or t
tcagtgtactactccacgaccggtgctcgatttagtgtcgtcgcaagagagagggggagctctgagagaggagcccagccctgggattttcaggtgttttcattttggtgatcaggactgaacagagagaactcaccatggagtctgggctgagcgtggtcgtttttctaggtggcttaattttaaaaggtgtccagtgtgaggtgcagctgttggagtcgtgggggagcttggcacagccgtggggggtccctggacgactctcctgtgcagcctctggattcacctttgacagctatgccatcgaccgtgggtcccgccgaggcctccgaggggaagggctggaatgggtctcgaggttattacgtgggtggttggtttaactaccactatacgtacgcacgacctccggtaggaacgggtcccgttcaacctatcctaccagaacgaactaacttaccgaaagtaaccactacttagttaactctagacaaacgttgaaaccacgtcctagagacgccgaacgaaccgaccggcctaagttacttaacttacgtaggtacgaacggaaacgccgaacccggtatagggtttaacncctaacccgttaaacg

SEQ ID NO: 134518 - DNA, 712 bp, Homo sapiens
  misc_feature: GYAE6OF01DAZW3.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagcgccaccctctcctgcgagggccagtcagagtgttaccagctaggtacttagcctggtaccagctaacgaacctggacctggcctcccgaggcctcctcatcgtatggtcgcactccagccgagggccctagtcggaccactccccgaagtaccgtaggttcaacggtcggacgtagggttcgggtacgtacggggtaaccacggtaacctttccgacccttttcccgacccgtaaccccgttcgacgaccgaacggtaccggttacgggtaccgtacccgttaggtaaacgtttacgttttacgacgttaacgtttagtttaacgtttaccgttgttacctaaggtacgtaaggttagttacgggtaacggtacccttaaccgtttaaccgttacgttttacgggaccggtaacggggtaaccgtaacggtagtacgggtaacgaacgtaaccgtaaacggtacgttggtacggtccgtacgaccgtactacgttcgtgttccttaccg

SEQ ID NO: 134519 - DNA, 685 bp, Homo sapiens
  misc_feature: GYAE6OF01AZJNU.16.71.G05.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangcccaccctctcctgcagggccagtcagagtgtaccngcaggtacttagcctggtaccagcagaacctggcctggctcccaggtctcctcatctagtggtgctactccagccgagggccacgtcggacacgtccccagactacggtttcaggtggactagggttcgggtacgtagggacacggtaccttcacgttctaccacccgtcgacgtcgacgacgtggacgtcctagtaagtacttttacgacgtagttacgttacgttaacgtcgttacgtagtaccgtaaggttacggttcgggttaacgggtacccgtaacccgttttaacggttaccggttttttacgggacccgggttaacggggtaacccgtaacggtccggttacgggtaacgttaacgtaacccgtaaaacggtaacggttccggtacgggtaccgttacgacccgttaaccgtacgtttacccgttcggttacctttaccg

SEQ ID NO: 134520 - DNA, 562 bp, Homo sapiens
  misc_feature: GYAE6OF01B3FJT.16.71.G05.1.454.CMB.1.raw
  modified_base (201)..(201): a, c, t, g, unknown or other
  misc_feature (201)..(201): n is a, c, g, or t
  modified_base (374)..(374): a, c, t, g, unknown or other
  misc_feature (374)..(374): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccaggcaccctgtctttgtctccgaggggaaanagcccacctctcctgcagggccagtcagagtgtacagcaggtactagcctggtaccagcagaaacctggctggctcccaggctcctcatctatggtgcatccagcagggccactggcatcccagacaggttcaggtgcgagtgggtctgggacagacttcactctccaccctnacgcacggactgggacgcctagaagtattttggacagtgttaattacgtgtcaagctaaggtagttgggtacgggtcgtaacccgtttacgtacctttttgggacccgtaaggggaccctaaaggtccgttagggaagacgtacgaaacgtaacgtgtaggctacgcctaccattctgttctttaccg

SEQ ID NO: 134521 - DNA, 680 bp, Homo sapiens
  misc_feature: GYAE6OF01CDN0P.16.71.G05.1.454.CMB.1.raw
  modified_base (675)..(677): a, c, t, g, unknown or other
  misc_feature (675)..(677): n is a, c, g, or t
  modified_base (679)..(680): a, c, t, g, unknown or other
  misc_feature (679)..(680): n is a, c, g, or t
tcagtgtactactccacgaccggtgctcgatttagtgtcgtcgcaagagagagggggtccctgagactctcctgtgcagcctctggattcacctttgacagctatgccatgacctgggtccgccaggctccgaggggaaggggctgggaatgggtctcgaggtattacgtgggtggtggtttactaccacatactacgcagacctccgtggaacggggccgttcacctatcctccagaacgactaattaccaaagaaccacactgtatctgacaaatcgaaacgcgcctggaagacgacccggacgacgacggccaattatacttacgtggtacgacgaaacgccgaccggctaggttacgccaaccctattaccttactttgacttacggtcggggaccaacgggtaaccctggtaccacccggttcctcccgtcgacgtccctacccaaccgaacgggtcccctagttcccggttcccttcccccgtcggacccctaccccgtccctaccgaacgaccgacctacccgtccggtcggggaccacggaccggccggcccggtcgggtcgtccggtccgtcggtaccgtaaccggtaccgttaccgttaccggtacgttacggtaccgtacgtcggacgggcgggtcgtagggacgacgggccgacacgtacgannngnn

SEQ ID NO: 134522 - DNA, 644 bp, Homo sapiens
  misc_feature: GYAE6OF01DL9PU.16.71.G05.1.454.CMB.1.raw
  modified_base (99)..(99): a, c, t, g, unknown or other
  misc_feature (99)..(99): n is a, c, g, or t
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (319)..(319): a, c, t, g, unknown or other
  misc_feature (319)..(319): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (632)..(632): a, c, t, g, unknown or other
  misc_feature (632)..(632): n is a, c, g, or t
tcagtgtactactccacgaccggtgctcgatttagtgtcgtcgcaagagagagggggagagctgctcagttaggacccagagggaccatggaaaccccngcgcagcttctcttcctcctgctactctggctccagataaccaccggagaaattgtgttgacgcagtctccaggcacctgtctttgtctccgagggaancgcccacctctccngcagggccagtcgagagtcgtaccagcaggtacttagcctggaccagcagaaccgtcggcctggtcctacccgaggtcctcctacactctagtggtcgctactaccnggacgacgggccacgtgaccactccgagactggtacngtcggntaggtggtcgagggactctacttcgacttctcgacctgacgcgacgaccgtcggagtaccgtagtaacgttagtttacggacgttagtacgtttacgttacgtaggtaccgtagtacgttagggttacgttacggggtacgggtaaccttaccggtttaacgttaccggttttacgggacccggtaacggggtacaacgggttacgagggtactaacgtaacccggtaaaagtccggttggtacgtctacggacccttacgtatccggtntttccgttaacc

SEQ ID NO: 134523 - DNA, 612 bp, Homo sapiens
  misc_feature: GYAE6OF01BWGQJ.16.71.G05.1.454.CMB.1.raw
  modified_base (183)..(183): a, c, t, g, unknown or other
  misc_feature (183)..(183): n is a, c, g, or t
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcggtcgtgttctaggcgctaatttaaaggngtcagtgtgnggtgcanctgtggagtgtggggagtgtggcacgagccgtgggggtccctgagctctcctgtcgngacgcctcgtacggtactttccgtaccttttgacagtcttatcacctatacggtccgtcgggtcccgcgcggtcctaccggaggggaagggctaggagtggtcgtagtaggtagtcgtgggtcgtaggttacacctagtactactacgacacgtcctccggtaggtacggtccgttaccgctactctcgagtataacctactacgaataaccactactgtactctaacgataacgtcaacgtacgacgtgaacggcgaccggacgacccggacggtacctaaccttaagtacgttacgtacggtgaaaccggaggtacccgtacggacttacggttaccgacccaccgttaaacc

SEQ ID NO: 134524 - DNA, 648 bp, Homo sapiens
  misc_feature: GYAE6OF01BDHLK.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgccaccctctcctgccagggccagtcagagtcgttaccagcaggtacttagcctggtaccagcagaaacctggcctggcctcccgggctcctcatctatggtgcatccagtcgacgggccacgtcggcactccagactaggtcaggtcggcaggtcgggtctggggactagtaccgttcaccgttctaccacccgtgacgaccagtacgtcggacgtccgtagtaacgtagtttcgacgtagttgttaacttacgtcgtaccacggtactaagtacggttacggtaacgggtacctaaccgtttacgttaccgttttgggacccggtaacgggtaccctaaggtcggtaacggtacgtaaacgtaccggtaaaaccggttaacgtcggtacggtacctacggaccgtaaccgtacgttaccgttacgtccgtttacgtaaccccg

SEQ ID NO: 134525 - DNA, 672 bp, Homo sapiens
  misc_feature: GYAE6OF01C4PQN.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgcccaccctctcctgcagggccagtcagagtgtaccagcaggtacttagcctggtaccagcagaacctggcctggcctcccgaggcctcctcatctatggtcgcatccagccgacgggtccacgtcgcactcccgagacgaggttcaggttcggcgtagggtcggtcgtagggacagtcctcactctccaccctgacgcgagtacgtacggacgtcgtagtaagttacgttttcgcgtagttagttacttacgtcgtacgtacgtacgtaggttacggtacgggttacggtaccttaccgtttaccgttacggttttccgggaacccgggtacgggtaacccgtaacgggtaccgtacgggtaacgtaaccgttaaaccggtaaaccggttaacggttcgggtaccgggtaccgttacccggtaacccgtaaacccgttacgtttaccgttccgtttccgtttaacccg

SEQ ID NO: 134526 - DNA, 701 bp, Homo sapiens
  misc_feature: GYAE6OF01BF6IH.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtcgtgggctgagctggtctttttcttgtgcttattttaaaggtgtccagtgtgaggtgcagctggttggagtcggtgggggagtcgttggacacgacggtccggtcggggggtccctggacgtacctcgtccgtgcgcacgtcctcgtggtacttacctacctttagactagtcctagtcgcctagtcgtaccggtcgggtacccgccgacggtccgtaccgggaaggggaacgggtcgtagggtaacgtcgggtcgtacgtaaggttacgttacggttggggtggttaggttacctaaccgtaacgtaacgtaaccgtacggaccgtacgtaccgttaccgggaggtaacccgggtcccgtaccaccgtactaccgtaccgagtaaccgaactaaaccgttaccgaaagtaaccaactacgtacgtactacgtacaacgtaaacgtacgaaccgtacgtacgtaagacgaccgaccgaacgacccgacgactaagtagttacgtacaggtcgaaacgtaaccggcgtaccggtagtactaccgtaccaaccgttaacg

SEQ ID NO: 134527 - DNA, 809 bp, Homo sapiens
  misc_feature: GYAE6OF01EF8UB.16.71.G05.1.454.CMB.1.raw
  modified_base (197)..(197): a, c, t, g, unknown or other
  misc_feature (197)..(197): n is a, c, g, or t
  modified_base (329)..(329): a, c, t, g, unknown or other
  misc_feature (329)..(329): n is a, c, g, or t
tcagtgtactactccacgaccggtgctcgatttagtgtcgtcgcaagagagaggggagctctgagagaggagcccagcccgtgggtatttttcgaggttgtttttcatttggtgatcgaggactgaacagagagaactcaccatggagtcgtgggctgagcggtcgttcgttcgtaggtcgacttaagtttaaaggntcgagtgtgagtgcagtcgtggtgagtcggtggggaagcgttggcacgtcggcccggtggggttcccaggtacgtacgttccgtccgttgtacgcctagcccggtttatggtaattaccgtacttggacgtntccgtagtcgaaccgtaggttccaacggtttccggggccctaaaccgtacggggtcctaccgggtaaaacgggggacggtaccgtttaagggtaaaacggtcgggtttccctacggttaacggttaatttccgggtttaggggtcccgtttacggtttaaaccgtaaccgtaaactcgttaaacggtcccccgaggttaaacgtacccggttacggccgggttaaccgggtcccggttaccgaacccgttacgtaacccgtacgtaacgtaaccgtaaccgttaaacgtaaccgtaaacggtaaacctaaccgttaacgttacgtacgttacctaacgaaacgtaacgtaacgaacgtaccggtacgtaacgaacgaccgtaccgacgtaccgaccgtaacgttaacgttacgttacgttaccggaagttaccgaacggacgtacggtaccgtagttaaccgccgttaccgtacgtaccg

SEQ ID NO: 134528 - DNA, 802 bp, Homo sapiens
  misc_feature: GYAE6OF01AI0V4.16.71.G05.1.454.CMB.1.raw
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctcccagataccaccggagtaaattgtgttgacgcagtctccaggccaccctgtctttgtctccgaaggggaaagacgcccaccctctcctgcgagggccagtcagagtgtaccngcaggtacttgcctggaccagcaagaacctggcctggcctccgnggcctccncntctagtggtcncactccaggcgacgggccactcgacactacccgaagaccgtacggttcgacggttcgggacgtaggggtcgggttccgacgggactaacggttacctttacccgaaccgtttcccgtaaccctaccccgtacgaacggtaccgaacggtacggtacgggtacgtacccggttaaggttaacggtttagttttacggacgttacgggtttacgtttaacgttttaccgttacgggttaacgtaacggttcgtaaacgggtttaacggtttacggggttaacccgggttaccgttaaacccgttttaaccgggtttaccggtttttaccggggaacccggggtaaccggggttaaacccgtaaacgggttaccggttaaacggggtaaacggtaaccggttaaaaccggtaaaaccgggttaacggttccgggttaacggtccgttacccggtaactacccgttaacgtttccgttacgtttccgttaccccg

SEQ ID NO: 134529 - DNA, 635 bp, Homo sapiens
  misc_feature: GYAE6OF01A1JNS.16.71.G05.1.454.CMB.1.raw
  modified_base (515)..(515): a, c, t, g, unknown or other
  misc_feature (515)..(515): n is a, c, g, or t
  modified_base (592)..(592): a, c, t, g, unknown or other
  misc_feature (592)..(592): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtcgtgggggaggcttggcacaggccgtgggggggtccctgagactctcctgtgcacgcctctggattcctacctttgacagtctagtcgccagtcgaccgtgggtcccgccgaggccgtcgaggggagggtcgtaggagtgggtctcgtaggtattacgtgggtggtaggttactaccgatactactacgcaagtaccgtaccggtagggaaccggggtcccggttaccaaccgtacttcccgtaccgaagaacgaacctaacgttacccaaagaaccaacgtactagtactacagaactaaanacgaaacagcctaggagaaccgcccgaacgaccgaccggacctaatacttacgtttagacggttacgacggtaaacncccgaaccgggtactaaggtttacccgccctaaaccgttaacc

SEQ ID NO: 134530 - DNA, 547 bp, Homo sapiens
  misc_feature: GYAE6OF01BSYCJ.16.71.G05.1.454.CMB.1.raw
  modified_base (201)..(201): a, c, t, g, unknown or other
  misc_feature (201)..(201): n is a, c, g, or t
  modified_base (379)..(379): a, c, t, g, unknown or other
  misc_feature (379)..(379): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaacctggcctggctcccaggctcctcatctatggtgcatccagcagggccacgtggcactcccagacaggttcagtggcaggtgggtctgggacagtacttcactctccaccctnagcagacgtgacgctagaagtatttgcgtagttagttattacgtgtctagtctagtagtggtacggctaccgttactacgtttcggaccgtacgggaccaggtcgtaggagacgtacgaaacgtaacgtggtacggcgtacgtactaccgtattccgtgttccttacg

SEQ ID NO: 134531 - DNA, 724 bp, Homo sapiens
  misc_feature: GYAE6OF01ERDFV.16.71.G05.1.454.CMB.1.raw
  modified_base (203)..(203): a, c, t, g, unknown or other
  misc_feature (203)..(203): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaagggaaagngccaccctctcctgcagggccagtcagagtgttaccagcaggtacttagcctgtaccagcagaacctggcctggctcccagcctcctcatctagtgtgcatccagccgagggcccacgtcggactacgtaccccagaacgtacggttcaaggttggacgtaggttcggggtctggggaacctaaggtacctttaccgaccttccctacccgaccccgttcacgacctacggaacgtcgggacgacccgttagtaaacgttattttcggacgtaacgttaggtttaacttacgtacggttaccgaacgtacgtacggttaaggttagggttaaccgggtaccgttaacccgttttaaccgttaccgttttttaccgggacccgggttaaccgggggaacccgttaacggtaccggtagggtaacgaacggttaacccgtaaaacggttaaaccggtacgggttacgggtaccgttaccggtacccgtacccgtaacttccgtttccgttaccgtttaacccg

SEQ ID NO: 134532 - DNA, 931 bp, Homo sapiens
  misc_feature: GYAE6OF01CLGT4.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttctgtggcttaatttaaaggtgtccagtgtgaggtgcagctgtggagtcgtggggagcttggcacgagccgtgggggtccctgacgactctcctgtcgcagcctctggtacttcctacctttgaacagtctatcgtacccagtcgtacccgtcggggtccccgccgtacgggcctacccggaagggggaacggggtccgttaggggtaaacgttcgggggttaccttacggtaacggttaacgtttaccggtaggggttggggttacggttttaaacgtaacccaacgttaacttaacccgtacgtaccgtaaacggtacccgttaccggtacggggtaaaccgggtcccggttaccgaaccccttactccccgttacccgtaaacggaacgtaaaccgtaaaccgtttaaccccgaaaaacggtaaacccctaaaccgttaaacccgtttagttaacccgttaaccgttaccggtaaaccttaaaaacgttacgggaaaaaccccgtacgggtaccccggttaagggaaacccgggtaaccgggtacccccgggtaaacccgggaaaccccggaaccccggggtaaaaccccctttaaagtttaaaaccggttttaaaaccgtttttaaacccgggtacgggtttaaaccgggggtaaacccgggaaaaaaaacccggtcccccgggtaaaacccccgggggttaccggtttaaaccggtttttaaaccccgggtaaccccttaaaaccccccccgtttaaaaacgg

SEQ ID NO: 134533 - DNA, 719 bp, Homo sapiens
  misc_feature: GYAE6OF01EIHT0.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccaggcaccctgtctttgtctccgaggggaaancgccaccctctcctgcgagggccagtcagagttgttaccagcaggtactagcctggtaccagcagaacctggcctggctccgaggcctcctcatctagtggtcgcactccgagcgacgggccacgtcggcactaccccgagacgtacggttccaggtcggcgtagtcggggttcgtgggacgtacggtacttccgaccttcctacctacccgtacgacgtacgaacggtaccgttgggaaccgtccgttaaggtaacgtttacgttttcggacgtagggtttacgttacgttttacgttaggtaccgtaacggtcgttaagggtttacggttacggggttaacgggtacctttaacccggtttaaccgtttaccggttttaaccgggacccggtaaccgggggtaacctaaggtaccggttagggaacgtaaccgttaaaccgaaaaccggttacgtagggtttccggaccgttacggaaccctaaccggttagtttaccgtttcggttcttaacccg

SEQ ID NO: 134534 - DNA, 725 bp, Homo sapiens
  misc_feature: GYAE6OF01DF77X.16.71.G05.1.454.CMB.1.raw
  modified_base (407)..(407): a, c, t, g, unknown or other
  misc_feature (407)..(407): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctccagactaccgacggaagtaagttgtgttacgacgctacgtcctacgagcctaccgttgttctttgtcctaccggaagggaaagccgccctacctctacgcgacgtacggacctagtacaggtacgtactaccgagcgtaagttactacgtacgtacgacgagacaacgtaactcggccgtacggccctcgacgtcctaccatactctagtgtcacactaccgacgaccgacggacctcgtacgacaccgtacccgtaaggacgtacggttacnggtaccggacgtcggggttacggtcgggtacgggtaacacggttaccttactaccgttcctaaccccgtaccgtacgacgtaacgtaacggtacgtaacgggaccgtaccgtagtaacggtttacttacggacgtttagtacgtttaacttacgtcgtactagacgttaggttaggtacgggtacggtaacctttaaccgttacgttaccggtttacgggacggtacgggtaaaccgcggttacgaagggtactaacgtaaaccgtaaacgtcggtacggtacggtgtacgtaccaacttacgtctcgttcctaaccg

SEQ ID NO: 134535 - DNA, 1148 bp, Homo sapiens
  misc_feature: GYAE6OF01C9AVC.16.71.G05.1.454.CMB.1.raw
tcagtgtactactccacgaccggtgctcgatttagtgtcgtcgcaagagagagggggagctctgagagaggagcccagccctgggtatttttcgaggttgttttctattttggtgatcgaggactgaacagagagaactcaccatggagtcgtgggctgagcgtggttctttttcgttggtggtactttaaagtttttaaaagggtcgtaccgtaaggtggtaggtagggtcgactacggtcgttgggttgggtacgggttcggggtagggggggtacggttcggtttcgggaccaaccggtaccgggttccccgggggtttacccgggggggggtttcccctagggtaaccgtacctttcccgttcccggttggtacgccgtaccgttccccgtttacggtacggttacccttttcccgttaaccgtttacggaaccgtaccgtacgttacgttcccgtacctaccggttacccggttaacccggggttcccggggtcccccggtacccgggtaaccgggttccccgggtaaccgggtaaacgggggggtaaccggggtccgggtaacgggttaaaccggggtttcgggttacccgggttaacggtttaaacgggttttaacgtttttacgggggtttaggggtttacgggtttaacggttttaaaccgtaaaccccggttaacgtaaaccgtttaacccggaccgttaaccggtaaaccggttaccccggggttaacccgggttaaacggggtaaaccccggggggtttcccctttaaaccccgggtaaacccttccggtttaaaccccgtaacggttaaaccggaaacttaaaccggtttaacccctaaaacggaaacccgttaaaactacccgttaacggtttaacttccgttaaccggtaacccgtaaaacggttaacgtaaacccggtaaaacggtcccgttaaaccgggaacgggaaccccgggaacccggaaaccccgggtaaacccgtaacccggaaccccggttaattaaaagttttaaccgttaaacggttcggggttaaaccggtaccggggtaaaaccggggttaccgggggtaaacggttttcggggggtacccgggtttaacggggcggtttaaacgggttcgttaacccggg

SEQ ID NO: 134536 - DNA, 669 bp, Homo sapiens
  misc_feature: GYAE6OF01B43X5.16.71.G05.1.454.CMB.1.raw
  modified_base (208)..(208): a, c, t, g, unknown or other
  misc_feature (208)..(208): n is a, c, g, or t
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctccagactaccgacggagaattgtgttgacgcagtctccgaggccaccctgttctttgtctaccgaaggggaaacncgccctacccgtctccgtgcgacgggccagtcagagtcgtacngcaggttactgctggaccngacacgaaccgtggcctcggcctccgacgtcctcctctacttcgtacgtggtcaccgtacgtccgagccggacgggacctacgtcggacctacgtacccgaaggtaccgtaggttacgaggtcggacgtagggtcgggttacgtacgggaactacgtactacctacctccgtaccgacctcgacgtacgacggtacgtcggtacgtacgtagtaacgttgttacgcgttagtacttagtttcgtcgtacgtactaggtagttaggtacggttacgaccgtttaacgttcgttacggttacggaccggtacggtacgagtccggaaggtaacgaccgtaaccgaagtacggtcggtacgtacgtaccgtaccttacggtattcccgttagtccttaccgg

SEQ ID NO: 134537 - DNA, 620 bp, Homo sapiens
  misc_feature: GYAE6OF01BCQP8.16.71.G05.1.454.CMB.1.raw
  modified_base (197)..(197): a, c, t, g, unknown or other
  misc_feature (197)..(197): n is a, c, g, or t
  modified_base (398)..(398): a, c, t, g, unknown or other
  misc_feature (398)..(398): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctcaggcaccctgtcttgctcgagggaaanagccacctctcctgcagggccagtcagagtgtaccagcaggtacttagcctggtaccagcaagaaacctggcctggcctcccgaggcctcctcatctagtggtgcactccagcgacgggccacgtcggacactcccgagacacggttcgaggtggactaggtcggggtctcgggaacagtaccttcacgttccacaccctnacgacacgactacgggacgtccgtagtaagtacgttttgacgtagtgttaattacgtcgtacgagtcgtaaggttagtacgggtacggtaccgtaccgtttacgtacgttttcgggacccgtacgggaacctaaggtcgtaggtaacgtacgtaaccgtaaagtacggttcggtacggtaccgtacgtaccgtacctaagttccgttacgttcgttaacccg

SEQ ID NO: 134538 - DNA, 786 bp, Homo sapiens
  misc_feature: GYAE6OF01CRWHM.16.71.G05.1.454.CMB.1.raw
tcagtgtactactccacgaccggtgctcgatttagtgtcgtcgcaagagagagggggagctctgagagaggagcccagccctgggattttcaggttgttttcatttggtgatcaggactgaacagagagaactcaccatggagtctgggctgagctggtctttttcttgtggtcttaattttaaaggtgtccagtgtggaggtgcagtcgttggtggagtcggtgggggtaggtcgttggcacgacggccggttcggggggtccctggacgaccgtccgtccgtgtcgcacggtcccttgtggtactttcctaccgttttcgaactagtcttacgccgactacgtcgtacccgttcgggtcccgccgacggtcccgtacggaaacgggggacgggtcgtacggtaacgtcgggtctcggtaagtttacgttacggttgggttaggttacggtttactaaccgtaacgttaactacctaaccggacgtaccgtaccgttaccgggtaggggaaccggggttcccgttacgaaccccgtgttaccctaacccggtaagaacgtaaacccgtaaacgttaacccgaaacgtaaacccgtaaccgtacgttacgttaacgtccgtaacgaataaacgtaacgaacgaccgtcgtaacggacggaaccgaccgaacccggacgaaccccggtactaaacgttacgttaccgttaagtaccggacggtaaaccggaaccgtacccggaacccgtaacgttaccgtttaccaacccggttaaccccttaaacg

SEQ ID NO: 134539 - DNA, 631 bp, Homo sapiens
  misc_feature: GYAE6OF01ELJKX.16.71.G05.1.454.CMB.1.raw
  modified_base (201)..(201): a, c, t, g, unknown or other
  misc_feature (201)..(201): n is a, c, g, or t
  modified_base (382)..(382): a, c, t, g, unknown or other
  misc_feature (382)..(382): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagcccaccctctcctgcagggccagtcagagtgttaccagcaggtacttagcctggtaccagcaagaacctggcctggctccagctcctcatctatggtgcatccagcgacgggccacgtggacactcccagactaggttcaggtggcaggttcgggtctgggacagtacttccgacttcnccaccctgacgtcagtacgtaggacgccttagaagtagttttcggactaggttagttacttacgtgttacgtagtactaaggtttacgtgggttaacgggtacttaacccgtttacgttaacggttttaccgggaccggtacgggggtaaccaaggtaccgttagggaaacgtaacgtaaccgaaacggtaaccgttacgggtacggtaccgtacgacccgtaaccctagttccttacgttcgttaccg

SEQ ID NO: 134540 - DNA, 921 bp, Homo sapiens
  misc_feature: GYAE6OF01D0RC9.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttcttgtggtcttaagttttaaaggtgtccagtgtgaggtgcagcgtggtggagtcgtggggaggtcgttggcaacgacgccggtcggggggtccctggacgtacctcctcgtagtcgcagtccgttcgtggtacttcgtaccctttgacagtaccgtagtcgccgtaagtccggtaacccggttcggggtcccgaccggtacggtccgtaccgggtaacgggggaacgggtccggtaggtaaacgggttcgggttaccgtacggtaacgggttaacgtttacgggttacggggttacgggtttacggtttaaccgtaaacccgtaacgtaacgttaacccgtaacggtacccgtaacgggttaacccgttaccgggtacgggaaacggggttacccttaactttaaccccggaacttacgtttacccacccgggtaaaaggtaaccgtaaaccttaaccgttaaacccggaaacggtaaccgttaacggggttacgtaaattttaccccggtataaaacggttcgaaaccgtcggtaacctaggaaacccgggttaaaccggaacggtacccgtaaccggggttaaccttaagtttaaaggtttaccgtttacggggtaaaagtttttaacgggggtttaacttacggggggtttaaaccgggtttaaacccgttccccccggggggtaaaccccgttaccgggggggaaccccggtaaaaacgggggtttccccgggtttccggtaaaaccccccgg

SEQ ID NO: 134541 - DNA, 698 bp, Homo sapiens
  misc_feature: GYAE6OF01A2W83.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaanagcccaccctctcctgcagggccagtcagtagtcgttaccagcaggtacttacgccttggtaccagcaagaaacctggcctggcctccaggctcctcatctatggtgcatccagcgaggccacgtggctacgtccccgaagaccgaggttcgagtcggacgtaggtggggtctcgggaactacggtacttccacgttcctaccgtacccgtcacggtcagtaccgtagggaccgtaccttaggtaaagttcgttttacgacgtaacggtttagtttaactttaccgttacgtaccgtaaggtaccctaagggttacgtacggggtaacgggtacccttaacccgtttaacgttaccggttttacgggaacccgggtaacgggtaacccgtaaggtaccgttaagggtaacgtaacggtaaaccgtaaaacggtaccgttagggtaccggtacgttaccgtaccgtaaccgttagttccttacgttccgtttaacccg

SEQ ID NO: 134542 - DNA, 620 bp, Homo sapiens
  misc_feature: GYAE6OF01DQ5H3.16.71.G05.1.454.CMB.1.raw
  modified_base (204)..(204): a, c, t, g, unknown or other
  misc_feature (204)..(204): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggccaccctgtctttgtctccgaaggggaaancgcccaccctctcctgcagggccagtcagagtgttaccagcaggtacttagcctggtaccagcaagaacctggcctggcctcccgaggcctcctcatctagtggtgctatccagcgacgggccacgtggcactcccgagactaggttcaggtcggcgtagggtgggtctcggggacaggtactttccgaccttccgtacccaccctgaacgccacggactcgggacgtccgtagtaagttagtttgacgttagttagttaacttacgtggtacaggtctaaggttagttgggtaacggtccttaacccgtttacgttaccggttttcgggaccgtacggggtacctaaggtcgtaggaactacgtaccgaaagtacgttggcggtactacgacctaactagtcgttcgtcttaccg

SEQ ID NO: 134543 - DNA, 883 bp, Homo sapiens
  misc_feature: GYAE6OF01BCYP9.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctcccagataccaccggagaaattgtgttgacgcagtctccaggcaccctgtcttgtctccgaggggaaancgccaccctctcctgcgaggccagtacagagtcgttaccagctaggtacttaggcctaggtaccagtcaacgaaacccgtggcccgtcggaccttccccgacggtccctcccgttactacttaccttagtcgggttacgcctaacgtccgacggccgaaccggggcccaacgtacgaccgtaacctaccccgaaacggaccggtaacgggtttccgaacgggttcgggaccggtagggttacgggggttaccggtacgggggaaccgtaggtaacccgttttacccgaacccgttacccttaccccgtacccccgttacgaccggtaccgtaacgggtaccggtacggggtaaccgttacccggttaaggtaaacgtttaggtttttacgacggttaaggtttacgtttaacgtttacttaccgggttacgtaacggtaccggtaagtttacgggtacggggttacccgggttacccgttaaacccgttttaaccggtttacccgggttttaacggggaccccgggttaaacggggggaaaccccgttaacggtaccgggttaaacggggtaaccgttaaacgttaaacccgggtaaaccggttaacgggttacgggtaccgggtaccgtacggtacccgttacccgttaacctttccgttaccgttacgtttaacccccg

SEQ ID NO: 134544 - DNA, 1012 bp, Homo sapiens
  misc_feature: GYAE6OF01E0XJO.16.71.G05.1.454.CMB.1.raw
tcagtgtactactccacgaccggtgctcgatttagtgtcgtcgcaagagagagggggagctctgagagaggagcccagccctgggtattttcaggttgttttcatttggtgatcaggactgaacagagagaactcaccatggagtcgtggctgagcgtggtctttttcttgtgacttaatttaaaggtgtccagtgtgaggtgcagcttggttggagtcggtgggggaggtcgttggcaccgacggtcccggttcgggggggttcccctaggacgtaccgttccgtccgttggtcgaccgtacggtcccttacgtgggtactttaccttacccgtttgaacctacggtcttaacgtcgaccctaacgttccgtaacccggttcggggtccccgtacccgacgggtcccgtaacccgggaagggggtaaccggggtccgtaagggtaacggttcggggttaccgtaccggtaaggtttacgtttaaccgggttgggggtttacgggttaccggttttaaccgttaaacccgtaacgtaacgtttaaacccgtaacccggtacgtacggttaacccggttacccgggttaacggggtaaccggggtacccccggtttaacccgaacccgttacgttaccccccgttaacccgaaaacggtaaacccggttaaaccctaaaacccggtttaaaccccccggaaaaagtaaaacccccgtaaacgttaaccccgtttaaacggtttacccgttaacccgttaaccgggtaaaacctaaaaccgtaaacgggttaaaaccccgaaccgggttaaccccgaaggggttaaacccggtaacccggaaccccccgggaaaccggtaaccccgtaaaacccggtaaacccttaaaacgtttaacgtttaaacccggttttaacggtaccggtaacggaaaccggtaaaacccggacccggtaaaccccgggttaccttaaacgtttaccccggtaaacccccgaaacccgtttaaaccccg

SEQ ID NO: 134545 - DNA, 809 bp, Homo sapiens
  misc_feature: GYAE6OF01CYO02.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatcggaaaccccagcgcagcttctcttcctcctgctacctctggctccagataccaccgagaattgtgttgacgcagtctccaggcaccctgtctttgtctacgaaggggaanacgccacctcctctgcgacgggccagtcgagtaggttacgttacgagtacgtaggttaccgttacgccgttaggtaccacgacaacgaaccgtcggaccgtcggtcctaccgacggtaccttccgtcacttacgtagtcgggtactaccgactcggaacgccggaaccgggcctaacggtcggaccctaacgtccccggaacgtaccggttaggtaccggtaggtaccggtaggtacgggggttaccggttacgggtaaaccgggtaacgtacccgggttaacccgtttacccgaacccctttcggtaaccccccaccgttcccggaacgggtaccgtaaccgggtaccggttaccggggacgttaccgtaacggtttaacgtttaacgtttcggtacgttaggttacgttactttacgtaacgtgtaacgtacggttaaggttacgggtcggttaaccgggtacctttaccgttcggtttaaccggttcgggtaaccggaacgggtaccgtacgggtacggtacggaaacggttacgtaaccggttaaacgtacgtcggttaacggcgttaccgtacctacgtacgttctacgggtttccttaccgg

SEQ ID NO: 134546 - DNA, 570 bp, Homo sapiens
  misc_feature: GYAE6OF01EIX0Z.16.71.G05.1.454.CMB.1.raw
  modified_base (203)..(203): a, c, t, g, unknown or other
  misc_feature (203)..(203): n is a, c, g, or t
  modified_base (372)..(372): a, c, t, g, unknown or other
  misc_feature (372)..(372): n is a, c, g, or t
tcagtgtactactccacgaccggtgctcgatttagtgtcgtcgcaagagagaggggggagagctgctcagttaggacccagagggaaccatggaaaccccagcgcagcttctcttcctcctgctactctggctcccagataccacggagaaattgtgttgacgcagtctccaggcaccctgttctttgtctccgaggggaaancgcccaccctctcctgcagggccagtcagagtgttaccagcaggtacttagcctggtaccagcagaacctggcctggcctcccgaggcctcctcatctagtggtcgcactccagcgacgggccacgtggcactcccagacgaggttcagtggcaggtggtcgtgggacngacttcgactctccacctcacgcagacgtcggacgccgtagtaacgtatttgactagttagttactttacgtgtacgagtacgtagttagtggtacgggtcctaccgttacgttacgtttcggaccgtacgggtaccaggtcgtaggatacgtacgaagtacgtcggtacgcgtcgacctactagttctgtccttacg

SEQ ID NO: 134547 - DNA, 754 bp, Homo sapiens
  misc_feature: GYAE6OF01AS6NW.16.71.G05.1.454.CMB.1.raw
  modified_base (200)..(200): a, c, t, g, unknown or other
  misc_feature (200)..(200): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaattgtgttgacgcagtctccaggcaccctgtctttgtctccgaggggaancgccacctctcctgcagggccagtcagtagtcgtaccgagcgtaggttactagccgtaggtaccagacaacgaacctggaccctggcctacccgaggtcctccgtcacttacgtagtcggtcgacctacgtaccgaggccgaacggggtccctaacggtcggaacctaacctaccccgaaggtaaccgtacggtttacgacggttgggaccgtagggttcgggtacgtacggggtaacctaacggttacccttaccgtacccgttccgtacccctacccgtacgaacggaccgtaacgtaccggtacggtaaccgtaccgtaagtaacgtttagtttacgacgttacgttacgttagttaccgtcgtacgtaacgtacgtaggttacggtcgggtaaccgttacccttaaccgtttaccggttacggtttaccgggaaccggtaaccgggaaccgttagggtaccgtaagggaacgttaaccgaaccgtaaacgggttagtcgggttaacgtcccgtacgtaccgtaacttacgttccttcggttaccttaccg

SEQ ID NO: 134548 - DNA, 569 bp, Homo sapiens
  misc_feature: GYAE6OF01BX7KC.16.71.G05.1.454.CMB.1.raw
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagcccaccctctcctgcagggccagtcagagtgttaccagcaggtacttagcctggtaccagcagaaacctggcctggcctccaggcctcctcatctatggtgcatccagcgacgggcccacgtggacactccccgagaccaggttccaggtggcaggtgggtctgggacngacttcactctcaccctnacgcacgactggacgccgtagaagtntttgctagtgttattacgtgtacgagtactagttagtgggtacggtcctaccgttacgttacgtttcgggaccgtacggggacctaagtccgtaggacgtacgtaacgtaaacggacgtggtcggcgtacgtcacctatccgttgtccttacg

SEQ ID NO: 134549 - DNA, 671 bp, Homo sapiens
  misc_feature: GYAE6OF01BAK21.16.71.G05.1.454.CMB.1.raw
  modified_base (204)..(204): a, c, t, g, unknown or other
  misc_feature (204)..(204): n is a, c, g, or t
tcagtgtactactccacgaccggtgctcgatttagtgtcgtcgcaagagagagggggagagctgctcagttaggacccagagggaaccatcggaaaccccagcgcagcttctcttcctcctgctactctggcctcccagataccaccggaagaaattgtgttgacgcagtctccaggcaccctgttctttgtctcgaggggaanacgccacctctccgtgcgagggccagtcagagttcgttaaccaggcaggtacttagcccgtaggtaccagcaagaaccgtggccgtcggcctccgacggcctccgtactacttcgtagtggtcgacactccgagccgacgggccacgtcggcctaccgtcccaaggtaccgtacgggttcacggtggacgtagggttcgggtacgtgggaacctacggtaccttccaccgtcctacccacccgtgaacgcgaagtcgtacggcgtacgttagtaaagttcgttacgacgttaggttattacgttacgttcgtacgacggttagtaggtttaggtacgggttacgtacccttaccgtttaccgtttacgtttacggggaccggtaacggggtactacgggtcgtagaacggtacgtaacgtaacgtagtccggtgacccgtagacctacttatccgttgtccgttccg

SEQ ID NO: 134550 - DNA, 644 bp, Homo sapiens
  misc_feature: GYAE6OF01AFEPI.16.71.G05.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (327)..(327): a, c, t, g, unknown or other
  misc_feature (327)..(327): n is a, c, g, or t
  modified_base (515)..(515): a, c, t, g, unknown or other
  misc_feature (515)..(515): n is a, c, g, or t
  modified_base (608)..(608): a, c, t, g, unknown or other
  misc_feature (608)..(608): n is a, c, g, or t
  modified_base (629)..(629): a, c, t, g, unknown or other
  misc_feature (629)..(629): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggataaattgtgttgacgcagtctcagcacctgtctttgtctcgaggggaaancgccacctctcctgcgacgggccagtcagngttcgtaccagcgaggttacttacgccgtaggtaccagaccaagaaaccgtcggcctcggacctcccggagtcctccgtacacttcgtacgtgggtacnctactccgagggcgaaccgggcctacgtgaccgtacctacccgagtaccggtaggtcctaaggtcggacgtaggggtcggtgtacgggaactcgtacttcacgtcgtcctacgtcacgcgtaagccgtaggtacgtccgtaaggtaactttcggttcacgttacgtagttttacgtaacgttgtaacncgttagtacggttaagccgggtacgaccttaacgttacgtttacgttcgggaaccggtacgtaccggagtgtaggactacgtaacagttacgnggtactcgacgtaccgtaacngttctacgtcgttac

SEQ ID NO: 134551 - DNA, 698 bp, Homo sapiens
  misc_feature: GYAE6OF01BJ4BL.16.71.G05.1.454.CMB.1.raw
  modified_base (201)..(201): a, c, t, g, unknown or other
  misc_feature (201)..(201): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctccagataccaccggagaaattgtgttgacgcagtctccaggcaccctgtctttgtctccgagggaaancgccaccctctctcgcacgggccagtcagagtgttaccagcgagtacttagcctggtaccagcaagaaaccgtcggacctcggcctccgacggtcctcctacatactagtggtcnctacnccagcgacggccacgtcggacctacgtacccgagtaccgtacggttcgaaggtcggtacgtacgggtcgggtacgtacggggaactaggtaaccttaccgacccttaccttacccgaacccttcgacgaccgtacggtacgtacgggacgtacccgttaaggtaaacgtttacgtttacgacgttaagttacggtttaattaccgtagtaccgtaacggtataaggttacgggttaggtaaccggttcttaaccgttaaccgtttacggtttacgggacccggtaacgggaccgacgttacggacgtaagtaccgtaaccgtaaacgtacggtcggtacgtacctacggtaccacttacgttctccgttcttaaccg

SEQ ID NO: 134552 - DNA, 676 bp, Homo sapiens
  misc_feature: GYAE6OF01D3TM9.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttcttgtggcttattttaaaaggtgtccagtgtgaggtgcagctgttggagtcgtgggggaggcttggcacaggccgtggggggtccctgacgactctcctgtgcacgcctcgtggtacttcctacctttgactagcttatcgccatcggaccgtcggggtcccgccgacggccgtaccggaaggggaacggggcgtagggaagttgggtctacgtaggttacgttacgtgggttggttaggtttaactaaccactaacgtacgtacgcgaagtaccgtaccggtacgggaacgggtcccgttacacctatcctaccgagaacgtaactaacttacccaaagaaccactacttagtactacgtacgaactaaagtagaacacggtacctaggaacgtacgaccccggaacgaacccgaaccgaacctaatttaacgttaacgttaactaggtaccggaacggaaaccggtacccgaccgggtaactaggttaaccgtacccaaccccttaaacg

SEQ ID NO: 134553 - DNA, 699 bp, Homo sapiens
  misc_feature: GYAE6OF01BNQAF.16.71.G05.1.454.CMB.1.raw
  modified_base (689)..(689): a, c, t, g, unknown or other
  misc_feature (689)..(689): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttcttgtggcttaattttaaaggtgtccagtgtgaggtgcagctgttggagtcgtgggggagtcgttggcacgacggccggtcggggggtcccctggacgactccgtccgtgtgcacgtcctcgtggtacttcctacctttgaacagtctagtcgcctagtcgaccgtcgggtcccgccgacggtccgtaccggaaggggacgggtcgtagggaagtcgggtcctacgtaggttacgttacggtggggttggtagtttactaaccgtacgtaacttaccgtaacgcgtaacgtaccgttaccggtacggggaaccgggttccccggtttacaaccccgtagtttcccgtaacccgaaggtaaccgaaaccttaaacgttaccccgaaaaggtaacccacttaacgttggtaactacgtacgaactaaacgtacgaacgtccgtacgaggtaacgacgtacccgaacggaccgacggtactaagttagtactcgtgaccgacgaaacgccgtaccggacttaggtacnccctcgtaac

SEQ ID NO: 134554 - DNA, 689 bp, Homo sapiens
  misc_feature: GYAE6OF01CY6DD.16.71.G05.1.454.CMB.1.raw
  modified_base (200)..(200): a, c, t, g, unknown or other
  misc_feature (200)..(200): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
tcagtgtactactccacgaccggtgctcgatttagtgtcgtcgcaagagagagggggagagctgctcagttaggaccagagggaaccatggaaaccccagcgcagcttctcttcctcctgctactctggctcccagatacccacggagaaattgtgttgacgcagtctccaggcacctgttcttgtctcgaaggggaaancgccacctctcctgcgagggccagtcgagtgtcgttaccagcgaggttacttgcctacggtaccagacaacgaaaccgtcggccgtcgcctcccgagtcctcctcattctagtggtncacnccgagcgacggcctcgtgcactcccgagtacgtacgttcgcggtcggacgtaggtcgggtcgtagggacagttaccttcgaccttcgtaccctaccgtcgacgtaccgaacgtacgtacgggtacgtaccggttaggtaacgttagttttacggacgtttagggttacgtttacgtttaaccgtgttaccgagtacgttaagggttgggttaacgggtacggtaccttaaccggtttcgttaacggtttcggaaccggtacgggtacgaaccggtcgtaggtaacgtaacgtaaacggaaacggttaaggtcggttaaccggtgtaaccgtaccgttaaccgtggtttacttcggttactttaacccg

SEQ ID NO: 134555 - DNA, 788 bp, Homo sapiens
  misc_feature: GYAE6OF01AH4OG.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggcctccagataccaccggagtaaattgtgttgacgcagtctccaggccaccctgtctttgtcctccgaaggggaaagacgcccaccctctcctgcgacgggccagtcagtgtacgtaccagctaggttacttacgccgtggtaccagacgaacgaaccgtcggccgtcggtcctacccgaggtcccttccgtactactccgtagtcgggtcactaccgtccgaggtaccggacggaccctaacgtccgaacctaccgtacccgacgtaaccggtcggttaccgacggtacggacgtagggttaccggggttacgtaacgggtaaaccgtacggttaaccccgtttccgaaccccgtttacccgtaccccgtaaccccgttacgaaaccggggtcccgtaaacgggtaccggttcggggtaaccgtcccggtttaaagggtaaaccgttttagtttaccggacgtaagggtttccttaacgggttactttacggacgtacgtacggttagggttacggttaacgggtaccgttacctaaccgttttacggttaccggttacgggaccggtaacgggacctaggtccggtaacgaataccgaaaggtaaccgttggtccggacgtcgaccgtaacctacttggtccgttagtcccttaccg

SEQ ID NO: 134556 - DNA, 621 bp, Homo sapiens
  misc_feature: GYAE6OF01DLO3F.16.71.G05.1.454.CMB.1.raw
  modified_base (200)..(200): a, c, t, g, unknown or other
  misc_feature (200)..(200): n is a, c, g, or t
  modified_base (299)..(299): a, c, t, g, unknown or other
  misc_feature (299)..(299): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctccagataccacggagaaattgtgttgacgcagtctccaggcaccctgtctttgtctccaggggaaanacgccacctctcctgcagggccagtcagagtgttaccagctaggtactagcctggtaccagcaagaacctgctgctccaggcctcgcatctagtggtcncgatccgagcgaacgggccagtcggactacgtacccaggaccgtaaggttcaggtcggactagggtcgggtcgtacggactacggtacttcgactcgtccaccctgacgctacgtcgtaggactccgtagaacgttatttcgatagttgttaactacgtgtaccagtacgtaagttacggtcggtaacggtccctaacggtttcttacggtttacggaccgtaacggggacctacgggtacgtaggtaacgaaacgttaccggaaagttaacggtcggttacgacgtacgtaccctacgttaattccgtacggttcttaccg

SEQ ID NO: 134557 - DNA, 711 bp, Homo sapiens
  misc_feature: GYAE6OF01EEMO7.16.71.G05.1.454.CMB.1.raw
  modified_base (204)..(204): a, c, t, g, unknown or other
  misc_feature (204)..(204): n is a, c, g, or t
  modified_base (680)..(680): a, c, t, g, unknown or other
  misc_feature (680)..(680): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggccaccctgtctttgtcctccgaggggaaancgcccaccctctcctgccagggccagtcagtagttcgttacccagcgtaggtacttacgccgtacggtaccagcaacgaaacctggacctcggccctcccgacggtcctcctactactccgttatcgggtctaccgaccttccgacggtaccgtaccggggtccctaacgtcgggaccctaactcccgaacggtaccgtacggttccgaggtcggtacggtaggttcgggtcgtacggggaacgtaccgtacctttcccgaccgttcctacccgtacccgttacgacgtaccgaacgtacgtacgggacgtacccgttaaggaagtttacgtttcggacgttacgggttatttacgttaacgtcgtaccgtagtacgtaggttaggtacggtacggtaccttaccgttagttccggttacggacgtaacgggacctaggtacgtaggaactacgtaacgaacgttagtcggacgtntaccggctaacctgtccgttgccgttacccg

SEQ ID NO: 134558 - DNA, 657 bp, Homo sapiens
  misc_feature: GYAE6OF01BUAFH.16.71.G05.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
tcagtgtactactccacgaccggtgctcgatttagtgtcgtcgcaagagagagggggagagctgctcagttaggacccagagggaaccatggaaaccccagcgcagcttctcttcctcctactactctggctcccagataccaccggagaaattgtgttgacgcagtctccaggcaccctgtctttgtctccgaggggaaangccaccctctcctgcgagggccagtcagagtgttaccagcaggtactagcctggtaccagcagaaacctggcctggcctccaggcctcctcatcctatcggtncactccgagcgacgggccagtcggcactcccgagaccgtaggttcaggtggctagggttgggtctagggaccaggtacttcacctctccaccctgagccagtacgtgagcccgtagaacgtagtttcgacgtagttacgttagttacgtgtcgacgtacgtagttacgttagggtacggtaccgttaacccgtttaccggttaaccgtttttaccgggaacccgggtaacgggtaacccgtaaggtaccggtacggtacggtaacgtaaacccggtaaacggtaacgttacgggttcggtaccgtacggaccctaaccgttacgttacccgttcgttccgttacgttacccg

SEQ ID NO: 134559 - DNA, 806 bp, Homo sapiens
  misc_feature: GYAE6OF01BND01.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggcctccagactacccgaccggagtaattgtgttagacgctagtcctccgacggcctacccgttgtttcctttcgtccgtaccggaaagggggaaaactaccgcccctaccccgttcctacccgtcggaccgtacggggaccctagtaccgaggtacgttaccgttaaccagccgtaaggttacttacggccgtaggtaccagccgaacggtaaaccgtcggcccgtcggtccctacccgacggtccttcccgtctacttcgttacgtcggtcgcctaactccgagccggacggaccctactacgaacctacctcccggaagtaccgtacggtcgaggtacgcggtagggttcggtcgtacgggactagtaccttaccgacgtcctaccgacccttacgacgacacggtacggtaggtacgtccgtaagtaacgttacgttacgaccgttaggttactttaacgttacgtcgtaacgacgtaacgtaagggttacggtacggggtaccgttaaccttaacccggtttaaccgtttaccgggtttaccggacccggggtaacggtaacccgtaggtacgtaacgggtaactaacggtaacccgtaaaaccgttcggtacggtacccggtcgtaaccggtcccttaaaacttccgggtttactttccggttcttaacccg

SEQ ID NO: 134560 - DNA, 724 bp, Homo sapiens
  misc_feature: GYAE6OF01EGZCB.16.71.G05.1.454.CMB.1.raw
tcagtgtactactccacgaccggtgctcgatttagtgtcgtcgcaagagagagggggagctctgagagaggagcccagccctgggtattttcaggttgtttttcattttggtgatcaggactgaacagagagaactcaccatggagtctgggctgagcgtggtctttttcttgtggtcttaattttaaaaggtgtccagtgtgaggtgcagctggttggagtcggtgggggaggcgttggcacgacggccggtcgggggtccctgacgactctcctgtgcacgcctcgtgtacttctacctttgacagtctatcgacctagtcggtacccgttcgggtcccgccgacgggcctaccgggaagggggaacgggtcgtagggtaacggttgggtacctcggtaaggttaactttacgggttgggttacgggttagggtttaacctaacccgtaactaacgttaacccgtacgacgtaacgtacccgttaccgggtacgggaacgggtccccggtttaccaaccgtacgttccctaaccgaagtaacgtaactaaaccgttaacccgaaacgtaaaccctaacttaacgtacgttaacgtactaacgaactaaagtaccgaaacgtacgtccgtaaggacgacggaccgaaccgaaccgaccgtactatacttacgttactagacgaacgaacgccgtaacgtaccgtaagttaccacctacctaac

SEQ ID NO: 134561 - DNA, 640 bp, Homo sapiens
  misc_feature: GYAE6OF01AVHOE.16.71.G05.1.454.CMB.1.raw
  modified_base (203)..(203): a, c, t, g, unknown or other
  misc_feature (203)..(203): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccgaggccaccctgttcttgtctccgaaggggaancgcccacctctcctgcgacgggccagtcagtagttcgttaccagccgtaggttacttacgccgtacggtaccagaccgaacgaacccgtcggtcctacgggccctacccgacggtcctcctctacgttactagtcggtacgcctacgtccgaggcgacggtccacgtcgacaccgtccgagtacgtacggttcgaggtcggacgtagggtcggtacgacggaactacggtaccttacgtacctacctacccacctacgacgcgacgtacgtggacgtcgtagtaagtttcgttcgacgttagtcgtttaactcgtagtacaggtacgtaggtaggtcggtacggtcttaacgttacgttacggttacggacggtacggactagcgtaggaactagtaacacggtgtcgtacgatccgaactcgtattctgttctacg

SEQ ID NO: 134562 - DNA, 617 bp, Homo sapiens
  misc_feature: GYAE6OF01DQJFN.16.71.G05.1.454.CMB.1.raw
  modified_base (147)..(147): a, c, t, g, unknown or other
  misc_feature (147)..(147): n is a, c, g, or t
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctgctccagataccaccgganaaattgtgttgacgcagtctccaggccacccttgtctttgtctccgaaggggaaancgcccaccctctacctgcagggtccagtcagtntcgttaccagcaggtctagcctgtaccancagaacngctgctccngcnctntatctatgtncatcagcaggcactgctactccgagactagtcacgtgcgtaggtcggtccgtaggactacggtacttacgtacgtccttccacccgtcgaacgtacgacgtaccgttacgacgtaccgtagtaaggttactttgaactaggtttagttactttcgtagtaccgtagacgtagttacggtcggtacgggtacccttaacgtttacctacggttttacggacccggtaacgggacctaaacggtccggtaagaacgtaaacgtacggtaaacgtacgttacggcggtagtccgtactactacgttcgtaagttcgtttaccc

SEQ ID NO: 134563 - DNA, 556 bp, Homo sapiens
  misc_feature: GYAE6OF01EKO9P.16.71.G05.1.454.CMB.1.raw
  modified_base (304)..(304): a, c, t, g, unknown or other
  misc_feature (304)..(304): n is a, c, g, or t
  modified_base (382)..(382): a, c, t, g, unknown or other
  misc_feature (382)..(382): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtgttaccagcaggtacttagcctggtaccagcagaacctggcctggctccaggctcctcatctatggtgcanccagcaggccactgcatcccagacaggttcagtggacaggttgggtctgggacaggacttcgacctcgtaccaccctnagcagtactggacgtcctagtaagtattttgacgagttgttaattacgtgtacagtcgaggttatgggtaacgggcctaaccgtttacgtacgttttaggccgtagggaccgaagcgtaggacgacgtacgaaacgacgttacgcggtctgacctaactatcgtgttcgttacg

SEQ ID NO: 134564 - DNA, 679 bp, Homo sapiens
  misc_feature: GYAE6OF01D7X1I.16.71.G05.1.454.CMB.1.raw
  modified_base (605)..(605): a, c, t, g, unknown or other
  misc_feature (605)..(605): n is a, c, g, or t
  modified_base (634)..(634): a, c, t, g, unknown or other
  misc_feature (634)..(634): n is a, c, g, or t
tcagtgtactactccacgaccggtgctcgatttagtgtcgtcgcaagagagagggggagctctgagagaggagcccagccctgggtattttccaggttgttttcatttggtgatcaggactgaacagagagaactcaccatggagtctgggctgagctggtctttttcttgtggcttaattttaaaaggtgttcagtgtgaggtgcagctgtggagtcgtgggggagcgttggcacacgccgttcggggggtccctgagtacctctcctgtgcaggccctctggtacttctacctttagactagtctaacgtggaccctagtccgtaccggtcgggtccccgaccgacggccgtcccgaagggggaacggggtccgttagggaaaggttcgggtctacgtaggttagttaacgtggggttcggttaggtttactaaaccgaactacgttaacccgtacggacgtaacgtaccgttccggtaacgggaaccgggtccgttaccacccgtatccctacccgaagaacgtaactaacgttacccaaagaaccacctactatacgttatacggactaaatcgaacgacgtccgtagacgagacccgaanaaccgtacgaccctataacgttattacgngtcggaacgaagacccgtacgaccttagtacctacctccgtaaac

SEQ ID NO: 134565 - DNA, 686 bp, Homo sapiens
  misc_feature: GYAE6OF01CHJBN.16.71.G05.1.454.CMB.1.raw
  modified_base (170)..(170): a, c, t, g, unknown or other
  misc_feature (170)..(170): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctcccagataccaccggagaaattgtgttgacgcagtcnccaggcaccctgtcttgctccgagggaangccaccctntcctgcaggccagtcagagtgttaccagcaggttactagctggtaccagcagaacctgcctggctccagctcctnactctagtggtncactccgagcgacggtccacgtcggctacgtaccgagaacgtacggtcacggtggacgtaggttcgggtacgtacgggtaacacggtaccttctacgtcccgtcccgaaccctcgaaccgacgtacggtaaccgtcggaacgtacccgttaaggtaacgttacgtttacgacgttaggttacttaacgttaccgttagtaccgtaaggaccttaagggttacgttaagggggttaccgtaacccttaaccgttacgtttaacggttttacccgggaaccggacggggtaaaccctacgggtacgtagggtaaccgtaacgtaacggtaaacggtacggttcggtacgtaccgtacggtacctaacgttataccgtttacgtccgttaaccc

SEQ ID NO: 134566 - DNA, 721 bp, Homo sapiens
  misc_feature: GYAE6OF01EPCSI.16.71.G05.1.454.CMB.1.raw
tcagtgtactactccacgaccggtgctcgatttagtgtcgtcgcaagagagagggggagagctgctcagttaggacccagagggaaccatggaaccccagcgcagcttctcttcctcctgctactctggcctccagataccacggagaaattgtgttgacgctagtctccgaggcaccctgttctttgtcctccgaggggaaagcgccctaccctctcctgccagggccagtcagagttcgtaccagctaggttacttagccgttaggtacccaggacaaacggtaaacccgtcgggtaccgtcggtccgtccccgacggtccttaccttccattcgttaactgggtcgctactcgacgccgacgggccctacgttcgggaccacttaccccgagaacgggtacgttaccgaaggtgggaccgtaggggttcggggtccgtaggggtaaccacggttaacctttccaaccctttccgtacccctacccgtagcgtaccgacggtacgttcgggaacgttaccgtacgtaacgttacgtttgaccgtttaggttacttacttacgtgtaccgtagtacgttaggtacgttgggaacggtccttaaccgttacgtacggttttcgggaccggtaaggggtaccaaggtacgtaacgggaaagtcgttaaccggaaagttccgtggtacgaccgtgaccccgtatacgttactcgtcttacccg

SEQ ID NO: 134567 - DNA, 685 bp, Homo sapiens
  misc_feature: GYAE6OF01BQRIR.16.71.G05.1.454.CMB.1.raw
  modified_base (198)..(198): a, c, t, g, unknown or other
  misc_feature (198)..(198): n is a, c, g, or t
  modified_base (445)..(445): a, c, t, g, unknown or other
  misc_feature (445)..(445): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccacggagaattgtgttgacgcagtctccaggcaccctgtctttgtctccgagggaancgcccacctctcctgcgagggccagtcagtagtcgttaccagacgtaggttactacgccgttaggtaccagacaacggaaaccgtcgggtccctcggcccttacccgaggtcctacctcacttactagtcggtcgtacctactccgaggccgacgggcctacgtcggaccacctacccgagtacgtcggtacgaggtcgcgtagggttacggcgtacgggactacgtactacactcctaccacctanacacgagtacgagacgtacgtagtaacgttctttagacgtagttacgttacttacgttacgtacagtacggtaagtacggttacgggttaccggtaacccttaccgttacgttacggtttaccggaccgggtacgggaacctagggtacggttacggaaacgtacggtaaccggtaaacgttacggtacggtaccgtacgttaccgtactaccgttaagtttcccttaggttccttaccg

SEQ ID NO: 134568 - DNA, 715 bp, Homo sapiens
  misc_feature: GYAE6OF01B7R9D.16.71.G05.1.454.CMB.1.raw
  modified_base (204)..(204): a, c, t, g, unknown or other
  misc_feature (204)..(204): n is a, c, g, or t
  modified_base (274)..(274): a, c, t, g, unknown or other
  misc_feature (274)..(274): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaaccatggagtctgggctgagcgtggtcttttcttggtgtcttaattttaaaaggtgtcagtgtgacggtncagctgttggagtcgtgggggagcgttggccacacgccggtgggggtcctggagacctctcctgtcgacncgcctcgtaggacttccacctttgactagtcgtaattcggcctacgtcgtaccggttcggcccgccgaggtcccgtcggaaggggaacggggtctagggaagtcgggtctacggtaggttactttacggtgggtcggtttaggtttaacctaaccgacttaaacgtaccgttaaaccggccaagggttaccccgtcgggttaacggggtaaccggttcccggtaacctaaccgtaccttacctacccgtaagtaacggaacctaacgttaaccgaaacctaaactaacctaaccgttagtacctacgtacaacgtaaacttagaaccgtacgtacgtaggaaccgacgtacccgaacgtaccgacggtactaaccccgtagttaaccttacgtacggtagaccgtaaacgccgtacgtactacgtacgtaccacgtaaccg

SEQ ID NO: 134569 - DNA, 750 bp, Homo sapiens
  misc_feature: GYAE6OF01C0G44.16.71.G05.1.454.CMB.1.raw
  modified_base (232)..(232): a, c, t, g, unknown or other
  misc_feature (232)..(232): n is a, c, g, or t
  modified_base (619)..(619): a, c, t, g, unknown or other
  misc_feature (619)..(619): n is a, c, g, or t
  modified_base (654)..(654): a, c, t, g, unknown or other
  misc_feature (654)..(654): n is a, c, g, or t
  modified_base (718)..(718): a, c, t, g, unknown or other
  misc_feature (718)..(718): n is a, c, g, or t
tcagtgtactactccacgaccggtgctcgatttagtgtcgtcgcaagagagaggggagagctgctcagttaggacccagagggaaccataggaaaccccagcgcagcttctcttcctcctgctactctggcctacccagactaccaccggaagtaaattgtgttcgacgacagtcctaccaggccacccttgtcttgtcctaccgaagggaacgcgccctaccctcttccgngaccgacgggccaggtccaggtacgttacgttaccaggtcctaaggttaccttacggaccgtacggtaacccaggacctaacggtaaaccccgtggtacccttcggtacccttaccccggaaggttccctacccgttacctaagttaccgttacggtacgggttcaacctaccgttacccggacgtaccggaaccgggtacaccggtttacgaacctaccgtaccccgtaaggaaccgtacggttacgacggtcggccgttagggtacggttccgaggtaaacgtaccgtactttccgacttcctaccaccgtccgagaccgtaacgtacgtcgggtactccgtagtataacgtttgaacttggtataccgttatacgtacgtacgngttaggtagtacgttccggtactaccgtttaacgngttacccggacgacggtacctaggtaccgtaggtactaacgtacggtactaacggtggtacccnctaaggtaccctacttagtcttcgtaccttac

SEQ ID NO: 134570 - DNA, 795 bp, Homo sapiens
  misc_feature: GYAE6OF01EXJFS.16.71.G05.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgttctttgtctaccgaggggaaangcccaccctntcctgccagggccagtcagtgtcttaaccagctaggtactagcctggtaccagcaagaacctggcctggcctcccgaggtctcctcattctagtggtcgctactccgagccggaacgggtcccaacgtcggtaccacgtacccgaacgtacgtacggttacgaggtcgggtacgtacgggttcgggtacgtacggggtaactaacggttaccctttaccgaccttacccgttacccgaaccccgtttacgaaccgggtaacccgtaacggttaacccggttacgggtaaccgttacccggttaaggttaaaccgtttaggtttttaccggacgtttaacgggtttacgtttaacgtttaccgttaacgggttaccgtaacggttaaccggtaagtttacgggttaacgggtaaccgggttacccttaaccgtttaaccgttaccggttttaccgggaccggttaaccgggggtaaaccgtaacggtacggtacggaacgttaacggtaaacccgttaaaaggtacgttacggtacggtcgtacccgtaacgaaccgtagttccgttacgttccgttaaccg

SEQ ID NO: 134571 - DNA, 656 bp, Homo sapiens
  misc_feature: GYAE6OF01AOL9Z.16.71.G05.1.454.CMB.1.raw
  modified_base (279)..(279): a, c, t, g, unknown or other
  misc_feature (279)..(279): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactcgtggcctcccagactaccaccggagtaaattgtgttgacgcagtctccaggcctaccctgttctttgtctaccgagggaagacgccaccctctcctgcgaggccagtcagagtcgtaccagcagtactacgcgtgacagcaagaacctgccngcctccagtcctctcntctagtgngcactaccgagcgacggcctacgtacgacacctaccgaagtacgtcggtcgaggtcggacgtaggtcgggtcacgggactacgtaccttcgacctccgtaccaccgtacgacgacgtacgtacgtacggacgtaccgtagtaacgttcgtttacgagtacgtttactacgttacgttcggtactaggtactaaggttacggtcggggtaaccgtaccttaaccgtttaccgttaccgggtttaccggacgggtaacgggaccttacggtacggttaggtaacgtaacgtacccgaaacgttacggtcgtacggtactacggtacctacctacgttcgttacgttccgttaccg

SEQ ID NO: 134572 - DNA, 846 bp, Homo sapiens
  misc_feature: GYAE6OF01BAA3Q.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttcttgtggtcttaattttaaaaggtgtcctagtgtgaggtgcagctggttggagtcggtgggggaggtcgttggcacgaggtcccggttcgggggggtcccctggacgtacttccgtccgttggtcgcacgtccctcgtggtactttccgtacctttcgaactagtctacgtcgacctagtcgtacccggtcgggtccccgaccgacggccgtacccgggaagggggtaacgggtcgtagggtaacgttcgggtaccgttacggtaaggttaacgtttacgggttcggggtttacgggttacggttttaaccgtaaccccgttaacgtaacttaacccgtaaccggtaccgtaaacggtacccgttaccgggtaacggggtaaccgggttcccccgggtttaaccaacccgtaccttaccgtaaccccgaaggtaaccgaaccttaaaccgttacccgaaaacgtaaaccctaacgtacgttacgttaaccgttagtaaccgtaaactaaacgtaaccggtaaaccacgggttaaccccgttaggaaaccggtacccggaaccccggaacccggtaaccgaaccccgtaccgtaaacttacgttaacgtttaccgaggttaccgaaacggtaaccgacccgtaaccggtacgtaacgttaaccgtcccctaaacgttaaaccc

SEQ ID NO: 134573 - DNA, 741 bp, Homo sapiens
  misc_feature: GYAE6OF01DLAH2.16.71.G05.1.454.CMB.1.raw
  modified_base (103)..(103): a, c, t, g, unknown or other
  misc_feature (103)..(103): n is a, c, g, or t
  modified_base (213)..(213): a, c, t, g, unknown or other
  misc_feature (213)..(213): n is a, c, g, or t
  modified_base (605)..(605): a, c, t, g, unknown or other
  misc_feature (605)..(605): n is a, c, g, or t
tcagtgtactactccacgaccggtgctcgatttagtgtcgtcgcaagagagagggggagagctgctcagttaggacccagagggaaccatggaaaccccagcncagcttctcttcctcctgctactctggctcccagatacccaccggaagtaaattgtgttgacgctagtcctccgaggcctacccgtgtctttgctaccgaagggggaaancgccctacctctccgtagcgacggggccagtcaggtacgtacgttaccagcgtaacggttacttagcccgtaggtaccgaagaccgtaacgaaaccgtggtacctacgggaccctaccggacggtccctcctacacgtttcctaagttgggtctacgacctacgacgtacggacggccaacgtcgactacctacccgaaggtacgtacgttcacggttcggacgtagggttggtaccggtaggtaacgtaacgtccttactaccgttcctacccctaaaccgtcgaacgtacgttaacggacggttaggacctaacccggtaaggttaaacgtttacgtttcgaccgttaagttacggtttaacttaccgtagtacctaggtactacggtanacgggttacggaccttaacggttacttacggttggaaccggtacgtaagaccgttaggacgtacaacgtaacccgtaaagggacttccggagtacccttaacgccgtaacttaccggttctacgtttcggtaaacc

SEQ ID NO: 134574 - DNA, 664 bp, Homo sapiens
  misc_feature: GYAE6OF01CD3OF.16.71.G05.1.454.CMB.1.raw
  modified_base (203)..(203): a, c, t, g, unknown or other
  misc_feature (203)..(203): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaaggggaaangcccaccctctcctgcagggccagtcagagtcgtaccagcaggtacttgcctggtaccagcaagaacctggcctggcctccgagtcctcctcactctagtggtgcatccgagccgacgggccacgtgaacctactcccgaagacgtaggttcaggtcggactagggttcggtcgtagggaactacggtaccttcgaccttctacccacccttagacgtaccaggtaccgtcggacgtccgtagtaacgttcgtttacgacgttaggtttacgttaacgtttacgtcggtactaacggtacgtaacggttaggttacggggtaacgtacccttaaccgtttaccgttacggttttcgggaacccggtaacggggtaacctaaggtccggtaacgggaactacgtaaccgtaaacgtacgttggtacggtcttacgactacctagttcgtcgttccgttaccg

SEQ ID NO: 134575 - DNA, 821 bp, Homo sapiens
  misc_feature: GYAE6OF01CLAUU.16.71.G05.1.454.CMB.1.raw
  modified_base (204)..(204): a, c, t, g, unknown or other
  misc_feature (204)..(204): n is a, c, g, or t
tcagtgtactactccacgaccggtgctcgattttagtgtcgtcgcaagagagagggggagagctgctcagttaggacccagagggaaccatggaaaccccagcgcagcttctcttcctcctgctactctggctcccagataccaccggagaattgtgttgacgcagtctccaggccaccctgtctttgtctaccgaggggaaancgcccacctctcctgccgagggccagtcagtagtcgttaccgagcgtaggttacttacgcctggtaccagacaacgaaccgtcggcctcggcctacccgaggtcctcctactactctagtcggtcgactactccgagccggacggcctacgtcggaccactcccgagtacgtacggttcgaggtcggcgtacgggttcgggtcgtacgggtaactacggtaccttaccgtacctcctacccgtacccgtcgtacgaccgtaacgtaccggtacggtaccgtaccgttaagttaacggttacgttttacggaccgtttaacgggtttacgtttaaccgtttacgtaccgtacgtaacggttaccggttaaggttacgggttaacggggttaacccgtaccgtttaaccccgtttacggtttaccggtttaaccggggtaacccgggtaacggggtaaaccgttaaccgggtacggttaaacggggaacgttaaacccggttaaaccgtaaaaccgggtttaaccggtaccggggttaaccgggtacccgttaaaccggtaccccggtttaaacccgttaccgttttaccggttttcccggtttaaccgttttaccccg

SEQ ID NO: 134576 - DNA, 751 bp, Homo sapiens
  misc_feature: GYAE6OF01C6V2H.16.71.G05.1.454.CMB.1.raw
  modified_base (176)..(176): a, c, t, g, unknown or other
  misc_feature (176)..(176): n is a, c, g, or t
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (448)..(448): a, c, t, g, unknown or other
  misc_feature (448)..(448): n is a, c, g, or t
  modified_base (716)..(716): a, c, t, g, unknown or other
  misc_feature (716)..(716): n is a, c, g, or t
  modified_base (732)..(732): a, c, t, g, unknown or other
  misc_feature (732)..(732): n is a, c, g, or t
  modified_base (740)..(740): a, c, t, g, unknown or other
  misc_feature (740)..(740): n is a, c, g, or t
tcagtgtactactccacgaccggtgctcgatttagtgtcgtcgcaagagagagggggagagctgctcagttaggacccagagggaaccatggaaaccccagcgcagtcttctctttcctcctgcttactctggctcccagactacccgaccggaataattgtgttgacgcagttcnccaggccaccttgttctttcgtctccggaaggggtaaacncgcccctaccctcttccncgcgaggaccagtcagtgtcgttaccagctaaggtacttacgccgtgtaaccagacctacggaaccgttcggaccgtcgaccctacccgacggtccttcccttacgtacttacgtacggttacggtacctacgtaccgtaccgaacggaccggacggtacccgtacgtacgggtacccttaacgaccccgaacgtaaccgtacgggtttaccgnggtacgggtccgtttaaggggtccgggttacggtaggaccgttacggttaacccttcttaacccgtccgtaccttcccgacgtcgaacgttacgtaccggtacggtacgtacgtaggttaacgtttactttggacgttagttactttacggtttacacgttacgaggttactaacggtttgggtacgttacggtacccttacgtttcgttacgttccgggtacgacggtacgaacgtcgtaggacgtacgaaactaacggttacggtncgtgaccacgttaacngtttaccncgttctaaccg

SEQ ID NO: 134577 - DNA, 1035 bp, Homo sapiens
  misc_feature: GYAE6OF01COMVB.16.71.G05.1.454.CMB.1.raw
  modified_base (157)..(157): a, c, t, g, unknown or other
  misc_feature (157)..(157): n is a, c, g, or t
tcagtgtactactccacgaccggtgctcgatttagtgtcgtcgcaagagagagggggagctctgagagaggacgcccagcccgtgggattttcaggttgttttctatttggtgatcaggactgaacagagagaactcaccagtggagtcgtggctgngtcgttgttctttttcgttggtggtacttaaagttttaaaggtgtacctaggtgtggtaggtgctagtgttggtggagtcggtaggggagtcgttaggacacgtacggtccggtcgggggtaccctaggacgtccttccgttccgttggtcgaccgtaccgttccgttcgtacggtaacctttttacccgttaacccgttttagaaccgtaacgtccgttagtccgtacgtaccgtttacgggtaccccggttccggggtccccggacccggtaacggggtcccggtaaccgggggtaaacgggggggtaaccggggtaaccgggttagggtaaagggttccggggttaaccctttacggggttaacggttttaacggtttacccgggtttaggggggttttcgggttaaaccggtttttaaaccaaccccggttaaacgtaacgtttaaccccggttaacggaaacccgtaacgggttcccggtttaacccgggttaaaggggtaaccccggggttacccgggtttaccctaaaccccggttacgtaccccgttaaccgaaacggaaaccgttaaaaccgttaaacccgtttaccgaaaaaaccgtaaacccgtaccgtaaccgtttacggttaacttaaccggtaacctaaacgtaaacgttaaacggtacccggtaaccgtacggtaccgggaaacgtaaccggtacggtaaaccgtaccggaaaccccggttaaccgtaacccgttaaacgtttaacgttttaacgtttaacccgtaacggggtttaaccgaaaacccggggaaaacccgtccccggttaaaacccggggcgttttaaaacccggttaacccgtaaaccccgtttaaaccccgg

SEQ ID NO: 134578 - DNA, 886 bp, Homo sapiens
  misc_feature: GYAE6OF01BPSKW.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaattgtgttgacgcagtctccgaggccacccgttgttctttgtcctaccgaaggggaaagacgcccacccctctcctgcacgggccagtcagtagtcgttaccagcgaggtacttagccgtggtaacccgagacaacgaaacccgttcggcccgttggccctccccgaggtccctccttacattcctagtggtacgactaccgtccgagccggaacgggaccctaacgtcggaaccctacgttaccccgaagaccggtacggtttaccgagggttccggacggtacggggttcggggtacgtacggggaacctaacggttacctttaccaccgtttccctaccccgtaccccgttacgaacggtaccgtacggtaaccggttacgggaccggtaccgttacggtaaacggtttacgttttacggacgtttaacggttacgttttaaacggtttaccgttagtaccggtacgttacggtaaacgtttacggttacggggttaacccggttaccgtttaaaccccgtttaaccggttttaccgggtttttaacccgggggacccgggttaaaccgggggtaaacccgtaacgggggttaccggttaaacggggtaaaccggttaaacctaaacccgggttaaaaccggttaaccgggtttacgggttacggtaacccggtaccggtaacccgtaacccgtttaagtttccccggttaacgttttccccgtttaaccccg

SEQ ID NO: 134579 - DNA, 856 bp, Homo sapiens
  misc_feature: GYAE6OF01CF9KT.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttctgtggctatttaaaggtgtccagtgtgaggtgcagctgtggagtcgtggggagcttggcagagccggtcgggggtcctggacgtactcttcgtgtcgcgacgtccgtcgtggtactttccgtaacctttgacctacgtctaagtcgacctagttaccggtacccggttccgggtaccccgccggacggtacccgtaccgggaaggggaaccggggtcgttacggggtaaggttccgggttacgtaaccggttaaggttaacgtttaaccgggttcggggtttagggttaacgggtttaacctaacccgtaacttaacgttaacccgttacggaaccgtaacggtacccgtttaccgggtacgggtaacccggggttcccgtttaccgaaacccgttacgttaccccgtaacgtaaggtaaaccgaaaccgttaaacgttaaaccccggtaaaacgaaaccctaacccgttaaccgttaagtttaaccgtaaccgttaacggtaaacgtaaaacgttaacggaaacccggtaccgtaaccgtacgaaacgggaccaccggaaaccgtaccgaccccgggttaacttaacgtaacgtttaaccttaggttaacggtaccgaaacggaaacccggtacccggaaacggttacgtaaccggttttacccgtaacccgtaaacccgtttaaacccg

SEQ ID NO: 134580 - DNA, 609 bp, Homo sapiens
  misc_feature: GYAE6OF01D8HZO.16.71.G05.1.454.CMB.1.raw
  modified_base (131)..(131): a, c, t, g, unknown or other
  misc_feature (131)..(131): n is a, c, g, or t
  modified_base (135)..(135): a, c, t, g, unknown or other
  misc_feature (135)..(135): n is a, c, g, or t
  modified_base (167)..(167): a, c, t, g, unknown or other
  misc_feature (167)..(167): n is a, c, g, or t
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (203)..(204): a, c, t, g, unknown or other
  misc_feature (203)..(204): n is a, c, g, or t
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (436)..(436): a, c, t, g, unknown or other
  misc_feature (436)..(436): n is a, c, g, or t
  modified_base (475)..(475): a, c, t, g, unknown or other
  misc_feature (475)..(475): n is a, c, g, or t
tcagtgtactactccacgaccggtgctcgatttagtgtcgtcgcaagagagagggggagctctgagagaggacgcccagccctggggtatttttcagggttgtttttctattttggtgatcaggactgaanaganagaactcacatggagtctgggctgagcgtgtntttntagtgtctaagtttaaagtntcgatgtgaggnnagngtgtgatggngggagtctcgnagcgcgttggggcnganctcnctntgctagtctgatcttacacgttcaanagtctatcncgctgtacggttccggtccggtccgacggtaccgccggtacgggagggtacgtaggaacggtaggtctacgtagttacgttacggtggttggttggttaagtactactacgttacacgtcgtacgacgtaccagtaacggtccggtacnctactcacgacgagtaataactacaacaacactacgtanctactagacagaactacgaacgacgacgcgaacgacgtaaccgacgaccggtatacgtactttaacctagttaggttacggaacaaacggaccgaccgtaacgttaccggtaaccgtaaccgtaccttaaaccg

SEQ ID NO: 134581 - DNA, 657 bp, Homo sapiens
  misc_feature: GYAE6OF01DASFG.16.71.G05.1.454.CMB.1.raw
  modified_base (210)..(210): a, c, t, g, unknown or other
  misc_feature (210)..(210): n is a, c, g, or t
  modified_base (488)..(488): a, c, t, g, unknown or other
  misc_feature (488)..(488): n is a, c, g, or t
  modified_base (633)..(633): a, c, t, g, unknown or other
  misc_feature (633)..(633): n is a, c, g, or t
  modified_base (650)..(650): a, c, t, g, unknown or other
  misc_feature (650)..(650): n is a, c, g, or t
tcagtgtactactccacgaccggtgctcgattttagtgtcgtcgcaagagagagggggagagctgctcagttaggacccagagggaaccatggaaaccccagcgcagcttctcttcctcctgctactctggctccagatacccacggagtaattgtgttcgacgcagtctccgaggcctaccctgttctttgtcctaccgaaggggaaancgcccaccctctcctgcgacggcagtcaggtagttcttaccagctaggtacttcgcctaggtaccaggacaacggaaaccgtcggaccgtccggtcctcccgacggtcctccgtactctcttagtcggtcgacctacgtaccgacggtacgacgggacctacgtacgacctaaccgtcccgaacgtacgtacggttcgaggtcggacgtagggttcggtcgagggtacagtaccttctacttcctaccgtcctacgagaccgtacgtccgtaggtacnccggttaagtaacgttcgtttgaccgttgttacgtttaacttcgtggtactacggtactaggttaggcgggttacgacctttacgttacgttacgttacggaccgagggaccaggtcgagactagtaacgaagtcgtcggcgacncgtacacgtatccgttntccttcg

SEQ ID NO: 134582 - DNA, 682 bp, Homo sapiens
  misc_feature: GYAE6OF01AWBB7.16.71.G05.1.454.CMB.1.raw
  modified_base (220)..(220): a, c, t, g, unknown or other
  misc_feature (220)..(220): n is a, c, g, or t
  modified_base (262)..(262): a, c, t, g, unknown or other
  misc_feature (262)..(262): n is a, c, g, or t
  modified_base (317)..(317): a, c, t, g, unknown or other
  misc_feature (317)..(317): n is a, c, g, or t
  modified_base (677)..(677): a, c, t, g, unknown or other
  misc_feature (677)..(677): n is a, c, g, or t
  modified_base (679)..(681): a, c, t, g, unknown or other
  misc_feature (679)..(681): n is a, c, g, or t
tcagtgtactactccacgaccggtgctcgatttagtgtcgtcgcaagagagaggggtccctgagactctcctgtgcagcctctggattcacctttgacagctatgccatgacctgggtccgccaggctccaggggaaggggctggaatgggtctcaggtattactggtggtggttataccacatactacgcagactccgtgaagggccggttcaccatcnccagagacaattccaagacacactgtatctgacaaatgaacngcctgagcgcccgacgacgaccggccatatattactgtgacgaaagccgaccggntagttacgtccaccctataccttacgtttgactacggtcggggacctacggggtaaccctcggtccaacccgttcctccctacgaccgccccttacccgaaccgtaacggggccccctaagttccccgggttcccctttaccccccgtcggtacccctacccccgttaccccgtaccgaaaccggaccgtaccctaaccccgttccgggtccggggggacccaacgaccgggccccgggtacccggtcggggtccgttccggcccgtcgggtaacccgaacgggtaccttaccggttacccgacggttacgtacgtacgtggacggccggtacgcggacggacggcgacgacgtacgcancnnng

SEQ ID NO: 134583 - DNA, 885 bp, Homo sapiens
  misc_feature: GYAE6OF01DOA8K.16.71.G05.1.454.CMB.1.raw
  modified_base (140)..(140): a, c, t, g, unknown or other
  misc_feature (140)..(140): n is a, c, g, or t
  modified_base (815)..(815): a, c, t, g, unknown or other
  misc_feature (815)..(815): n is a, c, g, or t
tcagtgtactactccacgaccggtgctcgatttagtgtcgtcgcaagagagagggggagagctgctcagttacggacccaggagggaaccatacggaaaccccagcgcagtcttctcttcctcctgctactctcggtccncccaagtactacccgaaccgggtaagtaaatttggtgttacggaacgccgtaagttcctaccggaacggtccctaaccctttggtttactttccggtaccgtaccggggaaagggggtaaacgccgaccctaccccttctccggtcggacgacgggaccagttcgaggtacggttacttaccaagggtccgtaacgggttacttacggtacccgttaggtaacccaggaccgtaaacggtaacccgtcgggtacccgttcggacccttacccgaacggtcccttaacttcccgtaataccgttaaggtcgttaacgcctaccgtaaccggacgtccgggaacccgggtactaaccggttcggaaaccttccccggaacccggtagtaacggttccgtaggaccggttaggccggttaggggttacggttcgaaccgggtaactaaccggtcctttaccgtaaccgttccccttaaccaccggtaacgtacggaccgttaaccgggaccgttacggtaccggttacgtaaacgggtttaaacgtttaggttcgtaaaccggttagttttaccgttaaacctggttaccgtaggaacgttacgtagttacggtaacgggtaccgttacgttacccgtagtttaacccggtacgtacgggaaccgtacggtaaccggngttacggaaacttaacgacgtaaatcggtcctaacgtgacctacgacttaagtcttaaccgtcgttaacc

SEQ ID NO: 134584 - DNA, 911 bp, Homo sapiens
  misc_feature: GYAE6OF01BNNGH.16.71.G05.1.454.CMB.1.raw
tcagtgtactactccacgaccggtgctcgatttagtgtcgtcgcaagagagagggtgagagctgctcagttaggacccagagggaaccatacggaaaccccagcgcagcttctcttccctcctgctactcgtggctcccagactaccgacggagtaattgtgttgacgcacgtctccgacggcctacccttgttctttcgtccgtaccggaaagggggaaacgccgtacccgtaccccttcgtcccgtacggccgacggggtcctaacggttccgaaggtacgttacgttaaccgaggtaccggttaaggttaaccgtacggtaccggttacggtaaccgacgaaccgtaaaccggtaaaccgttccgggacccgttaccggtcccgttacccggaaccggttacccctttccctaaccggttactttaccgtaacgggttcgggtaaccttaccgtaacccggttacccgggacggttacccggaccccggggtacctaccggtacgggtcccctaaacccgttccccgaaaggtaccggttaccggttaggtacggggttacggtaccggttaacggggttccgggacgggttaaccggtaagacccgtttactttcccaccttccgtacccctacgtacccgtaggaacccgtaggttaccggacgggtacgaccgtttaaggtaacgttcgtttacgctttaaaccgttgggtttaaccttaaggtcggaaccttaggtacgtttacgggtacgttaacggggtcccttacttaaccgttcggtttaccgggaacggtaccggaaacgtaggtacgtagggtacaaccggtttaacggaacgtacccggtttggacgacggttttaccgccgtaacgtacgttccgtttccggttcgttaaaccccg

SEQ ID NO: 134585 - DNA, 905 bp, Homo sapiens
  misc_feature: GYAE6OF01AWLS4.16.71.G05.1.454.CMB.1.raw
tcagtgtactactccacgaccggtgctcgatttagtgtcgtcgcaagagagagggggagagctgctcagttaggacccagagggaaccatcggaaaccccagcgcagcttctcttcctcctgctactctggctcccagactaccaccggagaattgtgttgacgcagtcctccgacggcctacccttgttcttttcgtccgtaccggaaggggaaacgcgccctaccccttctccgtggccgacgggcctacgtcgaggtagttacgttaaccgagacgtaacgggttaccttacgccgttacggtaccgacggactaacggtaaccgtcggccgtcggcccttacccggacggtcccttaccgttacctacgttacgtacggttcggtacgtacccgtacgtacccgacggtccggacccgggtaccgtaccgtcgggaaccctacccgtaccccgtaacggtaacccgttacggttaccggtaacggtccggtacggttacgggggttcgggtacggttaccgggaacttaccgttacccgtacctacccgtccgtacccgttcccggtgaaccggtaccgtaccggttaccggacgggtaccgttacggttaacgttaacgggtttactttacggaccgtttacgtttaacggtttaacgtttcgtaacggttataccggtttaacggtagggtttaccgggttacggtaccgtttaccccgtttaacgtttacccgggtttaccggtttcccggggtaaccggtaccgggttaaccgttaacgggtacggtaaccggtaaaccggttaaacccgtacgggttaaacccggttcgggttaaccggtccgtcgttaaaccccacggtttactaccggtttacccgttacgttccttaacccgg

SEQ ID NO: 134586 - DNA, 823 bp, Homo sapiens
  misc_feature: GYAE6OF01DKORO.16.71.G05.1.454.CMB.1.raw
  modified_base (231)..(231): a, c, t, g, unknown or other
  misc_feature (231)..(231): n is a, c, g, or t
tcagtgtactactccacgaccggtgctcgatttagtgtcgtcgcaagagagagggggagctctgagagaggagcccagccctgggtattttcgaggttgttttctatttggtgatcaggactagaacagagagaactcaccatggagtctgggctgagctggtctttttcgtgtggtacttaagttttaaaggtgtcctaggtgtggtaggtgctagtcgttggttagggngttcgggtagggggtacggtcgttaggccacgacggtcccgggttcggggggtcccctaggacgtacctccgtccgtgtcgcacgtcctgtgtacttcctaccgtttgactagtactacgtcaccgtagtccgtacccggtcgggtccccgaccggtacggccggttaccgggaaggggtacgggtacgtacggtaagtcgggttctacggttaggttaacgtttacgttggggttacggtttacggtttaaccaaccgtacgttaacgtaccgttaccgacgttaacggtacccgttaccgggtaacggggtacccgggttacccggtacccgtaacccgttaaccgttcccgtaacccgaagggtaaaccgttaaaccgtaaacccgttaaccgaaaaccgttaaccctaaccgtaccggtttacgttaactaccgtaacgtaacgtaaacgttacggaaacgaccgtccgtaacggacgaacccggaccgaaccgtaacacccggtactaattaagttcgttacgtggaaccggaacgaccgacccggtaccgtaacgttacggtaacccacccgttaacgtaaacccg

SEQ ID NO: 134587 - DNA, 866 bp, Homo sapiens
  misc_feature: GYAE6OF01E1LZ1.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctccagatacccacggagaattgtgttgacgcagtctccgaggcctacccgtgttctttgtccgtaccgagggaaacgcgccctaccctctccgtgaccgtacgggccagtcgaggtagttcgttacccagtccgtaaggttaccgtttacgccgttacggtaccaacgccgaaaggtaaacccgtcggcccgtcggtcccttcccgaggtcctacctcctaagttcctaggtcggtacgacctacgtaccgacggtccgaccgggacctacggtcgacacctacccgaggtaccgtcggtacgtaggtcgacgtacgggttcgggtcggtaacgggtaacctacgttacccgttacccgtacctttacccggtaaccccttaccccggtaacgtacgtaacccggaacggttaacccggtgggtaacccgtaccgggttaaggttaaaccgtttagtttttaccggatttaaccggggttacttttaaacgttacgggttacgttaccgggtaacccgttaagggtttacggttacggtaaccgggggtttaccgtaacccttttaccgtttaaaccggtttacgggttttacccggaaaccccggggtaaggggtaaacccttaggggttacgtttaaacgggaaaaccgttacggtaaaacccggttaaaccggttcgttaacgggggcctaaggtcccgtaaactcggttacgtccgtttcgttaaccctcg

SEQ ID NO: 134588 - DNA, 697 bp, Homo sapiens
  misc_feature: GYAE6OF01EJ21B.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtcttgtctccgaggggaagcgcccaccctctcctgcagggccagtcagagtcgttaccagcgtaggtacttacgccgtggtaccagacaacgaaaccgtggccctggcctcccgaggcctcctcatctagtggtcgctactccgagcgacggcctacgtggaccactacccgagacgtacggttcgaggtcggtacgtagggttcgggtacgtacgggactaggtaccctttcgaccttccgtacccgtaccccttacgaacgtcgtaacggtacgtacgggtacgtacccgtaagtaaacgttacgttttacggaccgttacgttagttaacgtttacgtcgtaccgtagttacgtacgttaggttacgggtacggtaccgttaaccgtttacgttaccggtttacggaccggtaacggggaaccgtaacggtacggtacggtaacgtacgtaaccgtaaacggtacgtcggtacggtacgtacgtacctacgtacgttcgttcgttcttacccg

SEQ ID NO: 134589 - DNA, 791 bp, Homo sapiens
  misc_feature: GYAE6OF01ERSIN.16.71.G05.1.454.CMB.1.raw
  modified_base (778)..(778): a, c, t, g, unknown or other
  misc_feature (778)..(778): n is a, c, g, or t
tcagtgtactactccacgaccggtgctcgatttagtgtcgtcgcaagagagagggggagagctgctcagttaggacccagagggaaccatggaaccccagcgcagcttctcttcctcctgctactctggcctcccagactaccgaccggaagtaaattgttgttgacgcagtctccaggcctaccctgttctttgtctaccgaaggggaaagcgcccaccctctccgtgcgacgggccagtcgagtagtacgttaccacgcgtaggtaacgttcgtaccgtacggtaccacgtacaacgtaaaccgtcggtcctacggccctacccgaggtcctcctacacttcgttagtggtcgctactccggagccggtacggccgtacgtggcctaaccgtacccaacggtaaccgtacggtcgtacggtcggtaccggtaggttcgggtaccgtcgggaactacggtacttaccgaccttccgtaccgtacccgtacgacggtaccgtacggtaccggtagggaccggttaccgtaaggtaaacggtttacgtttacggtacgttaaggtttacgttaactttacggttacgtacggtaacgtacggtacggttaacgggtgggttaacgaccgtttaaccgtttaccggtttacggtttaccgggaccgggttaaccgggtaacggtaacgtccggttaaacgggtaaccggttaacgttaaaccggaaacggttacggttcgggtacggtaaccgtacgtaccttaccgttagttccgtttntccgtttaaccgg

SEQ ID NO: 134590 - DNA, 498 bp, Homo sapiens
  misc_feature: GYAE6OF02IHP1O.16.71.G05.1.454.CMB.1.raw
  modified_base (375)..(375): a, c, t, g, unknown or other
  misc_feature (375)..(375): n is a, c, g, or t
tcagtgtactactccacgaccggtgctcgatttagtgtcgtcgcaagagagaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctnagcagactggagcctgaagatttgcagtgtattactgtcagcagtatggtaggcaccttacacttttggccaggggaccaagctaggagagtcaaacgactagtggctgcaccatctgtcttc

SEQ ID NO: 134591 - DNA, 174 bp, Homo sapiens
  misc_feature: GYAE6OF02G4HUO.16.71.G05.1.454.CMB.1.raw
  modified_base (172)..(174): a, c, t, g, unknown or other
  misc_feature (172)..(174): n is a, c, g, or t
tcagtgtactactccacgaccggtgctcgatttagtgtcgtcgcaagagagaggggagctctgagagaggagcccagccctgggattttcaggtgtttcatttggtgatcaggactgaacagagagaactcaccatggagtctgggctgagcgggctggcaaggcgcatagnnn

SEQ ID NO: 134592 - DNA, 512 bp, Homo sapiens
  misc_feature: GYAE6OF02JE6X7.16.71.G05.1.454.CMB.1.raw
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctnagcagactggacgcctgaagtatttgcagtgttattactgtcagcagtatggtaggctaccttactacgttttcggccgtacgggaccaagcgtaggagagtacgaaacgacgtgtggctcgcaccatctgtcttc

SEQ ID NO: 134593 - DNA, 497 bp, Homo sapiens
  misc_feature: GYAE6OF02IPLD8.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactgacatcccagacaggttcagtggcagtgggtctgggacagacttcactctcaccctcagcagactggagcctgaagatttgcagtgtattactgtcagcagtatggtagggcaccttactactttggccaggggaccagctggagagtcaaacgacgtgtggctgcaccatctgtctc

SEQ ID NO: 134594 - DNA, 527 bp, Homo sapiens
  misc_feature: GYAE6OF02GRXUQ.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaacctggcctggctccaggctcctcatctatggtgcatccagcagggccactggcatcccagacaggttcagtggcaggtgggtctgggacagacttcactctccaccctcacgcagactggacgccgtagaagtatttcgctagttgttattactgtcagcagttatgggtaggctacttactacgttttgccgacgggaccagcgtaggagtacgtacgaaacgtaacgtggtacggctagcaccgatcgtcgtcttacc

SEQ ID NO: 134595 - DNA, 503 bp, Homo sapiens
  misc_feature: GYAE6OF02F5JY2.16.71.G05.1.454.CMB.1.raw
  modified_base (376)..(376): a, c, t, g, unknown or other
  misc_feature (376)..(376): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctnagcagactggagcctgaagtatttgcagtgtattactgtcagcagtatggtaggctaccttactacgttttggccgtagggaccaagcgtggagagtacaaacgactgtggctgcacatctgtcttc

SEQ ID NO: 134596 - DNA, 174 bp, Homo sapiens
  misc_feature: GYAE6OF02IQV8H.16.71.G05.1.454.CMB.1.raw
  modified_base (174)..(174): a, c, t, g, unknown or other
  misc_feature (174)..(174): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcgggctggcaaggcgcatagn

SEQ ID NO: 134597 - DNA, 502 bp, Homo sapiens
  misc_feature: GYAE6OF02IRK7H.16.71.G05.1.454.CMB.1.raw
  modified_base (201)..(201): a, c, t, g, unknown or other
  misc_feature (201)..(201): n is a, c, g, or t
  modified_base (374)..(374): a, c, t, g, unknown or other
  misc_feature (374)..(374): n is a, c, g, or t
  modified_base (422)..(422): a, c, t, g, unknown or other
  misc_feature (422)..(422): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagcccaccctctcctgcagggccagtcagagtgttaccagcaggtacttagcctggtaccagcagaaacctggcctggctccaggctcctcatctatggtgcatccagcagggccatgacatcccagacagttcagtggcagtgggtctgggacagacttcactctcaccctnagcagactggacgctgaagatttgcagttgtatttactgtcagcagtntggtaggctaccttacacttttggccaggggaaccaagctggagatacgaaacgactgtgctgcaccatcgttgtcttac

SEQ ID NO: 134598 - DNA, 503 bp, Homo sapiens
  misc_feature: GYAE6OF02JWSTY.16.71.G05.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (372)..(372): a, c, t, g, unknown or other
  misc_feature (372)..(372): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctntcctgcagggccagtcagagtgtaccagcaggtacttagcctggtaccagcagaaacctggcctggctcccaggctcctnatctatggtgcatccagcagggccactggcatcccagacaggttcagtgcagtggtctgggacagacttcactctcaccctnagcagactggagcctgaagtatttgcagtgttattactgtcagacagtagtggtaggctaccgttactacgtttgcgagggaccagcgtaggagagtacgaacgactgtagcgtcgacaccatctgtctcg

SEQ ID NO: 134599 - DNA, 509 bp, Homo sapiens
  misc_feature: GYAE6OF02IOK16.16.71.G05.1.454.CMB.1.raw
  modified_base (302)..(302): a, c, t, g, unknown or other
  misc_feature (302)..(302): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtncatccagcagggccactggcatcccagacaggttcagtggcagtgggtctgggacagacttcactctcaccctcagcagactggagcctgaagtatttgctagtgttattactgtcagcagtagtggtaggctaccttactacgtttcggaccgagggaccaagcgtaggagagtacaaacgtactgtgcgtcgcaccatctgtctc

SEQ ID NO: 134600 - DNA, 528 bp, Homo sapiens
  misc_feature: GYAE6OF02GRVZN.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcgtggcgttttctagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctgggaatgggtctcaggtattactggtggtggttataccacatactacgcagactccgtgaagggccgttcaccatctccagagacaattccaagaacacactgtatctgcaaatgaaccagcctagagacgccgaacgaccacggcccaagtactattacctgtcgacgaagccaccggctaggttacgtccaccctaac

SEQ ID NO: 134601 - DNA, 517 bp, Homo sapiens
  misc_feature: GYAE6OF02F03GI.16.71.G05.1.454.CMB.1.raw
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaaacctggcctggctccaggctcctcatctatggtgcatccagcagggccactggcatcccagacaggttcagtggcaggtgggtctgggacagacttcactctcaccctnagcagactggagcctgaagtatttgctagttgttattactgtcagcagtagtggtagggctaccttacgtacgttttcggaccgtacggggaccaagtcgtaggagagtacaaacgacgtgtgcgtgcaccatctgtcttc

SEQ ID NO: 134602 - DNA, 544 bp, Homo sapiens
  misc_feature: GYAE6OF02I9HW7.16.71.G05.1.454.CMB.1.raw
  modified_base (301)..(301): a, c, t, g, unknown or other
  misc_feature (301)..(301): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctccaggctcctcatctatggtncatccagcagggccactgacatccagacaggttcagtggcagtgggtctgggacagacttcactctccaccctcagcacgacgtggacgcctgtaagtatttgctagtgttattactgtcagtcagtagtggtaggtactaccgttacgtacgtttcggaccgtacgggaccaacgcgtaggagacgtaacgaaacgtaacgtacggtacggacgtacgacaccgtagtacgttcgtcttacc

SEQ ID NO: 134603 - DNA, 500 bp, Homo sapiens
  misc_feature: GYAE6OF02G0RH6.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctcagcagactggagcctgaagtatttgcagtgtattactgtcagcagtagtggtagggcaccttactacttttggccagggacaagcgtggagatcaaacgaactgtgcgtgcaccatctgtcttc

SEQ ID NO: 134604 - DNA, 554 bp, Homo sapiens
  misc_feature: GYAE6OF02FPXN0.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctccaggctcctcatctatggtgcatccagcagggccactggcatcccagacaggttcagtggcagtgggtctgggacagacttcactctcaccctgagcagactggacgtctgaagtatttgctagtgttattactgtcagtctagtagtgggtaggctaccgtttactacgttttcggaccgtacgggtaccaaggtcgtaggagtacgtactaaacggtaacgtacggtacggtactacggtaccgaaccgtacgtcgttacgttcgttaccg

SEQ ID NO: 134605 - DNA, 495 bp, Homo sapiens
  misc_feature: GYAE6OF02IR33J.16.71.G05.1.454.CMB.1.raw
  modified_base (201)..(201): a, c, t, g, unknown or other
  misc_feature (201)..(201): n is a, c, g, or t
  modified_base (414)..(414): a, c, t, g, unknown or other
  misc_feature (414)..(414): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaaacctggcctggctccaggctctcatctatggtgcatccagcagggccactgacatcccagacaggttcagtggcagtgggtctgggacagacttcactctcaccctcagcagactggagcctgaagatttgcagtgttattactgtnagcagtatggtagggcaccttacacttttggccagggaccaagctggagatcaaacgtactgtgctgcaccatctgtcttc

SEQ ID NO: 134606 - DNA, 491 bp, Homo sapiens
  misc_feature: GYAE6OF02IGWH2.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctcctgcaggccagtcagagtgttaccagcaggtacttagcctggtaccagcagaaacctggcctggctccaggctctcatctatggtgcatccagcagggccactgacatcccagacaggttcagtggcagtgggtctgggacagacttcactctcaccctcagcagactggagcctgaagatttgcagtgtattactgtcagcagtatggtagggctacttactacttttggccagggacagctggagatcaaacgactgtggctgcaccatctgtcttac

SEQ ID NO: 134607 - DNA, 517 bp, Homo sapiens
  misc_feature: GYAE6OF02HXD35.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctcagcagactggagcctgaagtatttgctagtgttattactgtcagctagtagtggtagggcctaccttactacgttttggccgtagggaccaagcgtaggagagtacaaacgaacgtgtaggctgcacctactcttgtcttc

SEQ ID NO: 134608 - DNA, 515 bp, Homo sapiens
  misc_feature: GYAE6OF02IFD0G.16.71.G05.1.454.CMB.1.raw
  modified_base (375)..(375): a, c, t, g, unknown or other
  misc_feature (375)..(375): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctccaggctcctcatctatggtgcatccagcagggccactggcatcccagacaggttcagtggcagtgggtctgggacagacttcactctcaccctnagcagactggagccgtgaagtatttgctagtgttattactgtcagcagttagtggtagggctaccttacgtacgttttcggccgtaggggaccaagcgtaggacgtagtacaaacgtactgtgcgtgcaccatctgtctc

SEQ ID NO: 134609 - DNA, 522 bp, Homo sapiens
  misc_feature: GYAE6OF02G3GGG.16.71.G05.1.454.CMB.1.raw
  modified_base (202)..(202): a, c, t, g, unknown or other
  misc_feature (202)..(202): n is a, c, g, or t
  modified_base (380)..(380): a, c, t, g, unknown or other
  misc_feature (380)..(380): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgttaccagcaggtacttagcctggtaccagcagaacctggcctggctcccaggctcctcatctatggtgcatccagcagggccacgtggcatcccagacaggttcaggtggcaggtgggtctgggacagtacttcactctccaccctnacgcacgactggacgccgtgaagtatttgctagtgttattactgtcagctagtagtggtaggctacttactacgtttcggccgtacgggacgagcgtggagtagtacgaacgacgtgtcggcgtcgcaccgtatctgtcttc

SEQ ID NO: 134610 - DNA, 530 bp, Homo sapiens
  misc_feature: GYAE6OF02J1S7U.16.71.G05.1.454.CMB.1.raw
  modified_base (523)..(523): a, c, t, g, unknown or other
  misc_feature (523)..(523): n is a, c, g, or t
  modified_base (528)..(530): a, c, t, g, unknown or other
  misc_feature (528)..(530): n is a, c, g, or t
tcagtgtactactccacgaccggtgctcgatttagtgtcgtcgcaagagagaggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccagggaaccctggtcaccgtctcctcagccctccaccgaagggcccatccggtccttcccctggccaccctcctaccaacgacgccacctcgtcggggcacgacgcggccctgggctgccgtgtcaaggcctacgttcgacgtagtacacgtgagcgggctggcaaggccgagacgtagnagcgnnn

SEQ ID NO: 134611 - DNA, 508 bp, Homo sapiens
  misc_feature: GYAE6OF02HBAEK.16.71.G05.1.454.CMB.1.raw
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactggcatcccagacaggttcagtggcagtggtcngggtacagacttcactctcaccctnagcagactggagcctgaagtatttgcagtgttattactgtcagcagtagtggtaggctaccttactacgttttggccgagggaccaagcgtaggagagtacgaacgacgtgtaggctcgcaccatctgtctc

SEQ ID NO: 134612 - DNA, 508 bp, Homo sapiens
  misc_feature: GYAE6OF02FZBD5.16.71.G05.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (376)..(376): a, c, t, g, unknown or other
  misc_feature (376)..(376): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctntcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacaggacttcactctcaccctnagcagactggagctgaagatttgcagtgtattactgtcagctagtatggtagggctaccttactacgttttggcctagggaccaagcgtaggagatacgaacgaactgtggctgctaccatcgttcgtcttc

SEQ ID NO: 134613 - DNA, 515 bp, Homo sapiens
  misc_feature: GYAE6OF02IMWE3.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaaacctggcctggctcccaggctcctcatctatggtgcatccagcagggccagtggcatcccagacaggttcagtggcaggtgggtctgggacagacttcactctcacctcagcagacgtggacgccgtagtaagtatttgctagtagttatttacgtgtctagcagttagtggtaggctacttactactttgccgaggaccagtctggagacgtacaacgactgtgtcgtcgacaccatcgtgtctacg

SEQ ID NO: 134614 - DNA, 526 bp, Homo sapiens
  misc_feature: GYAE6OF02I99OV.16.71.G05.1.454.CMB.1.raw
  modified_base (201)..(201): a, c, t, g, unknown or other
  misc_feature (201)..(201): n is a, c, g, or t
  modified_base (377)..(377): a, c, t, g, unknown or other
  misc_feature (377)..(377): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaaacctggcctggctccaggctcctcatctatggtgcatccagcagggccacgtggcactccagacaggttcaggtggcaggtggtctgggacagacttcactctcaccctnacgcagactggagccgtagaagtagtttgactagttgttattacgtgtcagtctagtagtgggtaggctacttactacgtttcggccgagggaccagcgtggagtagtacgaaacgtacgtgtaggctgacctaccagtctgtcttacg

SEQ ID NO: 134615 - DNA, 578 bp, Homo sapiens
  misc_feature: GYAE6OF02JDCN1.16.71.G05.1.454.CMB.1.raw
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaaacctggcctggctcccaggctcctcatctatggtgcatccagcagggccactggcatcccagacaggttcagtggcaggtgggtctgggacagacttcactctcaccctnacgcacgacgtggacgccgtagaagtacgttttgacctagttgttaactttactgtctagtctagttagtgggtacggcctaaccgtttacgtacgttttcggaccgtacggggtaacctaaggtcctagggaagtagtaaccaaacggtaacgttggtacggtcgttacggcctaaccgtacgtccgttacgttccttacg

SEQ ID NO: 134616 - DNA, 555 bp, Homo sapiens
  misc_feature: GYAE6OF02IIJM6.16.71.G05.1.454.CMB.1.raw
  modified_base (377)..(377): a, c, t, g, unknown or other
  misc_feature (377)..(377): n is a, c, g, or t
tcagtgtactactccacgaccggtgctcgattttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatgtgcatccagcagggccacgtggcactcccagacaggttcagtggcaggtggtctgggacagcttcactctcaccctnagcagactggagcctgtaagtatttgctagttgttattactgtcagcagtagtgggtaggctaccgttactacgtttcgggaccgtaacggggaccaaggtcgtaggaagtacgtaaccgaaaccggtacgtcggtacggtacgtacggcctaaccgtacgtacgttcgttcttaccg

SEQ ID NO: 134617 - DNA, 523 bp, Homo sapiens
  misc_feature: GYAE6OF02FX6Z8.16.71.G05.1.454.CMB.1.raw
  modified_base (202)..(202): a, c, t, g, unknown or other
  misc_feature (202)..(202): n is a, c, g, or t
  modified_base (378)..(378): a, c, t, g, unknown or other
  misc_feature (378)..(378): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngcccaccctctcctgcagggccagtcagagtgttaccagcaggtacttagcctggtaccagcagaaacctggcctggctcccaggctcctcatctatggtgcatccagcagggccactggcatcccagacaggttcagtggcaggtggtctgggacagacttcactctccaccctnagcagactggacgcctgaagtatttgcagttgttattacgtgtcagctagtagtggtaggctaccttacgtacttttcggaccgacgggaccagtcgtaggagagtaacgaaacgactgtggctcgcaccgtactctgtcttacg

SEQ ID NO: 134618 - DNA, 557 bp, Homo sapiens
  misc_feature: GYAE6OF02IKWX4.16.71.G05.1.454.CMB.1.raw
  modified_base (417)..(417): a, c, t, g, unknown or other
  misc_feature (417)..(417): n is a, c, g, or t
  modified_base (552)..(555): a, c, t, g, unknown or other
  misc_feature (552)..(555): n is a, c, g, or t
  modified_base (557)..(557): a, c, t, g, unknown or other
  misc_feature (557)..(557): n is a, c, g, or t
tcagtgtactactccacgaccggtgctcgattttagtgtcgtcgcaagagagaggggtcccgtcgagactctcctgtgcagcctctggattcacctttagttgcctatgccatgagctgggtccgccaggctccaggggaaggggctagaatgggtctcaagtatcacaagcagtagtagtaccgcatggtacgcagactccgtgaagggccgtttcaccatctccagagacaattccaagaacacgctgtatttgacaaatgaacagtctgagagtcgaggacacggccatatattactgtgcgaagcgggattggtggcggtgactgctattgactacgtggggccagggaccctggtcaccgtctcctcagccctccaccgaagggcccactccggtccttcccccgtcggccncccctcctccaacgacgccacctcgtcgggggccacgacgcccggccgtgggcctcggccgtggtccgaaggtacctacttcccggagtagtaccacgtggacggcgggtcgtcggcgaacggccgacgataggnnnngn

SEQ ID NO: 134619 - DNA, 564 bp, Homo sapiens
  misc_feature: GYAE6OF02IISRV.16.71.G05.1.454.CMB.1.raw
  modified_base (201)..(201): a, c, t, g, unknown or other
  misc_feature (201)..(201): n is a, c, g, or t
  modified_base (387)..(387): a, c, t, g, unknown or other
  misc_feature (387)..(387): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaaacctggcctggctcccaggctcctcatctatggtgcatccagcaggccatggcatcccagacaggttcagtggcagtggtctgggacagacttcactctccaccctcagcagactggacncctgaagtatttgctaggttgttaatttactgttacagtccgaagttagtgggtagggtctaacccgtttacgtacgttttcgggaccgtaaggggtacctaagtcgtaggaacgtagtaacgaaaccgtacgttagtacggcgttcgaccgtacctaacgtcgtcgttacttaccg

SEQ ID NO: 134620 - DNA, 500 bp, Homo sapiens
  misc_feature: GYAE6OF02JF8V1.16.71.G05.1.454.CMB.1.raw
  modified_base (201)..(201): a, c, t, g, unknown or other
  misc_feature (201)..(201): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (465)..(465): a, c, t, g, unknown or other
  misc_feature (465)..(465): n is a, c, g, or t
  modified_base (485)..(485): a, c, t, g, unknown or other
  misc_feature (485)..(485): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaaacctggcctggctcccaggctcctcatctatggtgcatccagccagggccactggcatcccagacaggttcagtggcagtgggtctgggacagacttcacttcncaccctnagcagactgagcctgaagtatttgcagtgttattactgtcagcagtatggtaggcacgttacacttttggctagggaccaagcgtganagtcaaacgactagtggtcngcaccatctgtcttc

SEQ ID NO: 134621 - DNA, 559 bp, Homo sapiens
  misc_feature: GYAE6OF02G1LG6.16.71.G05.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (383)..(383): a, c, t, g, unknown or other
  misc_feature (383)..(383): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangcccaccctctcctgcagggccagtcagagtgttaccagcaggtacttagcctggtaccagcagaaacctggcctggctcccaggctcctcatctatggtncatccagcagggccactgacatcccagacaggttcaggtgcaggtggtctgggactaggtacttacactcctaccaccctnacgcacgactcggagtcctaggaagtagtttgactaggttgttactttacgtgtcagctagttagtgggtagctaccgttactacgtttcggaccgtacgggacctagtcgtaggacgtacgtacgaaacgtacgtacgtaggtactcgacctaccgtagtcgttacgtcttaccg

SEQ ID NO: 134622 - DNA, 587 bp, Homo sapiens
  misc_feature: GYAE6OF02F90Q0.16.71.G05.1.454.CMB.1.raw
  modified_base (203)..(203): a, c, t, g, unknown or other
  misc_feature (203)..(203): n is a, c, g, or t
  modified_base (390)..(390): a, c, t, g, unknown or other
  misc_feature (390)..(390): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngcccaccctctcctgcagggccagtcagagtgttaccagcaggtacttagcctggtaccagcagaacctggcctggcctccaggctcctcatctatggtgcatccagcgacgggccacgtggcactcccagaccgaggttcgagtggctaggtgggtctgggacaggacttcactcctaccaccctnacgcacgacgtggacgtccgtaggaacgtagtttagacgtagttgttacttacttgtacagtactagttagtgggtacggtactaccgttacgtacgtttcggaccgtacggggtaccaaggtcgtaggacgtacgtaacgaaacgtacggttaggtacggacgtacggacctacctacgtccttacgttcttaccg

SEQ ID NO: 134623 - DNA, 848 bp, Homo sapiens
  misc_feature: GYAE6OF02HU2LH.16.71.G05.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggccaccctgtctttgtctccgaggggaaangcccaccctctcctgcagggccagtcagagtgttaccagcaggttactagcctggtaccagcaagaaacctggcctggctcccgagctcctcattctagtggtncatccagcacggccacgtggacacgtacccagacctaggttcaggtcggactaggttcggggtctagggaacacggttactttaccgaacgttcccttacccgaaaccccgtttcgaacggaccgtaacggtaaccggttacggggtaacggtacccggttaaggtaaaacggtttaacggttttttacgggaaccggttaaggtttacggtttaaacgttttaaccgtttacggtttaaccgttaacggttaaccgttaaggtttaacgggtttacgggggttaaacggggttacccgtttaaacccgttttaaccgtttaacccggtttttttaacggggtaccccgggtaaacggggggtaaacccgttaaacgggtaccggtttaacgggggtaaacggttaaccggtttaaacccggtaaaacccgggttaaaccggtttacgggttaacccggggttaccggttaccgggtaaccccgtaaccccgtttaaccggttttacccggtttaccggttttaccccgttttaaccccgg

SEQ ID NO: 134624 - DNA, 564 bp, Homo sapiens
  misc_feature: GYAE6OF02I69S9.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaacctggcctggctccaggctcctcatctatggtgcatccagcacgggccactgacactcccagacgaggttcagtgcaggtgggtcgtgggacagtacttcactcctaccaccctcacgcagacgtggacgctagaagtatttgactagtgttattacgtgtcagtactagtagtggtacggctaccttacgttacgtttcggccgtacgggtaaccgaagtcgtagggtaacgtacgtaaccgtaaacgtacgttaggtacggtcgtacgtacctaccgtatcgttacgttccttacg

SEQ ID NO: 134625 - DNA, 556 bp, Homo sapiens
  misc_feature: GYAE6OF02GX819.16.71.G05.1.454.CMB.1.raw
  modified_base (376)..(376): a, c, t, g, unknown or other
  misc_feature (376)..(376): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccatggcatcccagacaggttcagtggcaggtgggtctgggacagacttcactctcaccctnagcagactggacgccgtagaagtatttgctagtgttattactgtcagtcagtatgggtaggtctaccgttactacgttttcggaccgtacgggaccaaggtcgtagggacgtacgtacgaaacggtaacgtggtacggtcgtacgaccgtaaccgtacgttccgttacgttaccttaccg

SEQ ID NO: 134626 - DNA, 727 bp, Homo sapiens
  misc_feature: GYAE6OF02IJ42P.16.71.G05.1.454.CMB.1.raw
  modified_base (199)..(199): a, c, t, g, unknown or other
  misc_feature (199)..(199): n is a, c, g, or t
  modified_base (300)..(300): a, c, t, g, unknown or other
  misc_feature (300)..(300): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccaggcaccctgtctttgtctccaggggaangccaccctctcctgcagggccagtcagagtgttaccagcaggtacttagcctggtaccagcagaaacctggcctggctccaggcctcctcatctatggtcncatccagcgagggccagtggcagtcccagactaggtcagtggctaggtcgggtctgggactacggtaccttcaccttcctacccgtacccctcgacgtcgaacggtaccgtcgggaacgtacccgttaggtaaacggttacttttacggaccgttaaggtttacgtttaacgttttaccgtttacggttaccgtaacggtaccgtaaagggtttacgtttacgggggttaacggggttacccttaaacccgttttaaccgtttaaccgggtttttaccggggacccgggtaaaccgggggtaaaccctaaacggggtaccgttacgggtaacggtaaccgtaaccggtaaaaccggtaaccggttagggtaccgggtaccgttaccgtaccgtaaccgtaacgttccgttacgttacccgtttaccg

SEQ ID NO: 134627 - DNA, 805 bp, Homo sapiens
  misc_feature: GYAE6OF02IM3GI.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcaggagtcgtaccagctaggtacttagccgtaggtaccagcgaaacgtaaaccgtggcctaggcctacccgaggcctcctactatctagtgggtcacctactccgaaggtccgaacgggccctacgtggactaccgtcccaagacgtaggttccgaggtcggacgtagggttcgggtacgtagggacctaaggtccttacaacgttcctacccacccgttcgaacgtccgaagtaacccgttggggaacgtcccgtaaggtaaacgtttacgtttggacgttaaggtttacgtttaaacgtttcgtacgtttaccgaacgtacgtaacggtttagggttaccggggtaacgggttacccttaaacccggttttaccgttaaccgggtttttaccggggaacccgggtaaaccgggggttaaacccctaacgggtttacggtacggggtaaacgtttaaccggtaaaacccggttaaaaacccggtaacgggtttcgggtaaccgggtaccgtttacccgggaaccccgttaacccggttaccgttttacccggtttacggtttaaccccttttacccgg

SEQ ID NO: 134628 - DNA, 528 bp, Homo sapiens
  misc_feature: GYAE6OF02IDQWY.16.71.G05.1.454.CMB.1.raw
  modified_base (201)..(201): a, c, t, g, unknown or other
  misc_feature (201)..(201): n is a, c, g, or t
  modified_base (374)..(374): a, c, t, g, unknown or other
  misc_feature (374)..(374): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaaacctggcctggctccaggctcctcatctatggtgcatccagcagggccactggcatcccagacaggttcagtggcaggtggtctgggacagacttcactctcaccctnagcagactggacgcctagaagtatttgactagttgttattacgtgtcagctagtagtggtaggctaccttacgtacgtttcggccgtacgggaccaagctaggagtagtacaaacgtaacgtggtacggctcgacacctagtcgttagtcttac

SEQ ID NO: 134629 - DNA, 615 bp, Homo sapiens
  misc_feature: GYAE6OF02FYGPE.16.71.G05.1.454.CMB.1.raw
  modified_base (207)..(207): a, c, t, g, unknown or other
  misc_feature (207)..(207): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
tcagtgtactactccacgaccggtgctcgatttagtgtcgtcgcaagagagagggggaggagctgctcagttaggacccgagagggaaccatggaaaccccagcgcagcttctcttcctccttgctactctggctcccagataccaccgggagaaacttggtgttgacgcagtctccaggccaccctgtctttgtctccaggggaangccacccgtctccgtgcagggccagtcagagtgtaccagcaggtacttgcctgtaccagcagaacctgcctggctccgagctcctnatctagnggtncatccagcagggccagtggcatcccagactggttcaggtggctagtcgggtctgggacacggtacttcgacgtcctacgaccctgacgccacgacgtggacgtcgtagaacgttctttaggccgtaggttacgttaagttacgttagttcgacgtactaggttagttagggtacggtaccttaaccgttaacgttacgtttacggtaccgtacgggtaaccgtaggtccgtagggacgtaacgtaacgtaaaccggtacgttaggtacggtacgtacggaccgtaaccgacgttcgttcgttccgttaccg

SEQ ID NO: 134630 - DNA, 524 bp, Homo sapiens
  misc_feature: GYAE6OF02HU64S.16.71.G05.1.454.CMB.1.raw
  modified_base (330)..(330): a, c, t, g, unknown or other
  misc_feature (330)..(330): n is a, c, g, or t
  modified_base (389)..(389): a, c, t, g, unknown or other
  misc_feature (389)..(389): n is a, c, g, or t
  modified_base (413)..(413): a, c, t, g, unknown or other
  misc_feature (413)..(413): n is a, c, g, or t
  modified_base (489)..(489): a, c, t, g, unknown or other
  misc_feature (489)..(489): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtcgtgggggaggcttggcacagcctggggggtccctgagactctcctgtgcagcctctggattcaccgtttaggagccatgccatgagctgggtccgccaggctccgagggaaggggcnggagtgggtctctactattactgctagtaggtaatcatgctatactatgacagactcgngaagggccgttcaccttcacaganacaatccaagacagctctatctagcaattcgacagtcctgacgccgacgacgaccgacggcctagtcgtaattacngttaactaagtcggcgggtcggccgcggtacccgg

SEQ ID NO: 134631 - DNA, 586 bp, Homo sapiens
  misc_feature: GYAE6OF02GBPL0.16.71.G05.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctcctgcagggccagtcagagtgtaccagcaggtacttagcctggtaccagcagaaacctggcctggctccaggctcctcatctatggtncatccagcagggccacgtggcatcccagacaggttcaggtgcagtggtctgggacagacttcactctcaccctgacgcagtactggacgtctagtaacgtatttgacgtagttgttacttacgttgtactagtcgtaggttagtgggtacgggtccttaaccgttacgttacgttttcgggaccgtaacggggtaaccctaggtccgtaggtacgtaacgtaccgaaacggtaccgtggttacggtacgttacgacgtaaccgtacgttccgttacggttacttaccg

SEQ ID NO: 134632 - DNA, 538 bp, Homo sapiens
  misc_feature: GYAE6OF02FUAJI.16.71.G05.1.454.CMB.1.raw
  modified_base (202)..(202): a, c, t, g, unknown or other
  misc_feature (202)..(202): n is a, c, g, or t
  modified_base (375)..(375): a, c, t, g, unknown or other
  misc_feature (375)..(375): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgttaccagcaggtacttagcctggtaccagcagaacctggcctggctccaggctctcatctatggtgcatccagcagggccactggcatcccagacaggttcagtggcaggtgggtctgggacagacttcacttctcaccctnagcagactggacgcctagaacgtatttcgctagtgttacttacgttgttcagtactaggtagtgggtaggtactaccgttacgtacgttttacggccgtacgggaccagtcgtaggagtagtacgaacgtacgtggtacggtactcgacacctatctgtcttc

SEQ ID NO: 134633 - DNA, 591 bp, Homo sapiens
  misc_feature: GYAE6OF02H1TVY.16.71.G05.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctcccagataccaccggagaaattgtgttgacgcagtctccaggcaccctgtctttgtctccgaggggaaagngcccacctctcctgcagggccagtcagagtgttaccagcaggtacttagcctggtaccagcaagaacctggcctggctccaggctcctcatctatcggtncactccagccgacgggcccaacgtggaccacgtccccgaagactagggttcaacggtcggcgtaggtgggtaccgtagggacagttacttacaccgttctcccaccttcgagacacgacgtgggacaccgtagtaagttagtttgactagtagttattactgtactagtcgagttagttggtacggtacctacctttacgtacgtttcggaccgtacgggaacctagcgtaggagtacgtaacgaacgtacgtagtacgacgtcgacgaccgtatctcgttctaccg

SEQ ID NO: 134634 - DNA, 634 bp, Homo sapiens
  misc_feature: GYAE6OF02IDQCN.16.71.G05.1.454.CMB.1.raw
  modified_base (592)..(592): a, c, t, g, unknown or other
  misc_feature (592)..(592): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtcttttttcttgtggcttattttaaaaggtgtccagtgtgaggtgcagctgttggagtcgtgggggaggcttggcacagccgtggggggtccctgagactctcctgtgcagcctctggattctacctttgacagtctatgcccatcgaccgttgggtcccgccgacggcctcccggaagggggaacggggcgttagggaagttcggggtcctcgtaggttacttacgtggggttggttggttaactaaccacgtactactacgcaacgtaccgtcggtaggaacggggcccggtttaccaacccgtatccctccgaagaacgaacctaagttacccaaaacgaacctaactacgtagttaactctagaacaaagtacgaaacaggcctaggacgacggcccgaacgaccgaacggctaattaacgttacttacgngtagacccgaagcccacgggtactagttaccgaccacctaac

SEQ ID NO: 134635 - DNA, 581 bp, Homo sapiens
  misc_feature: GYAE6OF02ISS0D.16.71.G05.1.454.CMB.1.raw
  modified_base (201)..(201): a, c, t, g, unknown or other
  misc_feature (201)..(201): n is a, c, g, or t
  modified_base (391)..(391): a, c, t, g, unknown or other
  misc_feature (391)..(391): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacctctcctgcagggccagtcagagtgttaccagcaggtacttagcctggtaccagcagaacctggcctggcctccgaggcctcctcactctatggtgcatccagcaggccacgtggcactcccagactaggttcagtggcaggtcgggtcgtgggactaggtcttccgacttcctacctaccctnacgcacgacgtcggacgtccgtagaagttatttacgcgtagttacgttacttacgtgtacagtctagttagtaggtacggtacgtaccgtttacgtacgttttcggaccgtaacgggaccagtcgtaggacgtacgtaacgaaacgtacgtggtcgtacgtagtaccgtaccgtatccgttgtaccttcg

SEQ ID NO: 134636 - DNA, 552 bp, Homo sapiens
  misc_feature: GYAE6OF02HU4CI.16.71.G05.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (522)..(522): a, c, t, g, unknown or other
  misc_feature (522)..(522): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaacctggcctggctcccaggctcctcattctatggtncatccagcagggccacgtggcatcccagacaggttcaggtggcaggtgggtctagggacaggacttcacttctcctaccctcagcacgacgtggacgcctagaagtatttgctagtgttattactgtcagtctagtagtgggtacggctaccttagtacttttcggccgtagggacctaaggcgtagggagtacgtaacgaaacgtacgtaggtacggtntacgcctaacctagtacttcgttcttaccg

SEQ ID NO: 134637 - DNA, 541 bp, Homo sapiens
  misc_feature: GYAE6OF02H8FUQ.16.71.G05.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
  modified_base (376)..(376): a, c, t, g, unknown or other
  misc_feature (376)..(376): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaacctggcctggctccaggctcctcatctatggtncatccagcaggccatggcatccagcaggttcagtgcagtgggtctgggacaggtaccttcacttcctccacccttnagcacgactggacgccgtgaagtatttgctagttgttatttactgtcagctagtagtggtacggtactaccgttacgtacttttaggaccgtagggacctaagcgtaggacgtagtacgaacgtaacgtaggttacgacgtcgacgacctactcgttcgtcttcg

SEQ ID NO: 134638 - DNA, 751 bp, Homo sapiens
  misc_feature: GYAE6OF02GPP80.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgattttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcacctgtctttgtctccaggggaaancgccaccctctcctgcagggccagtcagagtgttaccagcaggtacttagcctggtaccagcagaaaccgtggcctggcctcccgaggtcctcctcacttctatggtgcactccgagccgacgggcctacgtcggaccacgtaccccaaggaccgtacgggtttccaacggtcgggacgtagggtcgggggttaccggtagggggaacctaacgggttaaccctttcccgaaccgttccctaccccgtaaccccgttacgaacgtaccgaacggtaccggtacgggaacgtcccgtaaggtaaagttacgtttcggacgtacggtttacgttaacgtttacgtacgttacgtagtacgtaaggttacggttacgggtacgggtactaacccgttttacgttaaccgtttttcggggaacccggtaacggggtaacccgtaaggtaccggtacgggtaacgtaacgttaaaccggaaacggttaacggttacggtacgggtaccgtacggtaacccgtaaccgttacgttaccgttacggttaacttaccg

SEQ ID NO: 134639 - DNA, 741 bp, Homo sapiens
  misc_feature: GYAE6OF02H5HG2.16.71.G05.1.454.CMB.1.raw
  modified_base (184)..(184): a, c, t, g, unknown or other
  misc_feature (184)..(184): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcggtcgtgttcaggtcggctaatttaaaggntcagtgtgagtgcagctgtggatcgtggggagctggcacaggcctgggggtacctgagctcgtctgtgccaggtcctcgaggtactttcgaacccttttcggaagtaagtccgttaacgtacgtaccgtacgtacgtaccggtaccgggtacccggtacccgtaccggtaccggtaccgggtaacggggtaacggggacggttacgggtaacggtacgggtacggtaacggttacggttaacgttacggttacggttcggttacggttaacgttaaccgtaacgtaacgtaccgtacgtacgtacgtaccgtaccggtacggtacgggtaccggtaccgtaccgtacgtaccgtaccgtacgtaacgaacgtaaccgtaaccgtaaacgaaacgtaacgtacgttaagtacgtacgtacgtaacgtaacgtaacgtaacgacgtacgtacggaacgaccggaccgaaccgaccgaccgacgtaacgtaagtaacgttacgtacggtaacgtaacgtaacggaccgtacgtacgttacggtacgtaccgtaccgtacg

SEQ ID NO: 134640 - DNA, 543 bp, Homo sapiens
  misc_feature: GYAE6OF02FOEP5.16.71.G05.1.454.CMB.1.raw
  modified_base (331)..(331): a, c, t, g, unknown or other
  misc_feature (331)..(331): n is a, c, g, or t
  modified_base (382)..(382): a, c, t, g, unknown or other
  misc_feature (382)..(382): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacctctcctgcagggccagtcagagtgttaccagcaggtacttagcctggtaccagcagaacctggcctggctcccaggcctcctcatctatggtgcatccagcagggccactggcactccagacnggttcaggtggcaggtcggggtctggggacaggacttcactctccaccctnagcagacgtggacgtccgtagaagtatttgactagttgttaattctgtcagctagtagtgggtaggctaccgtttacgtacgtttcggccgtagggaccaagtcgtggacgagtaacgaaacgaacgtggtggtcgtagctaccgtatcgttcgtcttacc

SEQ ID NO: 134641 - DNA, 578 bp, Homo sapiens
  misc_feature: GYAE6OF02H0HIB.16.71.G05.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagtgtactactccacgaccggtgctcgatttagtgtcgtcgcaagagagagggggagagctgctcagttaggacccagagggaaccatggaaacccccagcgcagcttctcttcctcctgctactctggctcccagataccaccggagaaattgtgttgacgcagtctccaggcaccctgtctttgtctccaggggaaagngccaccctctcctgcagggccagtcagagtgttaccagcaggtacttagcctggtaccagcagaacctggcctggctccaggctcctcatctatggtnctatccagcagggccacgtggcatcccagacaggttcagtggctaggtgggtctgggaccaggtacttcgactcctccaccctcacgcagacgtcggagcctagaagtatttgcgtagttgttatttactgtacgtagcagttagttgggtacggtacctaccgttaacgtacgttttacgggaccgaagggtaaccaaggtcgttagggagtaacgtactaaaaccgtaacgtaggttcggctacgacgtacccgtaatttcctacgttcttaccg

SEQ ID NO: 134642 - DNA, 607 bp, Homo sapiens
  misc_feature: GYAE6OF02G05CP.16.71.G05.1.454.CMB.1.raw
  modified_base (606)..(606): a, c, t, g, unknown or other
  misc_feature (606)..(606): n is a, c, g, or t
tcagtgtactactccacgaccggtgctcgatttagtgtcgtcgcaagagagaggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcgaccggcagttagtcacccatactacttgactacgtgggccagggaccctggtcaccgtctcctcacgccctccaccgaacgggcccagtccggtccttcccccgtggcccaccctcctccgaacgacgccacctcggtcggggaccacgacgccggtcccgtcgggaccgtcgcccgttcgggtaccgaaacggtacccttaaccgttcccgggtaacgttaacgtaccgtaccgtaggacggtccggggccttcgggaccgaacggggccgaccgtaacgttacggagtcgagtcgacgng

SEQ ID NO: 134643 - DNA, 608 bp, Homo sapiens
  misc_feature: GYAE6OF02IB1R8.16.71.G05.1.454.CMB.1.raw
  modified_base (352)..(352): a, c, t, g, unknown or other
  misc_feature (352)..(352): n is a, c, g, or t
  modified_base (390)..(390): a, c, t, g, unknown or other
  misc_feature (390)..(390): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcaagaaacctggcctggcctccaggcctcctcatctatggtcgcatccagcacgggccacgtggcactcccagactaggttcagtcgganaggtgggtctagggacaggtactcacttctaccacctnacgcagtacgtggactcgtagtaagtagtttacgacgtagttagttactttacgtcgtactacgactaggttagttacgggtacgggtaccttaaccgtttaacgttaccgttttacgggaccggtaacgggaaccgtaacggtcgtacggaacgtacgtaaccgtaaacggtaacgtggtacgcgtcgacctaccgtagttacgttacgtcttaccg

SEQ ID NO: 134644 - DNA, 569 bp, Homo sapiens
  misc_feature: GYAE6OF02HABNM.16.71.G05.1.454.CMB.1.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaanacgcccaccctctcctgcagggccagtcagagtgttaccagcaggtacttagcctggtaccagcaagaaacctggcctggcctccgaggctcctcatctatggtnacatccagcgaggccacgtgcactccagacgagttcagtgcaggtggtcngggacagacttacactctccaccctnacgcagacgtggacgtccgtagaaacgtatttcgacgtagttgttacttacgttgtcgagtcgtaagtacgtaggtacggcctacctttacgtacgtttacggaccgtacgggaaccagtcgtacggagacgtaacgtaaaccgtacgtacgtcggactacgtaccgacctactcgtcgttctacg

SEQ ID NO: 134645 - DNA, 731 bp, Homo sapiens
  misc_feature: GYAE6OF02GQVA6.16.71.G05.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggccaccctgtctttgtctccgaggggaangcccaccctctcctgccagggccagtcagagtgttaccagcaggtactgcctggaccngcaagaacctggcctggcctcccgaggcctcctcacttcctagtgggtcgacctactcccgaggccgacggggcccctacgtcgggacctaccgtaccccgaaggtaaccgtagggtttccaaggttcgggaccgtagggttcggggttaccgtaggggaacctaacgggtacctttccgaaccttccgtacccctaccccgtgaacgtaccgaacggtacgtcgggacgtaccgtaggtaaacgttacgtttacggacgttaaggttacgttaacgtttaccgtagttacgaagtacgtaaggttacgttacgggttaacgggaccttaaccgtttaacgtttaccggtttacgggacccggtacggggtaaccgtaggtaccgtagggaacgtaacggtaacgaaaccgggtacgttacgggtacggtaccgtacgaccgtaaccgtacgttccgttcgttacttaccg

SEQ ID NO: 134646 - DNA, 533 bp, Homo sapiens
  misc_feature: GYAE6OF02F373O.16.71.G05.1.454.CMB.1.raw
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (373)..(373): a, c, t, g, unknown or other
  misc_feature (373)..(373): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacctctcctgcagggccagtcagagtgttaccagcaggtacttagcctggtaccagcagaaacctgcctggctccaggctcctnatctatggngcatccagcagggccatggcatcccagacaggttcaggtggcagtgggtcngggacagacttcactctcaccctnagcagactaggacgccgtagtaagtactttgactagtgttattacgttgtactagactagtagtaggtagggctaccgttacgtacgtttgccgacgggacagtcgtaggagacgtacaaacgtacgtacgtggtacgtagccacgtactctcgtcttac

SEQ ID NO: 134647 - DNA, 513 bp, Homo sapiens
  misc_feature: GYAE6OF02FG8UR.16.71.G05.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctntcctgcagggccagtcagagtgttaccagcaggtacttagcctggtaccagcagaaacctggcctggctcccaggctcctcatctatggtgcatccagcagggccactggcatcccagacaggttcaggtggcaggtgggtctggacagacttcacttctcaccctnagcagacgtggacgcctgaagtntttagcagttgtattactgtcatcagtatggtaggcaccttactacgttttcggccgacgggacagtctagagagtacaacgaactgtcggcacgcacctatctgttcttac

SEQ ID NO: 134648 - DNA, 555 bp, Homo sapiens
  misc_feature: GYAE6OF02G74ND.16.71.G05.1.454.CMB.1.raw
  modified_base (201)..(201): a, c, t, g, unknown or other
  misc_feature (201)..(201): n is a, c, g, or t
  modified_base (399)..(399): a, c, t, g, unknown or other
  misc_feature (399)..(399): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtactagcctggtaccagcagaaacctggcctggctcccaggctcctcatctatggtgcatccagcagggccacgtggcactcccagacaggttcagtggcaggtggtctggacagtacttcactctcaccctcagcagactggagcctagaagtntttgctagtagtattactgtcagtcagttagtgggtaggctaccgttacgtacgttttcggaccgtacggggaccaaggtcgtgggtaactacgtaacgaaaccggtaacgtcgggttacgacgttcggaccaccgtagtccgttgtcctttaccg

SEQ ID NO: 134649 - DNA, 522 bp, Homo sapiens
  misc_feature: GYAE6OF02GKTOH.16.71.G05.1.454.CMB.1.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaacctggcctggctcccaggctcctcatctatggtgcatccagcagggccactggcatcccagacaggttcagtggcagtgggtctgggacngacttcactcncaccctnagcagactggacgcctgaagtatttgctagtgttattactgtcagcagtatgggtaggtctaccttactacgttttcggccgtagggaccaagctaggacgtagtacgaaacgtaacgtggtaggtcgtcgcaccatctgtcttacg

SEQ ID NO: 134650 - DNA, 576 bp, Homo sapiens
  misc_feature: GYAE6OF02HPA2B.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctcctgcagggccagtcagagtgttaccagcaggtacttagcctggtaccagcagaaacctggcctggctcccaggctcctcactctatggtgcatccagcagggccactgacatccccagacaggttcagtggctagtgggtctgggacagtacttcactctccaccctcagcagactgggacgccgtagtaagtatttgactagttgttatttacgtgtcagctagttagtgggtacggtactaccgttacgtcgttttcggaccgtagggaaccctaaggtcgtaggtagtacgtaaccgaaaccggtaacgttggtaacggtcgttacgaccgaaccgtacgttccgttaggttccctttaccg

SEQ ID NO: 134651 - DNA, 567 bp, Homo sapiens
  misc_feature: GYAE6OF02GDQP2.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcaagaaacctggcctggctcccaggctcctcatctatggtgcatccagcagggccacgtggcatcccagacaggttcagtggcaggtgggtctgggacaggacttcgacttctaccaccctcgagcagactggacgtccgtagaagtagtttagactagttgttacgttacgtgtacacgacgagttacgtagggtacggtacctaccttaacgttcgtttacggccgaacgggtaccaagtcgtaggagagtaacgaaacgtacgtaggtacgtacttacgactacctagtacttcgttcttacc

SEQ ID NO: 134652 - DNA, 561 bp, Homo sapiens
  misc_feature: GYAE6OF02F9V1X.16.71.G05.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (291)..(291): a, c, t, g, unknown or other
  misc_feature (291)..(291): n is a, c, g, or t
  modified_base (365)..(365): a, c, t, g, unknown or other
  misc_feature (365)..(365): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggccaccctgtctttgtctccgaggggaaangccaccctntcctgcagggccagtcagagtgtaccagcaggtacttagcctggtaccagcagaaacctggcctggctccaggctcctnatctatggtgcatccagcagggccacgtggactactcccagactagggttcaggtggcaggtgggtctgggacngacttcacgtctcaccctgagcagactggacgtccgtagaagtatttcgcgagttgttaacttacttgtacagtctagtagtgggtaggtctaccttactcgtttacggaccgtacgggaacgagtcgtaggagacgtaacgtaaacgtacgtaggtacggtacgtacgactaccgtatccgttacgttccttacg

SEQ ID NO: 134653 - DNA, 529 bp, Homo sapiens
  misc_feature: GYAE6OF02GUE2O.16.71.G05.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaaacctggcctggctccaggctcctcatctatggtncatccagcgagggccacgtggcactcccagacaggttcaggtggcaggtcgggtctgggacagtacttcgactctccaccctcagcacgacgtggacgccgtagaagtagtttgcgtagttgttattactgtcagctagtagtggtacggtctaccttactacgtttcgcgtacggacagcgtaggagagtaacgaacgtacgtgtcgcgtcgcaccatctcgtctac

SEQ ID NO: 134654 - DNA, 770 bp, Homo sapiens
  misc_feature: GYAE6OF02G6BEA.16.71.G05.1.454.CMB.1.raw
  modified_base (548)..(548): a, c, t, g, unknown or other
  misc_feature (548)..(548): n is a, c, g, or t
  modified_base (614)..(614): a, c, t, g, unknown or other
  misc_feature (614)..(614): n is a, c, g, or t
tcagtgtactactccacgaccggtgctcgatttagtgtcgtcgcaagagagaggggagagctgctcagttaggacccagaggaaccatacggaaaccccagcgcagtcttctcttcctcctgctactctgcctaccagactaccacagagtaattgtgttacgacgctacgtcctaccgacggtcctaccgttgttacgtttcgaccgtacggaagggaacaccgtaccctacccgttcgtccgacgaccgacggaccgtagtacgaggttacgtaccgtaccgacgtacgttacggttaccgtacgtaccgtacggtaaccacggaaccgtaacgtacccgtcggtacccgtacgtaccctaccgtacgtccctactacgtagttacgtacggtcgtacgaccgtaccgaccggacggtaccgtaccgaccgttacgtacgtaccgtaccgtacggtacgtacggttacgtacggtcggtacggtaggtacggtacggtacgtacgtaccgtactacccgtacctaccgtacccgtacgtaaccgtnaccggtacgtacgtacgttacgtacgtagttacgttagtacgttagtacgttagtaccgttacgtnttacgacgtagtcggttaacgtacggttaccgtacgtacgtttacgtacggacggttaacgcgttaacgacgtagacgtacgtaaccgtcgtaccgtggttacccgacttaccgtactacgtttaccgtaccgtttccgttacggtacccttaccg

SEQ ID NO: 134655 - DNA, 518 bp, Homo sapiens
  misc_feature: GYAE6OF02IP6X0.16.71.G05.1.454.CMB.1.raw
  modified_base (201)..(201): a, c, t, g, unknown or other
  misc_feature (201)..(201): n is a, c, g, or t
  modified_base (377)..(377): a, c, t, g, unknown or other
  misc_feature (377)..(377): n is a, c, g, or t
  modified_base (514)..(514): a, c, t, g, unknown or other
  misc_feature (514)..(514): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtactagcctggtaccagcagaaacctggcctggcctcccaggctcctcatctatggtgcatccagcagggccactggcatcccagacaggttcaggtgcaggtggtctgggacagacttcactctcacccctnagcagacgtggacgccctagaagtatttgctagttgttattactgtcagtcagtatggtaggactacttactacgtttcggccgagggaccgagcgtaggagtagtacgaaacgacgtgtagcgtcgcaccatcgtntctc

SEQ ID NO: 134656 - DNA, 576 bp, Homo sapiens
  misc_feature: GYAE6OF02HCOCK.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttaccagcaggtacttagcctggtaccagcagaaacctggcctggctcccaggcctcctcatctatggtgcatccagcagggccacgtggcactcccagactaggttcagtggcaggtcgggtcagggacagacttcactctccaccctcagcagactaggacgccgtagtaaagtatttcggactaggttcgttaatttcgtgtcagtctaggttatgggtacggctaacctttacgtacgttttcggaccggtaacgggaaccacggtcgtaggacggtaactaacgaaacgtaacgtacggtacggtcgtacgaccaacctagttcgtacgttccttaccg

SEQ ID NO: 134657 - DNA, 575 bp, Homo sapiens
  misc_feature: GYAE6OF02HLRS6.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcgttgtggctattttaaaaggtgtccagtgtgaggtgcagctgttggagtcgtggggaggcttggcacagccgtggggggtccctgagactctcctgtgcagcctctggattcacctttgacagctatcgaccatcgacctggggtcccgccacggcctccgaggggaacggggctgggaagtggggtctcgaggtattacgtgggtggttggttactaccacatacgtacgcaggactccgtggaacgggcccgttacaccatcctaccagacgaactaactaccaaagaaccacaactagttatctacgacaaagtgaacagcctagagacgaccgaagaccacggacctaatctaattactgtacgaccggtaaagccaccgggactaacgttacgtaccaccctaacg

SEQ ID NO: 134658 - DNA, 618 bp, Homo sapiens
  misc_feature: GYAE6OF02HFS2G.16.71.G05.1.454.CMB.1.raw
  modified_base (201)..(201): a, c, t, g, unknown or other
  misc_feature (201)..(201): n is a, c, g, or t
  modified_base (411)..(411): a, c, t, g, unknown or other
  misc_feature (411)..(411): n is a, c, g, or t
  modified_base (436)..(436): a, c, t, g, unknown or other
  misc_feature (436)..(436): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctcctgcagggccagtcagagtgttaccagcaggtacttagcctggtaccagcagaaacctggcctggctccaggctcctcatctatggtgctatccagcagggccacgtggcatcccagactaggttcaggtgctagtcgggtctcgggacaggtacttcactctccgaccctcgagcagacgtggacgtcctagtaaagtntttagactagttgttaactttacgngttacagtctaaggttagtgggtaacggacctaaccgtttacgttacgttttacgggaccggtaacggggtaacctaaggtccgtagggtaacgtaacgttaacgaaaaccggttacgttacgggtacggtaccgttacggacctaaacccgttagttaccttacggttacctttaacccgg

SEQ ID NO: 134659 - DNA, 622 bp, Homo sapiens
  misc_feature: GYAE6OF02JDC3O.16.71.G05.1.454.CMB.1.raw
  modified_base (563)..(563): a, c, t, g, unknown or other
  misc_feature (563)..(563): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtcgtgggggaggcttggcacagccgtggggggtccctgagactctcctgtgcagcctctggattcacctttgacagctatgccatgacctgggtccgccaggcctccgaggggaacggggctaggaagtgggtctacgaggttacttacgtggttggtaggtttataccgactactaccgtacgcaacgaccgtccggtaggaacgggtcccggtttaccacctagtcctccgaagacgacaacttaccaaagaaccacacttagtactcgagaaccaaagtacgtaaccagtcccgtaggaacgacggacccgaacgaccgaccggtacctaattacgttaacgtttaccnggtaaccgacgaaacggcccaacccgggtactaacggtttccgaccccaacccttaacg

SEQ ID NO: 134660 - DNA, 814 bp, Homo sapiens
  misc_feature: GYAE6OF02IS23S.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtcttttttcttgtggcttattttaaaaggtgtccagtgtgaggtgcagctgttggagtcgtgggggaggcttggcacagccgtgggggtccctgagactctcctgtgcagcctctggtacttcctacctttgacagcttagtcgcctatcggtaccgtcgggtcccgccgacgggcctccgaaggggacggggtctagggaagttggggtctacgtaggttaatacggttgggtggttaggtttaactacccaactaacttaacgtaccggactaacggtaccttcccggtagggtaaccggggtccccgtttaccaaccctacgttacccgttacccgaaggtaacgtaacccttaaaccgtttaaacccgaaaacggtaaacctaacccgtaacgttttacggttaaaccttccggttacgtaaacctaaaaaggtttaaccggaaaacccgtaacggtacccgttaacgggaaaccggtaaaccgggacccccgggaaaacccgggtaaccgaaacccggggttacccctaaagttttaaacccggtttaaacttttaacccggtagggttaacccggaaccggttaaaaacggcccggtaaacccccggggtacgttaaaccgggtttaacgttacccccaaaccccttaacg

SEQ ID NO: 134661 - DNA, 582 bp, Homo sapiens
  misc_feature: GYAE6OF02ILDNR.16.71.G05.1.454.CMB.1.raw
  modified_base (495)..(495): a, c, t, g, unknown or other
  misc_feature (495)..(495): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtcgtgggggaggcttggcacagccgtggggggtccctgagactctcctgtgcagcctctggacttcacctttgacagtctatgccagtcgaccgtggggtcccgccgacgggcctaccgaaggggaacgggggctagggaagtcgggtctcgaaggttattacgtgggtggttagtttactaccgactatactacgcaagtacctccgtaggaacgggtcccggttacgacctatcctccgaagacgaacacttaccgaaagaaccactactgtaactctaganaaatacgaacagcctagaacgacgaccgacgacgacgaccatatattacgtgtacgacgaacgcacggactagtctaccgacctaag

SEQ ID NO: 134662 - DNA, 620 bp, Homo sapiens
  misc_feature: GYAE6OF02H09KO.16.71.G05.1.454.CMB.1.raw
  modified_base (185)..(185): a, c, t, g, unknown or other
  misc_feature (185)..(185): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttgtggctattttaaaaggtntccagtgtgaggtgcagctgttggagtcgtgggggaggcttggcacagccgtggggggtccctgagactctcctgtgcagcctcgtggtacttctacctttgacagctatgccatcgaccgtcgggtcccgccgacggcctccgaggggaacgggcgtaggaagtgggtctcgtaggtattacgtgggtggtggttataccactatactacgcacgacctcgtaggacggggtcccgtcaccgtatcctaccaagacgaacctaacttaccaaaacgaaccactaccttaggtaactctacgaactaaaagtacgaaactacgtcctaggaacacggacccgaacgaacccgacggtaccaattaactatttaacctggtacgaacggaaacgccgaacccgggtactaacggtttacctacccaacccgttaac

SEQ ID NO: 134663 - DNA, 638 bp, Homo sapiens
  misc_feature: GYAE6OF02HCHNO.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacctctcctgcagggccagtcagagtgtaccagcaggtacttagcctggtaccagcagaaacctggcctggctcccgaggcctcctcatctagtggtgcatccagcacgggccactggcatcccagacagttcagtggcaggtcgggtctgggacaggtaccttacgactccgtacaaccccgttcaacggccaggtaaccgtagggacgtccgtaggaaagttacgtttcgacgtaaggttagttactttacgtacgtacgtacgtactaaggttagttagggtacgggtacttaaccgtttaccgttacgttttaccgggaccggtaacggggaacccgtaacgcggttagggaacgtaacgtaacggaaaaccgtacggttaggtacggtactacggactaacccgtagttccgttacggttacttaccg

SEQ ID NO: 134664 - DNA, 604 bp, Homo sapiens
  misc_feature: GYAE6OF02GEZ7U.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctgttggagtcgtgggggaggcttggcacagccgtggggggtccctgagactctcctgtgcagcctctggactttccacctttgacaggtctatcgccagtcgacccgtgggtcccgccgaggcctccgaggggaagggctagggaagtgggtctcgaggtattacgtgggttggtggttactaccatatactacgcagaccgtcgtaggaacgggtccgttacaccgtatccgaccgagaacgactaacttacccaaagaaccactacttagtactacgtacgaacaaagtcgaaactacgtaccgtaggaacgacgaccgaacgaacgaccggtactataacttcttaacgtcgtacggacgtaacgccgaccggtatacggttacctaccaccttaac

SEQ ID NO: 134665 - DNA, 586 bp, Homo sapiens
  misc_feature: GYAE6OF02JH3KM.16.71.G05.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (386)..(386): a, c, t, g, unknown or other
  misc_feature (386)..(386): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtcttgtctccaggggaaangccaccctctcctgcagggccagtcagagtgtaccagcaggtacttagcctggtaccagcaagaacctggcctgactccaggctcctcatctatggtncatccagcacgggccacgtggcagtcccagactaggttcaggtggcaggtggtcgtgggacaggtacttcgacttccacctacccgtnacgcaacgacgtagggacgccctaggaagttacgtttgactagttagttatttacgtagtcagtcagttagtgggtacggcctaccgttacgtacgttttacggccgtacggggtaaccaaggtcgtaggaagtacgtaacgtaaacggtacgttcggtaggtcgtacgcctaaccgtacgttacttacggttcttaccg

SEQ ID NO: 134666 - DNA, 794 bp, Homo sapiens
  misc_feature: GYAE6OF02HWLW7.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccaccggagaaattgtgttgacgcagtctccaggcaccctgtctttgtctccgaggggaaanagccaccctctcctgcaggccagtcagagtgttaccagcaggtacttagcctggtaccagcaagaaacctggcctggcctccctggcctcctcacttctagttggtcgcctaacgtccgaaggccgacggggtacccaacgttcgggacctactccccgaaggtaccgtacggtttaccgaaggtcgggaccgtagggttcggggttacgtacggggtacaacggttacctttcccgtaaccttccgttacccgtaaccccttcgaacggtaccgtaacggtaaccgttacggggtaacggtacccgttagggtaaacgtttaacgttttaggaccgttaaggttagtttaacgtttacgtcgttaccgaggtacgtaaggttacggttacgggttaacgggtaccttaacccgttttaccggttaaccgtttttcggggacccggtaaacggggtaacccgttaaacggtaccgttaggggtaacggttaaccggtaaccggtaaaaacccggttaacggttacgggtaacgggtccgttacggtaccgtaaacccgttacgtttacccggttcgtttacccgtttaacccg

SEQ ID NO: 134667 - DNA, 749 bp, Homo sapiens
  misc_feature: GYAE6OF02FTIX5.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcgtggtcttttcttggtggctaattttaaaagggtgtccagtgtgaggtgcagctgttggagtcgtgggggaggcttggtacaggccgtggggggtccctgagactctcctgtgcagcctctggattcattctttagcagcttatgtcatcgaccgttcgggtcccaccgacggcctccggaaggggaacggggcgtgggaggttcgggtctcgtaggtttagttgggttgggttagttgggtttactaccgtactacgttaacgtacgacgtaacggtacccgttaccgggtacgggaaacgggggtccccgggtttaccaacccgtaactttcccgtacccgaaggtaacgtaaccctaaattaccccgaaaagtaacccaacctaacttaacgttaactcgtacgaactaaaacgtacgaaaccgacgccctaggaacgaccggacccgggtaaggaacccgggtaaccggtacccgtttaagtttaacccgtttacggtacggttaaccgggaaccgggtaaaaaccggggtccggaaacggggtttaactaacggggacctaaggggtttacgggtaccgttaacccgggg

SEQ ID NO: 134668 - DNA, 567 bp, Homo sapiens
  misc_feature: GYAE6OF02GUOZH.16.71.G05.1.454.CMB.1.raw
  modified_base (200)..(200): a, c, t, g, unknown or other
  misc_feature (200)..(200): n is a, c, g, or t
  modified_base (306)..(306): a, c, t, g, unknown or other
  misc_feature (306)..(306): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccaccctctcctgcagggccagtcagagtgttaccagcaggtacttagcctggtaccagcagaaacctggcctggcctcccaggcctcctcactctagtggtcncgtactccagcagggccacgtggcatcccagacaggttcaggtggactaggtggtcgtgggacagtacttcactctaccaccctcgacgcacgcgtacggacgccgtagagtatttgactagtgttattactgtcagctagttgtaggtacggtactaccgttacgtcgtttcgaccggtacgggaccaggtctaggtacgtacgtaacgaaacgtacgtaggtacggaccgtgtaccgtaccgtatcgttcgtcttaccg

SEQ ID NO: 134669 - DNA, 616 bp, Homo sapiens
  misc_feature: GYAE6OF02GC0LZ.16.71.G05.1.454.CMB.1.raw
  modified_base (232)..(232): a, c, t, g, unknown or other
  misc_feature (232)..(232): n is a, c, g, or t
  modified_base (312)..(312): a, c, t, g, unknown or other
  misc_feature (312)..(312): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcgtgtcgttttctaggtggctatttaaaggtgtccagtgtgaggtgcagctgttggagtcgtgggggaggcttggcacngccgtggggggtccctgagctctcctgtgcagcctcgtggacttcacctttgacagctatgccagtcgacctgggtcccnccgaggcctaccgaggggaaggggctagggaatggggtctcgaggttattacgtgggtggtggtttactaccactactacgtacgcacgacctccggtgaacggggtccgtcacctattccacagacgactaatacccgaaanaacacagtntactcgtacaactaaagtacgtaactacgaccgtagacgaccgaccgaacgaccgtaccggacttaagtacgttaacgttacgtacggtaacgaacggtaaccggaccgaaccggggttaccttaacggtttacccgtacccaacccttacg

SEQ ID NO: 134670 - DNA, 536 bp, Homo sapiens
  misc_feature: GYAE6OF02GEGD3.16.71.G05.1.454.CMB.1.raw
  modified_base (201)..(201): a, c, t, g, unknown or other
  misc_feature (201)..(201): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggtaccagcagaaacctggcctggctcccaggctcctcatctatggtgcatccagcacgggccactgacactcccgagacaggttcagtggcaggtgggtctgggacagtacttcactctaccaccctcacgcacgacgtggacgctagaagtagtttgctagtgttacttactgtcagtctagtagtggtaggctacttacgtacgtttggccgtagggtaccagtcgtaggagtacgtacgaacgtacgtgtaggctcgacacctatcgtcgtcttaccg

SEQ ID NO: 134671 - DNA, 527 bp, Homo sapiens
  misc_feature: GYAE6OF02GKFGY.16.71.G05.1.454.CMB.1.raw
  modified_base (231)..(231): a, c, t, g, unknown or other
  misc_feature (231)..(231): n is a, c, g, or t
  modified_base (409)..(409): a, c, t, g, unknown or other
  misc_feature (409)..(409): n is a, c, g, or t
tcagtgtactactccacgaccggtgctcgatttagtgtcgtcgcaagagagagggggagagctgctcagttaggacccagagggaaccatggaaacccccagcgcagcttctcttcctcctgctactctggctcccagataccaccggagaaattgtgttgacgcagtctccaggcaccctgtctttgtctccaggggaaagagccaccctctcctgcagggccagtcagngtgttaccagcaggtacttagcctggtaccagcagaaacctggcctggctcccaggcctcctcatctatggtcgcactccagcacgggccacgtggcactcccagacaggttcagtggcaggtggtctgggacagacttcactctctaccctcacgcagactggacgccgtagaagtntttgctagtgtattactgtcagtctagtgtggtagcctacttactcgtttgacacgggactagctaggagtataacgaaacgtacgtggtcgtctacgctaccatcttcgtcttaccg

SEQ ID NO: 134672 - DNA, 735 bp, Homo sapiens
  misc_feature: GYAE6OF02IGKKK.16.71.G05.1.454.CMB.1.raw
  modified_base (189)..(189): a, c, t, g, unknown or other
  misc_feature (189)..(189): n is a, c, g, or t
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (730)..(730): a, c, t, g, unknown or other
  misc_feature (730)..(730): n is a, c, g, or t
  modified_base (732)..(733): a, c, t, g, unknown or other
  misc_feature (732)..(733): n is a, c, g, or t
  modified_base (735)..(735): a, c, t, g, unknown or other
  misc_feature (735)..(735): n is a, c, g, or t
tcagtgtactactccacgaccggtgctcgatttagtgtcgtcgcaagagagaggggtcccgtgagactctcctgtgcagcctctgattcacctttgacagctatgccatgacctgggtcccgcgacggcgtccaggggaaggggcgtggaagtgggtctcgaggtattacgtggtggtggttataccanatactacgcagactcgtgacgggcgttcaccatctccagagacaattccaaagaacacactgtanctgacaaatgaacagcctggagagccgacgacacggtaccaatattattacgtgngacggaaagcgaccggactagttacgtacccaacctaattaaccttacttttagaaccgttaacggccggggtacccgaaaacgggggtaaccccccttggggtaccctaccccggttccctacccgttacccgaagtcccccctaaccaacccccggaaagggtaccccctaccgtacccggtttcccgttacccccgttcccggtcccctaacccccgttcccgttacccaacgaccgacccgtaccgtaccgtccggggtcgaaccgaccggccggtccgtacccgggcgtccggccgttcggaccgtaaccggaccttaaccgtccggtaacgttaaccggtacgtaaccgtacgggtaacggtccggggaccgtacgggtaccggaacgggtaccgtaccggacgtacggcacggngnngn

SEQ ID NO: 134673 - DNA, 834 bp, Homo sapiens
  misc_feature: GYAE6OF02I7UIT.16.71.G05.1.454.CMB.1.raw
  modified_base (198)..(198): a, c, t, g, unknown or other
  misc_feature (198)..(198): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtcttgctccaggggaanagccacctctcctgcagggccagtcagacgtgttaccagcaggtacttagcctggtaccagtcagaaacctggcctaggcctcccgaggtccctacctcacttacctagtgggtacgcctaacgtcccgaaggccgtaacgggggtccccaacggttcgggacctaacgttccccgaaggtaccgtagggtttaccaggttcgggctaacgggttcggggtaccgtagggggaaaccctagggtaacccttttccgaaccctttccgttaccccgaaccccgtttacgacggaccttaacggaaccggttcgggaacggtacccgtaggtaaacgttacgttttacggaccttacggttagttaacttttacgtacggttaccgtaacggtaccgtaacggtttaacggtacggggttaacggtacccgtttaaacccgttttaaccggttaccggtttttaaccgggaacccggttaccgggggtaaaaccccgttaaggttaccgggttacgggtaacgtaaccggtttaaaccggtaaaacccggttaacggttaaccgggttacggtaacccttaccggtaacccgtaacccgttacggtttaccgtttacccggtttccctttaaacccgg

SEQ ID NO: 134674 - DNA, 526 bp, Homo sapiens
  misc_feature: GYAE6OF02G5RI3.16.71.G05.1.454.CMB.1.raw
  modified_base (200)..(200): a, c, t, g, unknown or other
  misc_feature (200)..(200): n is a, c, g, or t
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcttccagataccaccggagaaattgtgttgacgcagtctccaggcaccctgtctttgtctccaggggaanagccaccctctcctgcagggccagtcagagtgttaccagcaggtacttagcctggtaccagcagaacctggcctggctcccaggctcctcatctatggtgcatccagcgagggccactgacactcccagacaggttcaggtggcaggtcgggtctgggacaggacttcactcgtccaccctcaggcacgactggacnctgaagtatttgcagttgttattactgtcagcagtntgggtaggctaccttacgttacgtttggaccgaggaccagcgtggactacgtacgaacgtacgtggtcgcgtagccactactctcgtcttacc

SEQ ID NO: 134675 - DNA, 679 bp, Homo sapiens
  misc_feature: GYAE6OF02G9I3D.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagcccaccctctcctgccgagggccagtcagagtgttaccagcaggtactagcctggtaccagcaagaacctggcctggcctacccgaggcctcctcactctagtggtcgcactcccagccgaggggcccacgtggaccacgtccccaaggaccgtagggttccaggttcgggacgtagggttcggggtcgtaggggaacctacggtacctttccgaaccttccgtacccaaccccgttcgacgtcgacgtacgtcggacgtccgtaggtaaagtactttcgacgtagttagttacgtttacgtgttacagtacgtagttagttagggtacggtaccgtaccgtttaaccgttacgttttaccgggaccggtaacggggtaacctacggtacgtacgggtaacgtacgtaaccgtaaaccggtacgtacggtacggtccgtagaccgtaccgtacgttaccgttgttaccgttaccg

SEQ ID NO: 134676 - DNA, 675 bp, Homo sapiens
  misc_feature: GYAE6OF02I45HO.16.71.G05.1.454.CMB.1.raw
  modified_base (200)..(200): a, c, t, g, unknown or other
  misc_feature (200)..(200): n is a, c, g, or t
  modified_base (322)..(322): a, c, t, g, unknown or other
  misc_feature (322)..(322): n is a, c, g, or t
  modified_base (436)..(436): a, c, t, g, unknown or other
  misc_feature (436)..(436): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgagggaangccacctctcctgacacgggccagtcagagtcgttaccagcaggtaccttaggccgtaggtaccagcaacgaaacctggccttggacctcccaggcctcccttacacttcctaagtcgggtncctacgtccaggcgacgggccctacgtgacctaccgtcccgagaaccgtaggttccaggtacgggctaggtcggggtctagggaacgtacgtacttcacgtctaccgacccgtnacgacacgacgtggacgtcgtagtaagtatttacggcgtagttcggttaactcgttgtaccgtagtacgtaggttagtcgggtagtaccgtaccgtttaacgttacgtttaccgggtaccggaacgggtacctaacggtcggttacgggtaaacgtacgttaaaccggaaaccgttacggtcggttacggttaccgtacggttccgaaccttacggttccgtacggtttaccttacccg

SEQ ID NO: 134677 - DNA, 698 bp, Homo sapiens
  misc_feature: GYAE6OF02HMSD4.16.71.G05.1.454.CMB.1.raw
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcgtggtcgttttctaggtggcttaatttaaaggtgtccagtgtgaggtgcagctgttggagtgtgggggacgcttggcacncgccgtcggggggtccctgacgactctcctgtgcagcctgtggactctaccttgacagctancgaccagtcgtaccgtcggtacccgccgaggtcctaccggaaggggaacggggctagggaaggttcggggtcctacggtaaggttaacgttacggttggggttagggttagggtttaaactaaccctaaacgtaacgttaaccgttaccgaaccgtaacggtaaccgttacccgggtagggtaacccggggtcccgggtttaccaaacccggtttatcccgtaacccgaagggtaactaacccttaaacggttaccccaaaaggtaaacctaccgacgtttagtaactccgttaaggaacaaacgttacgaaactcgtacaaggacgcggacacgacgaccgtactatacttagtactggtaccgacgaacgcaccggagttacggtacctcctacccgtaa

SEQ ID NO: 134678 - DNA, 686 bp, Homo sapiens
  misc_feature: GYAE6OF02JUYHW.16.71.G05.1.454.CMB.1.raw
  modified_base (200)..(200): a, c, t, g, unknown or other
  misc_feature (200)..(200): n is a, c, g, or t
  modified_base (325)..(325): a, c, t, g, unknown or other
  misc_feature (325)..(325): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggtagaaattgtgttgacgtcagtctccaggcacctgtctttgctcgaggggaangccacctctcctgcagggccagtcaggagttcgtaccagccgtaggtacttagccgttggtaccaggccaagtaaacctggaccctggcctcccgaggtccttcctcgctacgtagtacgggtcnccgtaacgtccaaggccggaacgggtccacgtggacctacgtacccctaggaccgtcggtttacgacggtggtacgtaggtcgggttcgaggggacagtccgttacacccgttctccgaccctgtacgaccaacgtacgtcggtaacgacgtaggtaacttgtttacgacgtagttcgttaactacgtttcgacgtacgactaggtaggtacggttacggacctttaccgtaacgttccggtttaggaccggtaacgggttaacctacgggtaccggaaggaccgttaagaaccgtaaccggttactacggggttactaccgttccggtaactacccgtagtacggtcgtttacctaccgg

SEQ ID NO: 134679 - DNA, 584 bp, Homo sapiens
  misc_feature: GYAE6OF02FMCVA.16.71.G05.1.454.CMB.1.raw
  modified_base (201)..(201): a, c, t, g, unknown or other
  misc_feature (201)..(201): n is a, c, g, or t
  modified_base (384)..(384): a, c, t, g, unknown or other
  misc_feature (384)..(384): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttaccagcaggtacttagcctggaccagcagaaacctggcctggcctccgaggcctcctcatctagtggtgcatccagccgagggccacgtggcactcccagacaggttcagtgcaggtcggtctgggacagtacttcactctacaccctnacgacacgacgtcggacgcctaggtaacgtatttacgacgtaggttagttattacgtgtcgagtctagtagtgggtacggtactaccgttacgttacgttttacggaccggtacgggacctaacggtacgtaggtaacgtacgtaacgaaacgtacgtaggttcggtacgtacgaccgactacgtctacgttacttaccg

SEQ ID NO: 134680 - DNA, 771 bp, Homo sapiens
  misc_feature: GYAE6OF02I8C6T.16.71.G05.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccaccctctcctgcagggccagtcagtgtgttaccagcaggttacttagccgtggtaccagcaagaaacctggcctggcctccgaggcctcctnatctagtggtgccatccagcgtaacgggccctacgtggcctactacccgaggacgtacgggttcgaggtcgggctaggtcggggtactagggggtaaccaggttaacctttaccacgttccctacctaaccccgttacgacggtaccgtaacgggtaccgtagggtaacggtacccggtaggttaaacgggttacgttttacggaccggttaagtttcggttaacgtttaaccgttacggttaaccgttaacggtacgtaagggttaaggttacggggttaaccgggtaaccgtttaccgttttaaaccgtttaccggttttaccgggtaccggtaaacgggggttaacccgtaaggtaccgggttagggtaaccggtaacggtaaccggtaaaaccggttaacggttccgggtacggttaccgttaggtaacccgttaacctaacgttaccgtttacggttaccctttaacg

SEQ ID NO: 134681 - DNA, 635 bp, Homo sapiens
  misc_feature: GYAE6OF02GY8WI.16.71.G05.1.454.CMB.1.raw
  modified_base (202)..(202): a, c, t, g, unknown or other
  misc_feature (202)..(202): n is a, c, g, or t
  modified_base (375)..(375): a, c, t, g, unknown or other
  misc_feature (375)..(375): n is a, c, g, or t
tcagtgtactactccacgaccggtgctcgatttagtgtcgtcgcaagagagagggggagagctgctcagtttaggacccagagggaaccatggaaaccccagcgcagcttctcttcctcctgctactctggctcccagataccaccggagaaattgtgttgacgcagtctccaggcaccctgtctttgtctccgaggggaangcccaccctctcctgcagggccagtcagagtgttaccagcaggtacttagcctggtaccagccagaaacctggcctggcctcccgaggcctcctcatcctagtggtgcactccgagtcgacgggccacgtggccactcccagaccgtaggtccagtggacagggttgggtcgngggacagacttcacctctccacccgtcacgtcagacgtggacgctagagttagtttgactagtgttacgttactgtactagtactaggttagtacgggtacggtacctaccgtttacttacgttttcggacggtacgggtaaccaggtacgtacggaacgttaacgtaacggtaaaacggtaaccgttacgggtaccgggtaccgtttaccggacccgttaacccgtacgtttacccgtttacggttaccctttaacccg

SEQ ID NO: 134682 - DNA, 811 bp, Homo sapiens
  misc_feature: GYAE6OF02I7AC7.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtactagcctggtaccagcagaaacctggcctggcctccaggctcctcatctatggtgcatccagcgacggggccacgtcggctactccccaaggacctagggttaccaggtcggacgtaggttgggttccgtaggggacctaacggtacctttcgaccttcctaccgaccccttacgaacggtccgaacgtaccggtagggaccggtacccgttaaggtaaacggttacgtttttacggaccgttaaggttacggtttaaacgttttaccgttacggttaccgtaacgggtaccgtaagggtttaacggttacgggggttaaaccgggttacccgtttaaacccgttttaaccggtttaacccggttttttaccggggaacccgggttaaaccgggggtaacccgtaacgggttacccgggttaggggtaaaccggttaaccggttaaaaccgggtaaaaccggttaaaccgggtttacggggttaacccgggtacggtttacccgggtaaccccttaacccggttaaccgttttacccggtttaccggttaccccttttaacccgg

SEQ ID NO: 134683 - DNA, 647 bp, Homo sapiens
  misc_feature: GYAE6OF02IH69L.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttctgtggctattttaaaaggtgtccagtgtgaggtgcagctgttggagtcgtgggggagcgttggcacaggccgtggggggtccctgagactctccgtgtgcagcctctggattccacctttgacagctaatcgccatcggaccgtcggggtcccgccgacggcctaccggaaggggaacggggtcgtagggtaagtcgggtctacgaggttattacggtgggtggtaggttactaaccgatactaactacgcagtactcggtacggaacgggtcccggttacaccgtaacttccgtacgaagaccgtaactaacttaccgaaaggaacctacgaccttaggtacttcgagacctaaacgtacggaaccacggtaccgtagaacggaccgaccggaaccgacgacccggtaccaagttaactacgttaccgtaggtcgaacgtaaacgcccggtaccggactacggttacctacccacttaaccg

SEQ ID NO: 134684 - DNA, 687 bp, Homo sapiens
  misc_feature: GYAE6OF02J0M7A.16.71.G05.1.454.CMB.1.raw
  modified_base (334)..(334): a, c, t, g, unknown or other
  misc_feature (334)..(334): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctcccagactacccaccggagaattgtgttgacgcagtctccaggcaccctgtctttgtctccgaggggaaagcgcccaccctctcctgcacgggccagtcagacgtgttaccagctaggttactacggcctggtacccagtaccacggaaacctcggccgtcggccctacccgacggtcctccgtacactctagttcgggcncatccgaggccgtacgggcctacggtcggacctacctaccccgaggtacccgtagggttacgacggtcgggacgtacgggttcgggtaccgtaggggactacggtacccttctacccgtccgtaccctaacccgtcgacgtacgaacgtacgtcgggtacgaccgttagtaacgttagtttacgacgtacgttacggtttagttaccgttacgtaccgtaagtcgttaaggtacggtacgggtacggtaccgttaccgttacgtaccgtttaccggaacggtacggtacgagtccgtagagtacgtacgtaactagtacgtacgtcgtacgactacgtcgtacttctctaccg

SEQ ID NO: 134685 - DNA, 639 bp, Homo sapiens
  misc_feature: GYAE6OF02GF3QP.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagagtgttaccagcaggtacttagcctggtaccagcagaacctggcctggctccaggctcctcatctagtggtgctatccgagccgagggccacgtggacatcccagacctaggttccaggtggactaggttcgggtctgggacacggtacttacgacttcctccaaccctgacgaccgaacgacgtacgggtacgcccgtagtaaaggttacgttttcggacgttaggttacggttaacgtttacgtcgttaccgtaacgtcgtaacggttagttacggggtacggtaccttaccgtttacgttacgttttacggaccggaacggggtaaccaagggtccgtagggaacgtacgtaacgaaacgtacgtggtacgacgtacgaccgtaccgtacgtccgttgtaccttacg

SEQ ID NO: 134686 - DNA, 621 bp, Homo sapiens
  misc_feature: GYAE6OF02HKE03.16.71.G05.1.454.CMB.1.raw
  modified_base (595)..(595): a, c, t, g, unknown or other
  misc_feature (595)..(595): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttcttgtggctattttaaaggtgtccagtgtgaggtgcagctgttggagtcgtgggggaggcttggcacagccgtggggggtccctgacgactctcctgtgcagcctctggattcacctttgacagctatgcccatcgacctcggggtcccgccacggcctcccgaagggggaacggggtcgtggggaaacgttcggggtctcgtaaggttattacgtggggttggttggtttaactaccgtacattaacctacgacacgtaccgtccggtaggaacgggtcccggttacaccgatcctccaagacgactaactaccaaagaaccactacgtagtatctagacaaattcgaaacacgtcctaggacgtaacgaccgacgaaccaccgacctaattacttaatacctaggtacgaacgtaacgccgaaccggtntaacggtttacgcccaacccttaacg

SEQ ID NO: 134687 - DNA, 927 bp, Homo sapiens
  misc_feature: GYAE6OF02IKYK6.16.71.G05.1.454.CMB.1.raw
  modified_base (424)..(424): a, c, t, g, unknown or other
  misc_feature (424)..(424): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtctttttcttgtggcttattttaaaggtgtccagtgtgaggtgcagctgttggagtcgtgggggaggcgttggcacgaggccgtcggggggtccctgagacgtctccgtgtcgtcacgcctcgtggacttctaccgtttgacagtctatcgccagtacggaccgttcgggtcccgaccgacggtccgtacccggaagggggtaaacgggggtccgtacgggtaagttcgggggttacttaccggtaacgggttaacgtttaaccggngggtttggggttacgggttttaacgtaacccgtaacgtaacgttaaccgtaacccggtacgtaacggtaacccgtttcccgggttaagggtaaaccgggggtcccggtttaccaaaccccgtacgtttacccgtaccggaaacggtaaacggtaacccgttaaaacgttaaccccgaaaagggaaacccctaaacgttaacccgttacggtttaaaccgtccgtaaccgggtaaaccgttaaaaaacggttacccggtaaaaacccgacccgggtttaaaccccgggtttaaggaaaaccgggtaaacccggggtaaccccccggaaaaccgggtaaaacccggaaccccggggttaaccccttaaaggtttaaccgtttaaacgtttaaccccgggttagttaacccgggaaaccgggttaaaaacccggcccggtaaacccccgggggttacgttaaaaccgggttttaaccggtacccccctaaaccccggtttaaaccc

SEQ ID NO: 134688 - DNA, 682 bp, Homo sapiens
  misc_feature: GYAE6OF02GN24A.16.71.G05.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctcaggggaaangccacctctccngcagggccagtcagagtnttaccagcaggtacttagcctggtaccagcaagaaacctggcctggcctccgaggcctcctnactcgtatggtncatccagccgagggccagtcggcactcccagactaggttcaggtcggacaggttgggtcgtggggaactaggtaccttacgaccttcctaccgtaacccctgaacgtaccgtaacggacgtacgggacgtaccgtaaggtaaacgttaacgtttcgaccgtaaggttacgtttaactttacgttaggtacaaggtactaaggttacggttacgggttaacggacctttaacccgtttaacgttaccggttttcgggaaccggtaacgggaaccgtaacgggtcgttacgggtaacgtaacgtaaccggtaaaaccggttacggtaggttacggtacgtacggaccgtaacccgttacgtacgtttacgttaccgttac

SEQ ID NO: 134689 - DNA, 873 bp, Homo sapiens
  misc_feature: GYAE6OF02HHQC8.16.71.G05.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaancgccaccctctcctgcagggccagtcagagtgtaccagcaggtacttagcctggtaccagcaagaaacctggcctggcctcccgaggcctcctcatctagtggtcncactccgagcgacgggccctagtggccacgtcccgagtaccgtaggttcgaggtcggcgtagggttcgggtcgtagggactaggtaccttacgacctttccgtacccctacccgttacgacgtacgtaacggtaccggtagggacccggtaccgttaagggtaaacgtttacgttttacggacgttaacggtttacggtttaaacgttttaccggttacggttaccgtaacggtaccgttaaagggtttaacgggttacggggggttaaaccccgggttacccttttaaaacccccggtttttaacccgggtttaaccgggtttttttacccgggggaacccccggggtttaaaacggggggtaaaccccgttaaacgggggtttaccccgggttaagggggttaaaccggtttaaacccggttaaaacccggtaaaacccggggtttaaaaccggttcggggtttaacccggggtaacccggtttaacccgggttaaacccccggttaaacccgttaccggtttttacccgggtttaacccggttttacccttttaacccccggg

SEQ ID NO: 134690 - DNA, 733 bp, Homo sapiens
  misc_feature: GYAE6OF02HT605.16.71.G05.1.454.CMB.1.raw
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagcccaccctctcctgcagggccagtcagagtgttaccagcaggtacttagcctggtaccagcagaacctgcctggctccaggctccncatctatggtncatccagcgacgggccacgtcggacactcccgagtacgtaggttcaacggtggacgtagggttcggggttctaggggaaccaggtacctttccaaccgttccttacccgaccccttacgacgtaccgtacggaaccgttacgggtaccggtacccgtaggtaaacggttagttttacggaaccgttagttacgttaacgtttaacgttggtaaccgtaacgtacgtaaagggtttacgtaggggttaacggggttaccctaaccgtttttaaccgttaaccggtttttacgggaccccgggtaaacggggtaacccgtaagggtaccgttacggggtaacgtaaccggtaaaccggaaaccggttaaaccgttgggttaccggtaccgttacggtacctaacccgtacgtttaccgttcgttacgtttacccg

SEQ ID NO: 134691 - DNA, 737 bp, Homo sapiens
  misc_feature: GYAE6OF02HJXLX.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccagggaagagccaccctctcctgcagggccagtcagagtgttaccagcaggtacttagcctggtaccagcaacgaaacctggcctggcctcccgagcctcctcattctagtggtcgctactccgagcgacggggccacgtcggcacgtacccagtaccgtaggttacgacggttcggcgtagggttcgggtccgtaggggaacctaggtacctttccgaccttccgttacctaaccccctcgtaacgaccgaacggtaccgtacgggacgtacccgttacggtaacggttaagtttttacggaccgttaacggtttacgttaacgttttaccgttacggttacccgtaagtacgtaagggttacgttacgggggtttaaccggtaccgttaacccgtttaaccggtttacggtttttaccgggaacccgggtaaacggggtaaccctaacgggttcggtacggtaagtaaccggtaaaccgaaacggtaccggttaggtacggtacctacggtaccaacgttacctttcgtaccggttaccttacg

SEQ ID NO: 134692 - DNA, 707 bp, Homo sapiens
  misc_feature: GYAE6OF02IWNQE.16.71.G05.1.454.CMB.1.raw
  modified_base (202)..(202): a, c, t, g, unknown or other
  misc_feature (202)..(202): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaanacgcccaccctctcctgcagggccagtcagagtgttaccagcaggtacttagcctggtaccagcagaaacctggcctggcctccgaggtctccgtcatctagtggtcacactccgaagccgacggggcccaacgtcggactaactccccgagaccgtacggttcacggttcggcgtagggtcggggttccgtttagggactacgtactttaccgaccttcccgtaccaacccccgttgacgtaccgtaacggtaccgtacggacgtacccgtagtaaacggttacttttacggacgttaaggttacgttaagtttacttcgtaccgtaagtaccgtaaggttacggttacgggttacggtaccgttacccgtttaacgttacgtttttaccgggaccggtaacggggtaaccgtaacggtaccgttacgggagtaaccggtacgaaaccggtaacgtcggttacggtcgttacggaccaccgttcgtaccgttcgtacttacccg

SEQ ID NO: 134693 - DNA, 789 bp, Homo sapiens
  misc_feature: GYAE6OF02HWODN.16.71.G05.1.454.CMB.1.raw
  modified_base (202)..(202): a, c, t, g, unknown or other
  misc_feature (202)..(202): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaanagccaccctctcctgcagggccagtcagagtgttaccagcaggtacttagcctaggtaccagcaacgaaacctgcctggcctccaggctcctnatctatggtncactccgagcgacgggccacgtggacacgtcccgaagaccgtaggttaccaggtcggtacgaggttacggggtccgtagggaactaacggtacctttacaccttccgttaccccgaacccttacgaacgtaccaacggtaccgtacgggaactacccgtaaggtaaacgttactttacggaaccgttaggttacggtttaacgttttaaccgttaggttaccgtaaaggtaccgttaaagggttaagttacgggggttaaccggtaccgtttaacccgttttaaccggtttaacccggttttttacggggaaccccgggttaaaccgggggtaaacccgtaaacggttaccgggttaacgggtaaacggtaaccggttaaacccgtaaaaaccgggtaacggtttaacgggttaccgggtaacccgtttacggaacccgtaacccgttaacgtttcccgtttacgggttacccctttaaaccgg

SEQ ID NO: 134694 - DNA, 741 bp, Homo sapiens
  misc_feature: GYAE6OF02HSN0D.16.71.G05.1.454.CMB.1.raw
  modified_base (567)..(567): a, c, t, g, unknown or other
  misc_feature (567)..(567): n is a, c, g, or t
tcagtgtactactccacgaccggtgctcgatttagtgtcgtcgcaagagagagggggagctctgagagaggagcccagccctgggatttttcaggtgttttcattttggtgatcaggactgaacagagagaactcaccatggagtctgggctggagcgtggtcttttttcttgtggcttaagttttaaaaggtgtccagtgtgaggtgcagctgttggagtcgtgggggaggcttggcacgacgccgtcgggggggtccctgacgtactctcctgtgcagcctgtggtattcctacctttagacagctatcgaccatcggtaccgtgggtcccgccgacggcctaccggaggggaacggggtctagggaagttgggtactactaggttacgttacgttcgggttgggttacggtttaactaacccgaactacgttaacccgttaacgtaccgaacggttaccctaccggggttaacgggtaacgggtacccccgggttttacaaccgttacctcccgtaccgaaggtaacacgtaacttaacccgaaagtaaaccacgtacttagtntactacgagttaaacacggaaccacgtaccgtagaaccggtaacgacccggaaccgaaccgaccccggtactaagtttaaaccgtttaacttaacgttacggtaccggaaacggtaaccggtaacccgaccgggtttaccaaaccggttttacgaacccctaccctttaaaccg

SEQ ID NO: 134695 - DNA, 588 bp, Homo sapiens
  misc_feature: GYAE6OF02GTCQV.16.71.G05.1.454.CMB.1.raw
  modified_base (393)..(393): a, c, t, g, unknown or other
  misc_feature (393)..(393): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccacgtggcatcccagacaggttcagtggcaggtgggtctgggacaggacttcactctccacctcacgcagactggacnccgtagaagtgtttgcgtagttgttactttacgtgtacgagtactaggttagtgggtacgggtccgttaaccgttacgtacgttttcgggaccggtaacggggaacctaaggtcgtagggtaacgtacgtaaccgaaaccggtaacgtaggtacggtactacggacctaccgtagttccgttacgttccttaccg

SEQ ID NO: 134696 - DNA, 774 bp, Homo sapiens
  misc_feature: GYAE6OF02G1324.16.71.G05.1.454.CMB.1.raw
  modified_base (65)..(65): a, c, t, g, unknown or other
  misc_feature (65)..(65): n is a, c, g, or t
  modified_base (134)..(134): a, c, t, g, unknown or other
  misc_feature (134)..(134): n is a, c, g, or t
  modified_base (238)..(238): a, c, t, g, unknown or other
  misc_feature (238)..(238): n is a, c, g, or t
  modified_base (715)..(715): a, c, t, g, unknown or other
  misc_feature (715)..(715): n is a, c, g, or t
tcagtgtactactccacgaccggtgctcgatttagtgtcgtcgcaagagagagggggagctctgngagaggagcccagccctgggattttcgaggtgttttcatttgttgatcaggactgaacagagagaactnaccatggagtcgtgggctgagctggtcttttttcgttgtggcttattttaaaaggtgtaccagtgtgaggtgcagctgttggagtcgtggggagcttggcacgngccgtggggtcctgagactctccgtgtacgcacgcctcgtaggtacttccgtacctttgactaagtcctagtcgccctagtacgtccgttacgggtcccgaccgtaagggcctcccggtaaggggaacgggccgtggtaaaggtccggggtcctacggtaaacgtacgttcgaaaccgtaacggtacccgaagggttaacgtaacggttaacccggaccgttaggtaccgggttaacgaccggaacgttaaccggttcccggtaaggggtaaccgggggttcccttttaccgaaacccgttacgtttaaccgaccgttaacggaaaccgtaaaccgtaaaccgttaaccaaaggaaacccacgttcgtaagttacgttaacgtaacaaacgtttacgaaacgttacgtttacgaagtacggtaacggtcggaaacgtaccgtacgggtacctaagtaacgtttaaccgtacggttanaccggtaacgtaacggtccgggtaaagtttcccggggaaggtttccggaacgttaccgg

SEQ ID NO: 134697 - DNA, 735 bp, Homo sapiens
  misc_feature: GYAE6OF02IE41D.16.71.G05.1.454.CMB.1.raw
  modified_base (200)..(200): a, c, t, g, unknown or other
  misc_feature (200)..(200): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctcccagataccaccggagaaattgtgttgacgcagtctccaggcaccctgtctttgtctcaggggaangcctaccctctcctgcaggccagtcagtagtcgttaacagcgtaggttacttacgtccgttggtaaccaagtccgaacggtaaaccgtcggacctcgggtaccctaccccgaaggcccttccctcgacttcttaagtcggtcgacctactccgagcggacggacctaacctgaacctactcccgaagtaccgttacggttcaggttcggagtacggtcggggttaccgtcgggtaacgtacgttacgttacctaaccgttcctaacccgtaccgtaaccggacgacgtaacggtacggttacgggaaccgtaccgtaacggttaaacttacggttttacgaccggttaaagtttaccggtttaactttaacgggtcttaaccgaacggttctaaacggttacgtaccggggtaacgaccttaacgtttacgtcgtttacgggaccgtacgggtacaaggtccttaggaacgtacgtaacgtaaccgacgttaggtaccgagttccgacgtacctaggttacccttgtaccttacc

SEQ ID NO: 134698 - DNA, 748 bp, Homo sapiens
  misc_feature: GYAE6OF02HK9L6.16.71.G05.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcacccttgtctttgtctccgagggaaanagcccaccctctcctgcagggccagtcagagtgtaccagcaggtacttagcctgaccngcaacgaactgcctggcctacccgaggcctccgtcatctatggtcgcatccgagcgacgggtccacgtcggacctacgtccccgaagtaaccgtagggtttaccaggttacggccgtagggtttacggggtcgtacggggaacctacggttacctttaccgaccttccgtacccgtacccgtacgtagaccgtaacggtaccgtacgggaccgtacccggtaaggtaaacgtttacgtttacggtacgtacgttacgttacgtttaccgtagttaccgtaacgtacgttaacggttaggtacgggttaaccgggtaccttaaacccgttttaccggttaaccggttttaccgggaaccggttaaaccggggtaaccgtaacgggttcggtacgggtaacgttaacgtaaccggtaaaaccggttaacggttcggtaacggttaccgtacggtaaccgtacttacgttaccgttcggttaccttaaccg

SEQ ID NO: 134699 - DNA, 744 bp, Homo sapiens
  misc_feature: GYAE6OF02H1QWJ.16.71.G05.1.454.CMB.1.raw
  modified_base (204)..(204): a, c, t, g, unknown or other
  misc_feature (204)..(204): n is a, c, g, or t
  modified_base (567)..(567): a, c, t, g, unknown or other
  misc_feature (567)..(567): n is a, c, g, or t
tcagtgtactactccacgaccggtgctcgatttagtgtcgtcgcaagagagagggggagagctgctcagttaggacccagagggaccatggaaaccccagcgcagcttctcttcctcctgctactctggcctcccagataccaccggagaaattgtgttgacgcagtcctccaggcctaccctgtctttgtctcgaggggaaancgcccaccctctctgccacggccagtcagtagtcgttaccaagcgtaggtacttacgccgttacggtaccagaccgaacgaaaccgtcggtacccgtcgggtaccctccccgagggtcccttaccctacctacgttactacgttcgggtacgtcctaaccgtcccggaaggtaccggacgggtacccctaacggtcgggcctaacccgtccccgaaggtaccggtacgggtttacacgggttcggacgtacggggttcgggttacggcgggtaactaacggttaccttaccgaaccgtttccctccctaacccgtagaacgtcccgaaggtacccgtagcgtcgttaaaggtacttaggttcncgttaagttcttacgttctaggtcaaggtcttaggttagttcgggtacggacctttaccgttaacgttcggtttacgaccgggtaacggtaacctaggcggttagacgtaacgtaaccggaacgttcgtcggtaccgttcacgtacccgagtttacccgtcttacggttccttaccg

SEQ ID NO: 134700 - DNA, 735 bp, Homo sapiens
  misc_feature: GYAE6OF02IVPAV.16.71.G05.1.454.CMB.1.raw
  modified_base (207)..(207): a, c, t, g, unknown or other
  misc_feature (207)..(207): n is a, c, g, or t
  modified_base (315)..(315): a, c, t, g, unknown or other
  misc_feature (315)..(315): n is a, c, g, or t
  modified_base (627)..(627): a, c, t, g, unknown or other
  misc_feature (627)..(627): n is a, c, g, or t
  modified_base (687)..(687): a, c, t, g, unknown or other
  misc_feature (687)..(687): n is a, c, g, or t
  modified_base (719)..(719): a, c, t, g, unknown or other
  misc_feature (719)..(719): n is a, c, g, or t
tcagtgtactactccacgaccggtgctcgatttagtgtcgtcgcaagagagagggggagctctgagagaggagcccagccctgggatttttcgaggttgtttttcatttggtgtatcaggactgaacagagagaactcaccatggagtcgtgggctgagcgtcgtcgtttctagtcggctaattttaaaggctactagtgtgagtcngagtctgtgcgtcgtggggacgtcttaggcctagtacggcggtcgggggtccctagacggtcctcgttccgacgttgactacggtacctcggttgtaccgtttaaccncggttttaacgacgtacttaacccggtaactacggttccctaacgttacggtaacccgttacgggttcccgaaccgttaacggcctttaaccggggtaagggaaaccgggtcgtaggggtaaacgttcggtaaccgtcgttaaggtaaacctggttacgggttggtacctttaaacaccgttaacgtaaactaccgggtactaacgacgttacccggacgttacggtaaccggtacgtttaccgaacttaccgtctaccgacgactaacggaaccttagaaaccgtaactaactacgtactagtcctaaganaaccgtatacgaattccgaatgaacgacgaacctcggacctaccagttaaccagttacgngttaaccgacgtaagacccgtagccggttaanacccgtatccttaacg

SEQ ID NO: 134701 - DNA, 783 bp, Homo sapiens
  misc_feature: GYAE6OF02GQFVN.16.71.G05.1.454.CMB.1.raw
  modified_base (197)..(197): a, c, t, g, unknown or other
  misc_feature (197)..(197): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctcaggcacctgtcttgtctcaggggaaangccaccctctcctgcacgggccagtcagtagtcgttaccagcaggtacttagcctggtaccagcaagaacctggcctggcctcccgaggcctcctgacttctagtggtgcctatccaggccgacggggcctaacgtcgggacctacgtccccaaggtaaccgtcgggtttacaacgggtttggaccggtaagggtttcggggtaccgtttagggggaaccaaggttacccgtttacgaaccctttcccggtaccctaaccccgtttacggaaccggtacgtaaccggttaacgggttaccgggaaccgttacccggttaaaggttaaaccgggtttaactttttccggggaacgtaacggtttaggtttaaacttttacggttacggttacgtacggttactaagggttacgttacgggttacgggtaccttaaccgtttacgttacggttttacgggacccggtaagggtaacccgtagggtaccggttacgggacgtaacggtaacgtaaaaccggtaacgttcgggtacgggtaccgttacggtacccgaaccgttacgtttaccgttaggttacccgtttac

SEQ ID NO: 134702 - DNA, 790 bp, Homo sapiens
  misc_feature: GYAE6OF02FGO9V.16.71.G05.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (300)..(300): a, c, t, g, unknown or other
  misc_feature (300)..(300): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcacctgtctttgtctccaggggaancgccacctntcctgcagggccagtcagagtgttaccagcaggtacttagcctggtaccagcagaacctggcctggctcccaggctcctcactctagtggtnctatccagcgagggccacgtggacacgtcccgagacgaggttcaggttcggcgtagggtcggtcgtgggaacctacggacctttccgaccttccgtacccgtacccccgtacgtaaccggtaccgtaacggtaaccggttacggggtaaccggtacccggtttaacgggtaaacggtttacgtttttacgggaccgttaacgggttacggttttaaacgttttaaccgtttacgggttacccgtaacgggtaccgttaacgggtttaacggtttacggggttaaccggggttacccgtttaacccgtttttaaccggttaccggttttttaccggggaacccggttaacgggggtaaaccctaacgggttaccggttacgggtaacgtaaccgttaaaccggtaaaccgggttaaccggtttacgggtacggtaccgttacggtaacccgtaaccgttacgtttaccggttacgtttaccgtttaacccg

SEQ ID NO: 134703 - DNA, 627 bp, Homo sapiens
  misc_feature: GYAE6OF02HOEN0.16.71.G05.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
  modified_base (469)..(469): a, c, t, g, unknown or other
  misc_feature (469)..(469): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcacccgtgtctttgtctccgaggggaaanagcccacccgtctcctgcgagggccagtcagtagtgttaaccagctaaggtacttacgcctggtaccagcaagaaccgtggcctggcctccgaggcctcctnatctatggtncatccgagcacgggcacgtggacactccacgactacggttcaggttcgactaggtcggggttcagggaactagtacttacgactccgtaccaccgtnacggacacgtacgcggtactcgtagtagttattgctagttacgttaattcgtagttnaggtactagtggtagggtacggtacctacgtttaccgtacggtttaccgaccgggtaacgggaaccctagggtaccgtagggaacctaagtaaccggaacccggttaagtcgggtaacttccggcgtaacctaccgtacgttcgttactcccgttacg

SEQ ID NO: 134704 - DNA, 609 bp, Homo sapiens
  misc_feature: GYAE6OF02HDYTU.16.71.G05.1.454.CMB.1.raw
  modified_base (331)..(331): a, c, t, g, unknown or other
  misc_feature (331)..(331): n is a, c, g, or t
  modified_base (603)..(603): a, c, t, g, unknown or other
  misc_feature (603)..(603): n is a, c, g, or t
  modified_base (607)..(609): a, c, t, g, unknown or other
  misc_feature (607)..(609): n is a, c, g, or t
tcagtgtactactccacgaccggtgctcgatttagtgtcgtcgcaagagagaggggtccctgagactctcctgtgcagcctctggattcacctttgacagctatgccatgacctgggtccgccaggctccaggggaaggggctggaatgggtctcaggtattacgtggtggtggttataccacatactacgcagactccgtggagggccgttcaccatctaccagagacaacttccaaagaaccacactgtatctgacaaagtgaacagcctagagacgccgacgacacggccatatattactgtagacgaacgccaccggataggttacnccacccattacctactttgacttacggcgggaccaacgggaccctggtacctacccgtctcctcgaccgtccctaccgacccgaacgggccctagtcccggtccctccccgtcgacccctcccctccctaccaacgacgcctaccgtcggcggggaccacgcggccggccgtcgggcctcggtccgtagtacgaacggtaccttaccgttaccggacgtaacgtactacgacgtacggccgggtcgtcggacgaaccggcgacgtataggcnacgnnn

SEQ ID NO: 134705 - DNA, 746 bp, Homo sapiens
  misc_feature: GYAE6OF02HP16O.16.71.G05.1.454.CMB.1.raw
  modified_base (236)..(236): a, c, t, g, unknown or other
  misc_feature (236)..(236): n is a, c, g, or t
  modified_base (283)..(283): a, c, t, g, unknown or other
  misc_feature (283)..(283): n is a, c, g, or t
  modified_base (606)..(606): a, c, t, g, unknown or other
  misc_feature (606)..(606): n is a, c, g, or t
  modified_base (669)..(669): a, c, t, g, unknown or other
  misc_feature (669)..(669): n is a, c, g, or t
tcagtgtactactccacgaccggtgctcgatttagtgtcgtcgcaagagagagggggagctctgagagaggagcccagccctgggattttcaggttgttttcatttggtgatcaggactgaacagagagaactcaccagtggagtctggtctgagcgtggtctttttcttggtggacttaagttttaaaggtgtccagtgtgaggtgcagcttggttggtacgttcggtggggggngtgtcgacgcgcggtcgggtccggtcgagactctcctcgtgtcgacncgtcgtcgtgttccttaccttacgttcgaacgtcgtacgtcgacgactacggtccgtccgggtccggacccgacggccgtaccgggacgggggagggacggtacggtaaggttcggtcgggttaccgtaggttaacggtttacggttacggtttaggggttacggtttacggttaacccaacgtacgtaaacgttaccgaccgtaacgtacccggtaccgttacgggtacgggtaacccggttcccgtaacccacggtttcccaccggtaaacgaacgtaacccgtaacctaaccgaaagtaccgaaaccttcgacttacgtntaccgaaacgagttaaaccacgtaccacggtacgacgacggacccggaacacccgtacgaacnctaaagtttcaacgttcgaggtaaccgaacgaccggtcccgaggttcgttaaccgtaccttacccagtttaaacccg

SEQ ID NO: 134706 - DNA, 682 bp, Homo sapiens
  misc_feature: GYAE6OF02IV5Z9.16.71.G05.1.454.CMB.1.raw
  modified_base (202)..(202): a, c, t, g, unknown or other
  misc_feature (202)..(202): n is a, c, g, or t
  modified_base (527)..(527): a, c, t, g, unknown or other
  misc_feature (527)..(527): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagactaccaccggagaaattgtgttgacgcagtctccaggcaccctgtctttgtctccgaggggaancgccaccctctcctgcgagggccagtcagagtgtaaccagcagttactagcctggaccagacaggaaacctggcctggccctaccgaggccctcctacgacttccgttaagtcgggtcgacctactcccgaaggtccgacggggccctaacgtcggacctactcccgaagtacctagggttacgacggtacggacgtagggtcgggtaccgtaggggaacctacgtacgttccacgttcccttacgacccctgaacgctaacgacgtacggacgtaccgtagtaagtacgtttagaccgtagttacgttaattacgttcggttanacgtacgtaagtacggttagggtacggtacgttaaccgttacgtacgttttacggaaccggtacgggtaacacgtcgtacggtagtaacgaacggttaaaccgtacgtaggtacggcgttacgaccctacgttacgtccttacggttcttacccg

SEQ ID NO: 134707 - DNA, 767 bp, Homo sapiens
  misc_feature: GYAE6OF02HDM8I.16.71.G05.1.454.CMB.1.raw
  modified_base (199)..(199): a, c, t, g, unknown or other
  misc_feature (199)..(199): n is a, c, g, or t
  modified_base (274)..(274): a, c, t, g, unknown or other
  misc_feature (274)..(274): n is a, c, g, or t
tcagtgtactactccacgaccggtgctcgatttagtgtcgtcgcaagagagagggggagagctgctcagttaggacccagagggaaccatggaaaccccagcgcagcttctcttcctcctactactctggctcccagataccaccggagaaattgtgttgacgtcagtctccaggcacctgtcttgtctccgagggaanagccaccctctcctgcaggccagtcagagtcgtaccagcgagtcttacgcgtggtaccagcagaaacctggaccngtctaccaggcctccgtacattctagtcggtgctactccagcacggacctacgtggacctacgtacccgagtacgacgtttcgaaggtaccggtagtacgggttgggtaccggtagggtaaccgaacggtaacccgtttaccgaacccgttccgtacccgtaccccgtttaaccgaaccggtaccgtaaaccgggttaccggtacgggtaacgtaaccccggtttaagggtaaaacgtttcgttttaccgggaaccgtaacgggtttacgtttaacggttttaaccgtaggtttaaccgaacggtaccttaaagggtcgtttaacggggtaacggggtaccccttaacccggtttttaagttaccgttttaccggggacccggtaacggggtaaacccgtaaggtacggttagggactaacggtaaccgtaacgtaacgttcggtaacgcgtacgccgtaactaccgttagttaccgttacgttacttacccg

SEQ ID NO: 134708 - DNA, 855 bp, Homo sapiens
  misc_feature: GYAE6OF02HHKW9.16.71.G05.1.454.CMB.1.raw
  modified_base (150)..(150): a, c, t, g, unknown or other
  misc_feature (150)..(150): n is a, c, g, or t
  modified_base (243)..(243): a, c, t, g, unknown or other
  misc_feature (243)..(243): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctcggctccagataccgaccgganaagttgtgttgacgctagtctccgagctacctgttcttcgtctacgaaggggaagcgccacctctcctggcgacggcagtacagtcgtatacngcgtaggtacttagccgtggaccagacaagtaaccgtggacctcggccgtaccgacggtcctctacgtacttacgtagtggtacactaccgtaccgacgtcggacgggtaccctacggtacggtacccaaccggttacccgacggttaaccggtaaacggttccggtaaggtaccgggtcggggtagggttccgggggttagacgggtaacgtacggttacccttaccgtaccgtaccctacccgtaaaccgtccgaaagcccgtaaggtaaccggtaccggggtaaccgtccggttaaagttaaacgggttccgttaaaggttacggttaaagtttaccgttttaacggggttaacccttccgggttacccggtaaggtacggtttaaaagggttccgggttaaccggttacccgggtaccttttaaaccccgggtttacgttccgggttaaacgggtaccccggggtaaaggttaacccggtaaagggtccggtaacggtaaacggttaaacccgttacgtaaaaccgggttacggttaccgggtaacgtcggttaacccgaccgtaaaccgttttccggggtaaccttttacggttccccttaaacccg

SEQ ID NO: 134709 - DNA, 725 bp, Homo sapiens
  misc_feature: GYAE6OF02HRDIN.16.71.G05.1.454.CMB.1.raw
  modified_base (206)..(206): a, c, t, g, unknown or other
  misc_feature (206)..(206): n is a, c, g, or t
tcagtgtactactccacgaccggtgctcgatttagtgtcgtcgcaagagagaggggagagctgctcagttaggacccagagggaaccatggaaaccccagcgcagctctcttcctcctgctactctgcctccagactaccaccggagaaacttggtgttagacgcagtctccaggccaccctgtctttcgtactccgaggggaaanagcccacctctctgctaggccagtccagagtcgttaccagcaggtactacgcctggtaccagcaagaacctggcctggcctccaggctccctacagttcctagtcggtacgccattcccaggtaccacgggcctaacggtcgacgtaacctcccgtaagacggtagtttacgagttcgggactacggttcgggtacgtgggtacaaacgggttcctttaaccgtacgttaaccgtccccgtaaccctcggtaaacgcgtaacgtaccgttacggacgtacccgtagtaaccgttagttacgtcgtacgttacggttaatttcctaacgtcgtaagtccgaaggttacgtagggtaacggggtacccttaaccggtttacgttaccggtttccggtaccggtaaaccgggttaaccgaaggttccgttacgggaagtaccggttaaccggaaaccgtaacggcggtttacggacgttacggttaccggaaacctccggttacgttccggttacttcccgg

SEQ ID NO: 134710 - DNA, 838 bp, Homo sapiens
  misc_feature: GYAE6OF02FIV0W.16.71.G05.1.454.CMB.1.raw
  modified_base (228)..(228): a, c, t, g, unknown or other
  misc_feature (228)..(228): n is a, c, g, or t
tcagtgtactactccacgaccggtgctcgatttagtgtcgtcgcaagagagagggggagctctgagagaggagcccagccctgggattttcaggtgtttcatttggtgatcaggactgaacagagagaactcaccagtggagtcgtgggctgagcgtggtcttttctggtgtctaatttaaaggtgtccagtgtgagtcgcagtcgtgtggacgtggtggggacggtnttggcacgtacgcggttcgggggtcctagacgtacctccgtcctgtcgcgtacgtccgttacggtgtactttcgtaccgttgacacgtctagtcggtactcgtacgtaccccggtaggtccccgtacgacgggtcctaccgggggaaaggggtacggggtactacggggtaaggttccgggtacgtacggtaaggttacccgttaagggtcgggtttacggttacggtttaacgtaacccgtaacttacgtaaccgtacccgtacgtaaccggtacggtaacccgggagggttaacccgggttccggttaaccgtaccgtaccggtacctaaccgggtaacctaaaccggaaccgtaaacgttaacccccgggaaaagaaacccgtaaaccgttaacgttacccgttaagttaccgttaaccggtaacgttaaataccgtaaaccgtaacgtaccggttacgaaacggtaacccggtaaccgaacggaacccgttagaccccgttaagtttaaacgttaaaccggtttcgaagggttaacccgaaacgggttaaccgtacccgcgggtaaaccgttacccgggtaacctccccggttaacttaaccccgg

SEQ ID NO: 134711 - DNA, 648 bp, Homo sapiens
  misc_feature: GYAE6OF02JY29N.16.71.G05.1.454.CMB.1.raw
  modified_base (200)..(200): a, c, t, g, unknown or other
  misc_feature (200)..(200): n is a, c, g, or t
  modified_base (300)..(300): a, c, t, g, unknown or other
  misc_feature (300)..(300): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcacctgtctttgcctccaggggaaancgccacctctcctgcagggccagtcagtagtgtaccagcaggtacttagcctggtaccagcagaacctggcctggcctccgaggcctctcattctatggnctactcagcgaggccacgtggcacgtccgagtaccgtaggttcaggtcggactagggtcggggtactacggggaactacggtactttccgaaccgttccttacccgaccctttacgaccggtcgtaacggtaacgtcgggaacggtacccgtaggttaaacgttgtttacgaccgtagttacgttacgtttacgttacgtccgagtcgtaagttgttacggtacgggcttacccgttagttaccggtttacgaccggtacggtacgtaacggtcgtaggtacgtaacgtacgtaaccggtggtacgtcgtaccgtcgtaaccgtacgtacgttcgtacgttcgttacc

SEQ ID NO: 134712 - DNA, 706 bp, Homo sapiens
  misc_feature: GYAE6OF02HIPID.16.71.G05.1.454.CMB.1.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccaccctctcctgcacgggccagtcagagtagttaccagcaggttactagcctggtaccagcaagaacctggacctggcctccgaggcctccnctatctagtggcnctacgtccaggcacggccacgtggactactccgagacgtcggttacaggttggaccgtagggttcgggtcgtacgggacgtaggtaccttcgtacccgttctacccgtaacccgtcaacggtacctacggtaccggttaccggacgtacccggttaaggtaaacgttacgtttcggaaccgttaggttagttaaccgtttacgttcggtaccgtaagtaccgttacgttacgggttaagggtaccggtacccttaaccggttaccgtttaccggttttaccgggaccgggtaaacgggtacccgtaacggttccgtacgggtaacgtacgaaccgtaaaccggtacggtggttacggcgttacgacccgttacgtcttacgttaccgttcctacccgg

SEQ ID NO: 134713 - DNA, 835 bp, Homo sapiens
  misc_feature: GYAE6OF02HPX7F.16.71.G05.1.454.CMB.1.raw
  modified_base (203)..(203): a, c, t, g, unknown or other
  misc_feature (203)..(203): n is a, c, g, or t
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccgaggccacctgtctttgtctccgaaggggaanacgcccaccctctccgtgccgacgggccagtcagtacgttcgttaccaggcgaacggttacttagccgtacggtaaccagccaacgaaaccttggacctcggcctcccgaggtcctcccnctatcgtagtgggtcncaacgtccaggtaccgcgggtacccacgtcggacctacgtacccctaaggtaccgttaacggggttcacggtacgggtaccgtagggggttacgggtttccggagggtaaaccgtacggttacccgtttcctaaaccggttccccttaacccgacccgtacgtaaacggacccgtaacggttaaccgtcggggtaaaccgtccggttaaacgggttaaacgttttacgggtttaaggtacccgtttaagggtttacgtttaaaccggttttacccggttaacggttacgtaccgtaacggtttaacgggttaggttacgggggttaaacgttcccggtttaaacctttccgttaacggggtttttaccggaacgggtaacggaaccgttacggtacgtacgggtaacgtaacgtaaaccggtaaacggttcgtttacgggaccgtaggttacccggacttaacccggttctttacggtttacgttaccgttacccg

SEQ ID NO: 134714 - DNA, 743 bp, Homo sapiens
  misc_feature: GYAE6OF02I6DRM.16.71.G05.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctcccagataccaccggagaaattgtgttgacgcagtctccaggcaccctgtctttgtctccgagggaaanagccaccctctcctgcagggccagtcagtagtgttaccagcaggtacttagcctggtaaccngcaacgaacctggcctggcctccgaggcctccncatcctagtcggtncactccgagccgaggccaacgtggacctactaccccgaaggtaccgtacgggttaccacgggtcggaccgtaagggttcggggtccgttagggggaaccctaacgggttcctttaaccgaaccgttcccgtaccctaccccgttagtaaccgacgtaacggtaccgtgggaccgtaacgttacggtaacgttacgtttacgcgtaggttagttaacgtttacgtacgttacgacgtcgtaagttacggttcgggtaccggtaccctttaacccgtttagtttaaccggttttcgggaacccggttaaggggtaacccgtaaggtaccggttacgggaacgttaccggttaaacccgtaaacggtacggttacggtaccgtacgtacggtacccgtaaccgttaaccttaccggttacggttaccttaacccg

SEQ ID NO: 134715 - DNA, 618 bp, Homo sapiens
  misc_feature: GYAE6OF02II4WS.16.71.G05.1.454.CMB.1.raw
  modified_base (149)..(149): a, c, t, g, unknown or other
  misc_feature (149)..(149): n is a, c, g, or t
  modified_base (202)..(202): a, c, t, g, unknown or other
  misc_feature (202)..(202): n is a, c, g, or t
  modified_base (596)..(596): a, c, t, g, unknown or other
  misc_feature (596)..(596): n is a, c, g, or t
tcagtgtactactccacgaccggtgctcgatttagtgtcgtcgcaagagagagggggagagctgctcagttaggacccagagggaaccatggaaaccccagcgcagcttctcttctcctgctactctggctcccagatacccaccgganaaattgtgttgacgcagtctccaggcaccctgtctttgtctccgaggggaaangcccaccctctcctgccagggccagtcagacgttgtaccagcaggtactagctggtaccagcagaaacctggcctgggcctcccaggtcctcctacatcctatggtcgacctatccagacacggccacgttggccactcccagtacgtaacggtcaggtcggcctaggtcgggtcgtacggactagtaccgtcctacgtcctaccgtaccttacaggtacctacggtaccgtgggaacggtaccctaggtaaacggtttctttacggaccgtaggtttacgttaatttacccgttagtaccgacacgtaagtcgtaggtaccggtactacccgttatacgtttcggaacgtacggactaagcgtaggactagacctaacgtagtcgtaggtccngacctcctgtccgtatccttac

SEQ ID NO: 134716 - DNA, 764 bp, Homo sapiens
  misc_feature: GYAE6OF02GOCQ1.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcgtggtcttttttcgttgtggtacttaagtttttaaaaggtcgtaccgtagttggtaggacggtgccagtcgtggttggagtcggtgggggaggtcttggctacgacgtccggtgggggtccctggacgtactctccgtggtgcgacgccgtcgcggtacttaccgaccgtttacgaacctaggtcctaacgtcgacctaacgtccgtaccgtcgggtcccgccgacggtccgtaccgggagggggaacgggcgtaggtaaggtcgggtacctacgtaggttattccggtgggttggttacggttagtaacctactaactacgtacgactacgtaccgtcggtacggacgggtcccgttacaccgtacgtccgtacgacgaacgtaacctaacgtaacccgaaagaaacccgtacctaagttaccgttactaccgtaaggtaactaaagtacgtaacgtccgtaacgtagaccgttaaccgggacccggaacgacccgaacggtaccctaacgttaacgttaactttaaccggtacggtaaccggtaaccggaaccgttacccgggtaccggtacggttaaccggtttactacccggttacccttaaaccg

SEQ ID NO: 134717 - DNA, 642 bp, Homo sapiens
  misc_feature: GYAE6OF02FKUEH.16.71.G05.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtcctccaggcaccctgtctttgtctccgaaggggaaanagcccaccctctcctgcagggccagtcagagtgttaccagcaggtacttagcctggaccagcagaaacctggaccctggctcccgaggctcctcatctanggtgcatccagcaggccangacatcccagacgaggttcaggtgcaggtgggtactacgggactacggacgttcaaccgttctacccaacccgtcgaacgcgtaacgtaaccggtacgggaacgtccctaggaaagttacgtttggtacgtaagttacggttagtttactaggttccaacgtcgtaagttgttacgggtacgggtacctacgttaaccgttacgttttacgggacccgtaacggggaaccgtaacggtacgagggtaacgtagtaacccgaaacgttaacggtacggtaggtactacggtacaccgtaattaccgtcgttaccttaccg

SEQ ID NO: 134718 - DNA, 648 bp, Homo sapiens
  misc_feature: GYAE6OF02F20IN.16.71.G05.1.454.CMB.1.raw
  modified_base (267)..(267): a, c, t, g, unknown or other
  misc_feature (267)..(267): n is a, c, g, or t
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttggtggctattttaaaggtgtccagtgtgaggtgcagctggttggagtcgtgggggaggtcgttggcacgagccgtggggggtccctggagactctcctgtncacgcctctggattcctacctttagacagtctatcgccagtgaccgtcgggcccgacgacggcgtaccggaggggaacgggcgtagggacgttgggtccacgtaggttattacggtgggtaggtggtttaactaccagtactacgtacgctacgacctccggtaggaacggtccggtacactatcctacgaagagacacttacaagaacgactactagttatctagaacaaagttacgaacgacgctaggaacgtaaccgaccgaacgaacctccgggactaacgttaacgtaacgttacggttaggaaccgggtacgaaaaccggtcccgggtaacccggtacggttaaccggtttaacgtaccccgtaaccgttaaccc

SEQ ID NO: 134719 - DNA, 751 bp, Homo sapiens
  misc_feature: GYAE6OF02G93B7.16.71.G05.1.454.CMB.1.raw
  modified_base (168)..(168): a, c, t, g, unknown or other
  misc_feature (168)..(168): n is a, c, g, or t
  modified_base (304)..(304): a, c, t, g, unknown or other
  misc_feature (304)..(304): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagataccgacggagaaattgtgttgacgcagtcncaggcacctgtcttgtctcgagggaaagcgcccacctctcctgcgacgggtccagtcagtaggtcttaccagcgtacggtacttacgccgtaggtaccagcaacgaaaccgtgccgtggcctccgaggcctccgtntagtctagtcggtctcaacgtccgaagccggacgggccacggtcggcctacgtacccaggacgtaggttcaaggtcgggagtacgggtagggtcggtacgggaactacggttaccttcgtaacccgttccgtaccctaacccctggacgacccgtaacggtacggtacggtaaccgtccgtaacgggttaacgttaaggttttacgacgttaggttacgttaagtttacgtcggttacgacgtaacgtaacggttacgggtacggggttaacggttaacccgtttaaccgtttaccggttaacggttttccgggaaccgggaaacgggttaccgtaacgggtaccggttagggaacgtaaccggtaaaccgtaaacggttacggtaaccgggttcggacggttaaccgtaccggtaacttacgtttaccgttacgtacccgttaccg

SEQ ID NO: 134720 - DNA, 653 bp, Homo sapiens
  misc_feature: GYAE6OF02G3J42.16.71.G05.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagatacccaccggagaaattgtgttgacgcagtctccaggcaccctgtctttgtctccgaggggaaancgcccaccctctcctgcagggccagtcagngtcgtaccagcaggtacttagcctggtaccagcagaacctggcctggcctccgaggtcctcctcatctagtggcgcactccgagtcgacggccacgtggcactcccgagacctaggttcaggtcggctagggtcgggttcgtagggacctacggtaccgtttccaccgttcgtaccccgtacccgtacgacgtaccgaacggtaccggttacgggaccgtaccggttaaggtaaccgtttagttttaccggaccgttaaggtttacgtttaacgtttacccggttagttaccgagttaccgtaggttggtacgggttaccggtaccttacgttaccgttacgtttcgaccgtacggactacgcgtagacgtaacgtacgaacgcgtgtacgactcgactaccgtgtacttcgtacttacg

SEQ ID NO: 134721 - DNA, 769 bp, Homo sapiens
  misc_feature: GYAE6OF02JEPVT.16.71.G05.1.454.CMB.1.raw
  modified_base (241)..(241): a, c, t, g, unknown or other
  misc_feature (241)..(241): n is a, c, g, or t
  modified_base (283)..(283): a, c, t, g, unknown or other
  misc_feature (283)..(283): n is a, c, g, or t
  modified_base (646)..(646): a, c, t, g, unknown or other
  misc_feature (646)..(646): n is a, c, g, or t
  modified_base (713)..(713): a, c, t, g, unknown or other
  misc_feature (713)..(713): n is a, c, g, or t
  modified_base (743)..(743): a, c, t, g, unknown or other
  misc_feature (743)..(743): n is a, c, g, or t
tcagtgtactactccacgaccggtgctcgatttagtgtcgtcgcaagagagagggggagctctgagagaggagcccagccctgggattttcaggttgtttttcatttggtgatcaggactgaacagagagaactcaccatggagtctgggctgagctggtctttttcttgtggacttaattttaaaggtgtccagtgtgaggtgcagcttggttggagtcgtgggggaggtcttggcacgnggccggtggggggtccctaggacgacctcgtccgttgtcgcncgtcctcgtggtactttccgaccttttgacgagtctagtcgcctagtcgaccgtcgggtacccgccgtacggccgtaccggaagggggaacggggtcgtacggggtaaacgttcggggttcttaccgtaaggtttaacttttaccggttgggggttacggtttacggttttaacgtaacccgtaaacgttaacttaaacccgttaccgttaccgaaccggttacggttaccgggtaacgtaaaccggggggtcccctttaaccgacccgtaacgttccgtaaccggtacgaacgttaacgaaacttacccgaaataaacctccgattacggtaacttcgtaaacgtactaaacgtacgaaacncggtactacggaaacgaaccggaccgaaccgaaccaccggtacgtaactaagtttaaccgtacggtntaaaccggacgaaaccgcggtaacccggtnttacgtttaccgaccctaaccgtaac

SEQ ID NO: 134722 - DNA, 770 bp, Homo sapiens
  misc_feature: GYAE6OF02I6DUZ.16.71.G05.1.454.CMB.1.raw
  modified_base (734)..(734): a, c, t, g, unknown or other
  misc_feature (734)..(734): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctccagataccaccggagaaattgtgttgacgcagtctccaggcaccctgtcttcgtctaccgaggggaaagagcccacccttctccgtaggccgtacgggccaaggtcacggtagttcgttaccaggcgtaaggtacttacggccgtacggtaccacggacaacggtaaaccgtcggtccgtacggacctcccgtacggtcctccctaccgtataccgttagtcgggtactcctaacgtcccgagtaccggccgggtaccctacttacgacccttacgaacccgtaacggtaaccgttaggtaccgtaacgggtggaacgttcggggttcgggttaaccggtacgggacgtaaccgttaacccgtccgtaaccttcccgtaacccgtacccgtagtaccgtaccgaaccggttacggaccggtacgtacccggtagtaacgtttacgttcgacgtagttacgtttacgtcgtcgtacgacgttacgaggttacgtacggggtacgtaccgttaccgttaacgttccggttacggaacggtaccggtactaaggccgtaaggtacgtaacgtaccggtaacgtaggtacggccgtaccgtacncccgtaaagttcgtacgttcgttacccttaacccgg

SEQ ID NO: 134723 - DNA, 870 bp, Homo sapiens
  misc_feature: GYAE6OF02IQS43.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagcgtggtctttttctgtggcttaagtttaaaaggtgtccagtgtgaggtgcagctgttggagttcgtagggggagtcgttcggcacgacgcccggttggggggtcccctggagtaccgtctccgtgtgacagccctcgtcggtatttccgtaacctttcgacgtagtaccgttaagttaccggtccaacgttaccggtaacccggttcgggggtttaccccggaccccggaaggggtaccccttacccgggaaacggggggtaaaacgggggtcccttaaggggaaacgttcgggggttacctaccggtaaggtttaacgttaaccgttggggttaggggttacgtttaacttaaccgaacgtaactaccgttaacgaccgtaacgtacccgtaccgttacgggaaacggggttccccgttaacgaacccgttacgtaaccgttacccggaaacgaacgtaaacgttaaaacccgttaaccgaaaacaaaacccgtaacgttaaaccctaggttaaacctcgtaaaccggtaactaaaacttaccggggaaacttacggtacccttaaggaaaccgttaaccggtacccggaaacgacgtaaccggtcccgaaagtttaaaccgtaagttttaaaccgtacggttaaggaacccgtaaaacgtaaccggcccggtaagttaaaccccgggtttactaacccgttaaccccgttaaacc

SEQ ID NO: 134724 - DNA, 687 bp, Homo sapiens
  misc_feature: GYAE6OF02GEFOR.16.71.G05.1.454.CMB.1.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagactaccaccggagaaattgtgttgacgcagtctccaggcaccctgtctttgtctccgaggggaangcccaccctctcctgcgagggccagtcagagtcgttaccagctaggtacttagcctagtaccagcagaacctggctcggcctccgaggcctctcactcgtatggngactctcgagcgcggaccncgtcgacacgtccagacgtcggttcgagttcgcgtaggtacggtcgtaggatacgtacttcgactcctaccgtaccctacgacgtccgaaggtaccgtgggaccgtacccgtagtaaacgtttacgtttgacggttacggttacgtttaacgttccgttacgtacgtacggtactaacggttagtcggggttaaccgacctttaacccgtttacgtttaaccggtttaccggggacccgtaaacggtaacggtaccgtaggttacggaaacgtaccggttaacgtaaaccggttacgttaccgggtacggtaccgttacggtacccgttaaccgtagtttcccgtagtttcccgttaaccg

SEQ ID NO: 134725 - DNA, 874 bp, Homo sapiens
  misc_feature: GYAE6OF02JI9B9.16.71.G05.1.454.CMB.1.raw
  modified_base (130)..(130): a, c, t, g, unknown or other
  misc_feature (130)..(130): n is a, c, g, or t
  modified_base (315)..(315): a, c, t, g, unknown or other
  misc_feature (315)..(315): n is a, c, g, or t
tcagtgtactactccacgaccggtgctcgatttagtgtcgtcgcaagagagagggggagctctgagagaggagcccacgcccgtgggatttcaggtgttttctatttggtgatcaggactgaacagaganactcaccatggagtctgggctgagcgtggtactttttctgtggtacttagttttaaaggtggtaccagttagtggaggtgcgagcttaggttgggacgttcggtagggggtacgcgtttgggccaacgtacggtcccgtgggggggtacccctggagaaccttctcctggtcacggtactccgtntcggtaacttccgtacttttacggaccacgtcgtaacttacggcctacgttcgacccgttgggccccggccgtacggtaccgtcgaacgggggtacgggtaccgtagggaacgtgggtaccgttaacctaggttacgttaacggttcgggttggttaggttttaaacaccgttaacgtaagttaacccgtaacgccgtaacgttaaccggtcccggttaaggggtaacccggggttacccggttaacctaaaccccggtaccttaacccggttccccgtaaaaggtaacccgttaaaaccgggtaaccctttaaacccggtaaaacccgggaaacccttacggtttaaccgaaacgtttaccttaaccgtaccgtaacgttaaaacgtaccgaaaaccgtaccggtaaccgttacggaaggtaccgtaaacccggaacccggaacgtacccggaccctaaacgtttaagtttaacccgttaagttcgggttaaccaacggtttaaacggacccggaacggttaccttaaacggtaccggttacccctaaccttaaccgg

SEQ ID NO: 134726 - DNA, 721 bp, Homo sapiens
  misc_feature: GYAE6OF02G3GZQ.16.71.G05.1.454.CMB.1.raw
tcagtgtactactccacgaccggtgctcgatttagtgtcgtcgcaagagagagggggagagctgctcagttaggacccagagggaaccatggaaaccccagcgcagcttctcttctcctgctactctggctcccagataccgaccggagaattgtggttgacgcagtctccgaggcaccctgtctttgctccgaaggggtaagcgccacctctctgcacgggccagtcaggacgtcttaccgagtcgaaggtacttagcccgtggtaaccagcaacgtaaacctggacctcggcctacccgaggtcctccgtactacttcgttaacggttggtacgctacgtacccggagaccggacgggtacccacggtttcggacctaccgttacccgaaggtaccgttacgggttaccgaaggttcggggacgttacgggttcgggggttacaggggaacctacgggttaccttcgaaaccgttccctaccccgtaaccgtcgtacgccggtaagtcggtacggtacgtaccgtaagttagtttacgttcggacgttcggttaagttacctgttacgtagtactacggttaggacggttcgggtacgtcctttaacgttaacgttccgttagggaccgacggttaaccaggtccgttagacgttaaacgacgtaaaccgtaggttcgcggtactacgtaccgtcgttagtaccttcggttcttaccgg

SEQ ID NO: 134727 - DNA, 700 bp, Homo sapiens
  misc_feature: GYAE6OF02HMFX5.16.71.G05.1.454.CMB.1.raw
  modified_base (164)..(164): a, c, t, g, unknown or other
  misc_feature (164)..(164): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgcctactctgcctcccagataccgacggagaattgtgtcgacgnagtctcagcacctgtcttgctcgaagggaanacgccacctcnccgtgcgaggccagtcagtagtcgtaccagactagtacttacgcgtacggtaccagacaacgaacctcggcctggccgtccgcggaccttaccgactacttactacgtcggtcgactaacgtccgtagaccggaccggtacacgtcggcctaactcccggaacgtacgtaacgggttcgaggtccggtaaggtacggttcgggtacgacggtactaaggtacctttaccacgttaccccgtacgaacccttcgaagaccgaacgtcggtaacggtacgacgttaacgtacgtttacgttacgtacgttacgttaagttacgtacgttacgttacgcgtacgtaggtacggttaggtaccggtaaccgttaccgttacggttaaccgtttccgaacgggttaagtacccggtagtacgtacggaacgtacgtaacggtaacgttcgtaacggcgttacgtcgtaaccgtactacgtttcgttacgttacttaccg

SEQ ID NO: 134728 - DNA, 820 bp, Homo sapiens
  misc_feature: GYAE6OF02HDEEW.16.71.G05.1.454.CMB.1.raw
  modified_base (163)..(163): a, c, t, g, unknown or other
  misc_feature (163)..(163): n is a, c, g, or t
  modified_base (345)..(345): a, c, t, g, unknown or other
  misc_feature (345)..(345): n is a, c, g, or t
tcagtgtactactccacgaccggtgctcgatttagtgtcgtcgcaagagagagggggagagctgctcagttaggaccagagggaaccatggaaaccccagcgcagcttctcttcctcctgctactctggcctccagataccacggagaaattgtgttagacgnagtctccaggccaccgttgtctttgtctccgaaggggaaactcgccctaccctcgttcctgccagggccagtcagagtcgttaccagtcaggttacttacggccttaggtaccgagtacgaacgaaaccgtcggcctaggccttacccgaaggtcctcctacgtactcgtaacgttggtacnccgtacgtacccgtacggtcgaaccggggttaccccaacggtcgggaccctacccgtaccccggtaacggtaaccgttaccggttacggtacggttaccggggacgttcggggttacgggttcggttaacggggtaaccgtaacggttaccgtttacccgacctttacccgtcccgttaccccgttacgaccggtacccggtaacgtaccgggtacggtaccgtaccggttaaagttaaacggttttcgttaacggtacgtacggtttacgttaacgtttacgtacggtaccgtacgtagttacggttacggttacgggtaacgtaccgtttaaccgttaccggtttaccgtttacggggacccggttaaacgggcccgttaaacggtcgggtacgtagaacccgttaacgtaaaccggtggttaacggtcggtcgtacggtaccaccgttactttacggtcttaccgttaccgg

SEQ ID NO: 134729 - DNA, 173 bp, Homo sapiens
  misc_feature: GYAE6OF02I0NIO.16.71.G05.1.454.CMB.1.raw
  modified_base (136)..(173): a, c, t, g, unknown or other
  misc_feature (136)..(173): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccnnnnnnnnnnnnnnnnnnnnnnnnnnnnnnnnnnnnnn

SEQ ID NO: 134730 - DNA, 776 bp, Homo sapiens
  misc_feature: GYAE6OF02I26AP.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggtcttttttcttgtggctaattttaaaaggtgtccagtgtgaggtgcagctgttggagtcgtgggggagcttggcacagccggtcgggggtcctgagactctctgtgcacgcctcgtaggtacttacctacctttagacagtactatcgacctactcggtacccggtcggggcccgaccgacgggtccgtaccgggaaacgggggtaacggggtccgtaaggggtaacggttcggggttccgttaacggtacgggtttaacgttacgggtttgggttagggtttacggtttaacgtaaccgtaacgtaacgtaaccttaacggtaccaacggtaccgttaccggtagggaaccggggtcccgtaccgaacctacgtcctaccgagtaacgaactaagtaccaaagtaaaccaacctacgttagtaactactacgaactaaagaccgaaacgagtacccgaagggtaacgaaccgggtaacccgaacggaacccaaaccgggttactaaacggtaacttttaagttacccggttaaggaacccggtaaacggttaaacccgacccggttaaccggggttaaacttaccggtttaacccgtaccccgaaccctttaaacccg

SEQ ID NO: 134731 - DNA, 769 bp, Homo sapiens
  misc_feature: GYAE6OF02FI20P.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttctgtggctattttaaaagtgtccagtgtgaggtgcagctgttggagtcgtgggggaggtcttggcacaggtcccgtgggggggtcccctggacgtacctcgtccgtggtcgcagccctctggatttccgacctttgacgacgctatcgccagtcgacctcgggtccgccgacggccgtcccgtaaggggaaacggggtctagggaacgttgggtaccgttcgaaggtttactttaccggtgggttcgggttagggtttaactacccgaactaacgttaaccgtaacgcgaacgtaccgttcccggtaaggtaacggggtccccggttactacccgtaacgttacctacccgaagaacggaaacctaaacgttaacccgaacgaaaccgacctaaccgttagttaacgcctttagaaccgtaaaagtacgaaactacggacctaggtaacggaacgacccggaaacgtacccggaaccccggtaccgaaacgttaaccgtttaaattttaaccgtacgggttacggtaaccccggtaaaacggtaccccggtaaacccgggaaccgttaacgggttttaacccgttaccctaacccccggtttaaac

SEQ ID NO: 134732 - DNA, 701 bp, Homo sapiens
  misc_feature: GYAE6OF02GXGEU.16.71.G05.1.454.CMB.1.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctcccagataccaccggagaaattgtgttgacgcagtctccaggcaccctgtctttgtctccgaaggggaaancgccaccctctcctgcagggccagtcagagtgttaccagctaggtacttagcctaggtaccagcaagaacctggacctggctccgagcctcnatctatggncatccgagcgacggccatcggcaactccccgagaccgtaggttcgaggtacggcgtagggtccgggttacgtacgggaactaacggttccttaccgaacgttccgtaaccctaccccttgaacgtaccgtaacgtaccggtacgggacgtacccgttaagggtaaacgtttacgtttacgacgttaacggttacgtttaaacgtttacgttcggttaaccgtacggtacgttaaggttacggtaacgggtacggtaacccgttaccgtttaaccgtacggttttacgggaccggttaaccgggaacgtacggtacggtacggtaacgtacgtaaccggaaacgtacgttagggtaccgtacgtacggtactaaccgtagttacttcgttacttaccg

SEQ ID NO: 134733 - DNA, 809 bp, Homo sapiens
  misc_feature: GYAE6OF02FWHLC.16.71.G05.1.454.CMB.1.raw
  modified_base (150)..(150): a, c, t, g, unknown or other
  misc_feature (150)..(150): n is a, c, g, or t
  modified_base (199)..(199): a, c, t, g, unknown or other
  misc_feature (199)..(199): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctgcctcccagactaccaccgganaaattgtgttgacgcagtctccaggccacctgtcttgtctcgagggaancgccacctctccgtagccgacgggccagtcagtacgttacgttaacccaggccgtaacggttaccttaaggtcccgtaggttaacccagaccgaaacgtaaaccgtcggacccgttcgggaccccgttacccggaccggttccttccccgttaccgttaacgttacccgttaacggttcggggtaccgtcctaacgtccccgaggtaccgacggggtaccctacggtcggacctaaccgttacccgaagtacgtacggttacgacggttacgggacgtacgggttcgggtacggtacgggtaccgtaacggtttaccttacccgtaaccgttccgtaacccctaccggtacgtacggtaccgtaacgggtaccggttcggaacggttaaccgttaggttaaaccgtttacggttttcacggttacggtttacgttaacgtttacgtacgttacgtaacgtggttacggttagttaccgggtaccggttaccttaccggtttacttacggtttaccggacggaacggtaccgaacgtccgtaggacgtaacgtaaccggtaaacggtcgtacgtacgttacgccgacgtccttacgtctttcgtacctccg

SEQ ID NO: 134734 - DNA, 721 bp, Homo sapiens
  misc_feature: GYAE6OF02HM2JU.16.71.G05.1.454.CMB.1.raw
tcagtgtactactccacgaccggtgctcgatttagtgtcgtcgcaagagagagggggagaggctgctcagttaggacccagagggaaccatggaaacccacgcgcagctctcttcctcctcgtctactctggcctcctagataccgaccggacgtaaattgtgttcgacgccgagtctcgacggctaccctgtcgtttcgtctccgagggaaacgacgccaccctctctgcgacggccagtcgacgagtctacgacgtcgacgtacttacgctacggtaccaggcctaaggaaaccgtcggaccgtcggtacctaccccgacggtcccgttactccgtactccgtacgtggtcgacctacgtcgaacgcggaccggggccaaccggtggtaaccgaccgttaccccgaacgggtaccgtaaccgggtttcgagggttacgggtcgtaacggggttcggtcggttacgggaaccacgggttactcgtttacacccttccggtaccacgtcgaacgcgaacgttggacgtacgtagtacggtagttcgtacgagttacgtagtttactacgtcgacgtagtacggtaggtacggtacggtacgtaccgttcgtacgtttcgggaaccggtaggaaccgacggttcgacggggtactacgaaacggtaacgacggttggtaccggtagtaccgaccggtacttactaacgttcgttacgtaccg

SEQ ID NO: 134735 - DNA, 735 bp, Homo sapiens
  misc_feature: GYAE6OF02GKQ93.16.71.G05.1.454.CMB.1.raw
  modified_base (328)..(328): a, c, t, g, unknown or other
  misc_feature (328)..(328): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggctccagatacccaccggagaaattgtgttgacgcagtctccaggccaccctgtctttgtcctccgaaggggaacacgcccacccttctccgtgcgacgggccagtcagagtcgttaccagcaggtacttagccgtggtaccagcaacgtaaaccgtggcctggacctcccgaggtcctccgtctcgttctagtggtcnctactccgaggtcgacgggcctacgtacggtccaacgttaccccgaggtaccgtacggggttactacgggtacggtacggtacgggttacggggttccggtacggggaacttaaccggtccgttacccgtacccttacccgtacccgtaccccgttaacgcgtaaccgaccggtaccgttaacggggaccgtacgtaaacggtaagttactttacgacgttaggttaactttacgtttacgttcggtactagggactaccgggttagttccgggtaacggtacctaaccgtttcgttacgtttcgggacccgggtaagaccgtacgtacggttaggaaccgtacgtaacgtaaaccggttggacggttgtaccctaggcccgtaacctggttccgttcgtctacccg

SEQ ID NO: 134736 - DNA, 751 bp, Homo sapiens
  misc_feature: GYAE6OF02J0VY8.16.71.G05.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (354)..(354): a, c, t, g, unknown or other
  misc_feature (354)..(354): n is a, c, g, or t
tcagtgtactactccacgaccggtgctcgatttagtgtcgtcgcaagagagagggggagagctgctcagttaggacccagagggaaccatggaaaccccagcgcagcttctcttcctcctgctactctggcctccagataccaccggagaaattgtgttgacgcagtcctccaggcaccctgtcttgtctaccgaggggaaanacgcccaccctctcctgccgagggccagtcagagtnttaccagccgtaggttaccttagcctggtaccagcaggaacctggcctggacctccgacggtcctcctacactcctaagtcggtcgtctacctaccgaggtaccgagggaccccncggtacggaccctaagtccccgaaacgtacgtaacgggttccaagggtggtaccgtgggttacggtccgtacggggtactaccggtaccgtttacacccttccgtaaccctacccggtaacggtaaccgaccgtaagggtacccgtacggggtacccgtcggttaacgtaacggtttacgtttacggacgtaacggtttcgttaacggtttaccgtggttaaccaggtacctaaagggttaccggttacggtaccggggtaccttaacccgtttacgggttaccgtttacggggtcccggaaacggtctaacccgggtgtacggtaaccgttacggaaaccgtaacgtaggttaacggcgtaccggtaccacgtactccggtacggttctactaccg

SEQ ID NO: 134737 - DNA, 823 bp, Homo sapiens
  misc_feature: GYAE6OF02H90AO.16.71.G05.1.454.CMB.1.raw
  modified_base (59)..(59): a, c, t, g, unknown or other
  misc_feature (59)..(59): n is a, c, g, or t
tcagtgtactactccacgaccggtgctcgatttagtgtcgtcgcaagagagaggggganctctgagagaggagcccagccctgggattttcaggttgttttcatttggtgatcaggactgaacagagagaactcaccatggagtcgtgggctgagcgttggtcttttttcttggtggtctttaaagtttttaaaggtgtcctagtggtgaggtgcagtcgttggttcgggagttcggtgggggacggtcgttggacacgaggtccggtcggggggtccctggacgtacttccgtccgtgtcgaccgacgtcccgtcgtaggtcttccgtactttagaccgtagtccgtaagtcgaccctagtccggtacccggtcgggtacccgtccggtaccggtaccgtaccgggaagggggaacggggtcgtacggggtaaggttcggggtctacgtaaggttacgttttaggttggggttacggttacggttaactaaccgtaacgtacgttaaccgtaccgaccgtaacgttacgttacccgggttagggtaaccgggtacccgtttacccaaaccggtttacctacccgttacggaacgtaaccgtaaccttaacgttaaccaaacgtaacctaaccgtagttagttactactacgaaacgttaaagacgacctacggacgtacggaacgaccgaaccggaaccgtaacggcccggtactaacgtttaacgttaccgttaacgttcgggtaacccggaaccaaaccgggtcccgtaacccgggtagtttaacccgttaaccccgggtcccttaaacccctttaacgg

SEQ ID NO: 134738 - DNA, 783 bp, Homo sapiens
  misc_feature: GYAE6OF02IJII7.16.71.G05.1.454.CMB.1.raw
tcagtgtactactccacgaccggtgctcgatttagtgtcgtcgcaagagagagggggagctctgagagaggagcccagccctgggattttcaggtgttttcatttggtgatcaggactgaacagagagaactcaccatggagtcgtgggctgagcgtggtctttttcttggtggcttaattttaaaaggtgtccagtgtgaggtgcagctggttggagtcggtgggggagtcgttcggcacgacgccggttcggggggtcccctggacgtacctcctccgtagtcgcgacgtccctcgtggtacttacctacctttgactagtacctatcgaccctagtccggtacccggtaccgggtcccgaccgacggtccgtaccggaacgggggaaacggggtccgtagggtaaggttcgggtacgttaccggtaaggtttacgttacggttgggttacgggttcgtttaacgtaaccacgtaactaaccgtacgtacgaacggtaccgtccgggtaacggtaaccggggtcccgttaaccgacccgtacttccgtaccgaaaggtaacgtaacctaaaccgttaaccgaaaacgtaaaccaccgttacttaccgtacgttacacgtaaactaaacgtacgaaactacggtacctaacgggaccgtaaccggacccgtaaaccgaccgtaccgggtacctaacgtttaaccgtactttaaccggtacgtaaccggaacgtaaaccggacccgaccggtacttaaggttaaccctccctaaccgttaccg

SEQ ID NO: 134739 - DNA, 160 bp, Homo sapiens
  misc_feature: GYAE6OF01BHEFP.49.11.A11.1.454.CMB.1.raw
  modified_base (159)..(160): a, c, t, g, unknown or other
  misc_feature (159)..(160): n is a, c, g, or t
tcagagtcgagagacacgaccggtgctcgatttagctacgactgcagggagcttactgactaggccggccttaattaaggtcagcctaaggctgccccagcgtcactctgttcccgcctcctctctctcgactctgagcgggctggcaaggcgcatagnn

SEQ ID NO: 134740 - DNA, 251 bp, Homo sapiens
  misc_feature: GYAE6OF01ED0RJ.49.11.A11.1.454.CMB.1.raw
  modified_base (251)..(251): a, c, t, g, unknown or other
  misc_feature (251)..(251): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagn

SEQ ID NO: 134741 - DNA, 252 bp, Homo sapiens
  misc_feature: GYAE6OF01CRVB5.49.11.A11.1.454.CMB.1.raw
  modified_base (251)..(252): a, c, t, g, unknown or other
  misc_feature (251)..(252): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnn

SEQ ID NO: 134742 - DNA, 186 bp, Homo sapiens
  misc_feature: GYAE6OF01AB53X.49.11.A11.1.454.CMB.1.raw
  modified_base (101)..(101): a, c, t, g, unknown or other
  misc_feature (101)..(101): n is a, c, g, or t
  modified_base (154)..(186): a, c, t, g, unknown or other
  misc_feature (154)..(186): n is a, c, g, or t
tcagagtcgagagacacgaccggtgctcgatttagctacgactgcaggggggcctaaggaagcagcactggtggtgcctcagccaatggcctggaccgttntcctcctcggcctcctctctctcgactctgagcgggctggcaaggcgcatagnnnnnnnnnnnnnnnnnnnnnnnnnnnnnnnnn

SEQ ID NO: 134743 - DNA, 260 bp, Homo sapiens
  misc_feature: GYAE6OF01DTWWH.49.11.A11.1.454.CMB.1.raw
  modified_base (251)..(260): a, c, t, g, unknown or other
  misc_feature (251)..(260): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnn

SEQ ID NO: 134744 - DNA, 246 bp, Homo sapiens
  misc_feature: GYAE6OF01D8NA3.49.11.A11.1.454.CMB.1.raw
  modified_base (246)..(246): a, c, t, g, unknown or other
  misc_feature (246)..(246): n is a, c, g, or t
tcagagtcgagagacacgaccggtgctcgatttagctacgactgcaggaaccggccacctgaccatcagccggtcgaagacgggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgagcgggctggcaaggcgcatagn

SEQ ID NO: 134745 - DNA, 253 bp, Homo sapiens
  misc_feature: GYAE6OF01AJWAU.49.11.A11.1.454.CMB.1.raw
  modified_base (250)..(253): a, c, t, g, unknown or other
  misc_feature (250)..(253): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccgccctcctctctctcgactctgagcgggctggcaaggcgcatagnnnn

SEQ ID NO: 134746 - DNA, 253 bp, Homo sapiens
  misc_feature: GYAE6OF01B23R0.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnn

SEQ ID NO: 134747 - DNA, 254 bp, Homo sapiens
  misc_feature: GYAE6OF01DAFVK.49.11.A11.1.454.CMB.1.raw
  modified_base (251)..(254): a, c, t, g, unknown or other
  misc_feature (251)..(254): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnn

SEQ ID NO: 134748 - DNA, 274 bp, Homo sapiens
  misc_feature: GYAE6OF01BOE2K.49.11.A11.1.454.CMB.1.raw
  modified_base (251)..(274): a, c, t, g, unknown or other
  misc_feature (251)..(274): n is a, c, g, or t
tcagagtcgagagacacgaccggtgctcgatttagctacgactgcagggaacccggccaccctgaccactcagccgggtcgaagacgggatgaggccgactattactgtcaggtgtgggatagtggtagtggtgtcgtcttcggagctgggaccagggtcaccgtcctaggtcagtcccaaggccaacccatgtcactctgttcccgcctcctctctcgtcgactctgagcgggctggcaaggcgcatagnnnnnnnnnnnnnnnnnnnnnnnn

SEQ ID NO: 134749 - DNA, 254 bp, Homo sapiens
  misc_feature: GYAE6OF01BKGZJ.49.11.A11.1.454.CMB.1.raw
  modified_base (250)..(254): a, c, t, g, unknown or other
  misc_feature (250)..(254): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgagcgggctggcaaggcgcatagnnnnn

SEQ ID NO: 134750 - DNA, 251 bp, Homo sapiens
  misc_feature: GYAE6OF01BMHWI.49.11.A11.1.454.CMB.1.raw
  modified_base (249)..(251): a, c, t, g, unknown or other
  misc_feature (249)..(251): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccgcctcctctctctcgactctgagcgggctggcaaggcgcatagnnn

SEQ ID NO: 134751 - DNA, 253 bp, Homo sapiens
  misc_feature: GYAE6OF01BHJH2.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnn

SEQ ID NO: 134752 - DNA, 253 bp, Homo sapiens; identical to SEQ ID NO: 134751
  misc_feature: GYAE6OF01DSN97.49.11.A11.1.454.CMB.1.raw
  modified_base (251)..(253): a, c, t, g, unknown or other
  misc_feature (251)..(253): n is a, c, g, or t

SEQ ID NO: 134753 - DNA, 256 bp, Homo sapiens
  misc_feature: GYAE6OF01DAEBE.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttccaccctcctctctctcgactctgagcgggctggcaaggcgcatagnnnnnn

SEQ ID NO: 134754 - DNA, 282 bp, Homo sapiens
  misc_feature: GYAE6OF01AXLSD.49.11.A11.1.454.CMB.1.raw
  modified_base (239)..(239): a, c, t, g, unknown or other
  misc_feature (239)..(239): n is a, c, g, or t
  modified_base (245)..(282): a, c, t, g, unknown or other
  misc_feature (245)..(282): n is a, c, g, or t
tcagagtcgagagacacgaccggtgctcgatttagctacgactgcaggaacccggcaccctgaccatcagccgggtcgaagacgggatgaggccgactattactgtcaggtgtgggatagtggtagtggtgtcgtcttcggagctgggaccagggtcaccgtcctaggtcagcccaaggccaacccatgtcactctgttcccacctctctctctcgactctgagcgggctggcaaggcncatagnnnnnnnnnnnnnnnnnnnnnnnnnnnnnnnnnnnnnn

SEQ ID NO: 134755 - DNA, 252 bp, Homo sapiens
  misc_feature: GYAE6OF01B2HUE.49.11.A11.1.454.CMB.1.raw
  modified_base (251)..(252): a, c, t, g, unknown or other
  misc_feature (251)..(252): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnn

SEQ ID NO: 134756 - DNA, 253 bp, Homo sapiens; identical to SEQ ID NO: 134746
  misc_feature: GYAE6OF01C70WD.49.11.A11.1.454.CMB.1.raw
  modified_base (251)..(253): a, c, t, g, unknown or other
  misc_feature (251)..(253): n is a, c, g, or t

SEQ ID NO: 134757 - DNA, 256 bp, Homo sapiens
  misc_feature: GYAE6OF01ASE2E.49.11.A11.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttccccaccctcctctctctcgactctgagcgggctggcaaggcgcatagnnnn

SEQ ID NO: 134758 - DNA, 253 bp, Homo sapiens
  misc_feature: GYAE6OF01ES673.49.11.A11.1.454.CMB.1.raw
  modified_base (250)..(253): a, c, t, g, unknown or other
  misc_feature (250)..(253): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnn

SEQ ID NO: 134759 - DNA, 253 bp, Homo sapiens
  misc_feature: GYAE6OF01D98G4.49.11.A11.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnn

SEQ ID NO: 134760 - DNA, 297 bp, Homo sapiens
  misc_feature: GYAE6OF01ARW73.49.11.A11.1.454.CMB.1.raw
  modified_base (201)..(201): a, c, t, g, unknown or other
  misc_feature (201)..(201): n is a, c, g, or t
  modified_base (271)..(297): a, c, t, g, unknown or other
  misc_feature (271)..(297): n is a, c, g, or t
tcagagtcgagagacacgaccggtgctcgatttagctacgactgcagggtacccggccacccgtgaccatcagccgggtcgaaggacgggtactgaggccgactattactggtcaggtgtgggatagtggtagtggtgtcgtcttcggagctgggtaccagggtcaccgtcctagggttccagcccaaggcctaaacccgntgtcactctggttcccaccctcctctcgtctcgaccgtctgagccgggctcggggccaaggcgtcatagnnnnnnnnnnnnnnnnnnnnnnnnnnn

SEQ ID NO: 134761 - DNA, 253 bp, Homo sapiens; identical to SEQ ID NO: 134746
  misc_feature: GYAE6OF01CCWBV.49.11.A11.1.454.CMB.1.raw
  modified_base (251)..(253): a, c, t, g, unknown or other
  misc_feature (251)..(253): n is a, c, g, or t

SEQ ID NO: 134762 - DNA, 254 bp, Homo sapiens
  misc_feature: GYAE6OF01C4RG0.49.11.A11.1.454.CMB.1.raw
  modified_base (252)..(254): a, c, t, g, unknown or other
  misc_feature (252)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnn

SEQ ID NO: 134763 - DNA, 260 bp, Homo sapiens
  misc_feature: GYAE6OF01ASOLC.49.11.A11.1.454.CMB.1.raw
  modified_base (252)..(260): a, c, t, g, unknown or other
  misc_feature (252)..(260): n is a, c, g, or t
tcagagtcgagagacacgaccggtgctcgatttagctacgactgcagggaacccgggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnn

SEQ ID NO: 134764 - DNA, 252 bp, Homo sapiens; identical to SEQ ID NO: 134755
  misc_feature: GYAE6OF01BE2TQ.49.11.A11.1.454.CMB.1.raw
  modified_base (251)..(252): a, c, t, g, unknown or other
  misc_feature (251)..(252): n is a, c, g, or t

SEQ ID NO: 134765 - DNA, 260 bp, Homo sapiens; identical to SEQ ID NO: 134743
  misc_feature: GYAE6OF01EOPMY.49.11.A11.1.454.CMB.1.raw
  modified_base (251)..(260): a, c, t, g, unknown or other
  misc_feature (251)..(260): n is a, c, g, or t

SEQ ID NO: 134766 - DNA, 254 bp, Homo sapiens; identical to SEQ ID NO: 134747
  misc_feature: GYAE6OF01CIXAF.49.11.A11.1.454.CMB.1.raw
  modified_base (251)..(254): a, c, t, g, unknown or other
  misc_feature (251)..(254): n is a, c, g, or t

SEQ ID NO: 134767 - DNA, 255 bp, Homo sapiens
  misc_feature: GYAE6OF01BJJXM.49.11.A11.1.454.CMB.1.raw
  modified_base (253)..(255): a, c, t, g, unknown or other
  misc_feature (253)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgacctctgagcgggctggcaaggcgcatagnnn

SEQ ID NO: 134768 - DNA, 253 bp, Homo sapiens; identical to SEQ ID NO: 134759
  misc_feature: GYAE6OF01CVWIA.49.11.A11.1.454.CMB.1.raw
  modified_base (252)..(253): a, c, t, g, unknown or other
  misc_feature (252)..(253): n is a, c, g, or t

SEQ ID NO: 134769 - DNA, 309 bp, Homo sapiens
  misc_feature: GYAE6OF01BQW1T.49.11.A11.1.454.CMB.1.raw
  modified_base (257)..(309): a, c, t, g, unknown or other
  misc_feature (257)..(309): n is a, c, g, or t
tcagagtcgagagacacgaccggtgctcgatttagctacgactgctagggaacccggccaccctgaccgtatcagccgggtcgtaagacggggatgaggccgactattactgtcaggtgtgggatagtgggtagtggtgtcgtcttcggagctgggaccagggtcaccgtcctaggtcagcccaaggccaaccccactgtcaactctgttcccgcctcctctctctcgactctgagcgggctggcaaggcgcatagnnnnnnnnnnnnnnnnnnnnnnnnnnnnnnnnnnnnnnnnnnnnnnnnnnnnn

SEQ ID NO: 134770 - DNA, 254 bp, Homo sapiens
  misc_feature: GYAE6OF01BQGA1.49.11.A11.1.454.CMB.1.raw
  modified_base (252)..(254): a, c, t, g, unknown or other
  misc_feature (252)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttctcactctcctctctctcgactctgagcgggctggcaaggcgcatagnnn

SEQ ID NO: 134771 - DNA, 253 bp, Homo sapiens; identical to SEQ ID NO: 134746
  misc_feature: GYAE6OF01D8LML.49.11.A11.1.454.CMB.1.raw
  modified_base (251)..(253): a, c, t, g, unknown or other
  misc_feature (251)..(253): n is a, c, g, or t

SEQ ID NO: 134772 - DNA, 252 bp, Homo sapiens; identical to SEQ ID NO: 134741
  misc_feature: GYAE6OF01CT2T6.49.11.A11.1.454.CMB.1.raw
  modified_base (251)..(252): a, c, t, g, unknown or other
  misc_feature (251)..(252): n is a, c, g, or t

SEQ ID NO: 134773 - DNA, 252 bp, Homo sapiens
  misc_feature: GYAE6OF01B0SAF.49.11.A11.1.454.CMB.1.raw
  modified_base (252)..(252): a, c, t, g, unknown or other
  misc_feature (252)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagn

SEQ ID NO: 134774 - DNA, 169 bp, Homo sapiens
  misc_feature: GYAE6OF01BO8ZH.49.11.A11.1.454.CMB.1.raw
  modified_base (159)..(169): a, c, t, g, unknown or other
  misc_feature (159)..(169): n is a, c, g, or t
tcagagtcgagagacacgaccggtgctcgatttagctacgactgcagggagcttactgactaggccggccttaattaaggtcagcctaaggctgccccagcgtcactctgttcccacctcctctctctcgactctgagcgggctggcaaggcgcatagnnnnnnnnnnn

SEQ ID NO: 134775 - DNA, 256 bp, Homo sapiens
  misc_feature: GYAE6OF01BD6SX.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatctagccgggtcgaagacgggatgaggccgactattactgtcaggtgtgggatagtggtagtggtgtcgtcttcggagcgtgggaccagggtcaccgtcctaggtcagcccaaggccaacccactgtcactctgttcccgcctcctctctctcgactctgagcgggctggcaaggcgcatagnnnnnn

SEQ ID NO: 134776 - DNA, 174 bp, Homo sapiens
  misc_feature: GYAE6OF01EEVR3.49.11.A11.1.454.CMB.1.raw
  modified_base (160)..(174): a, c, t, g, unknown or other
  misc_feature (160)..(174): n is a, c, g, or t
tcagagtcgagagacacgaccggtgctcgatttagctacgactgctagggagcttactgactaggccggccttaattaaggtcagcctaaggctgccccagcgtcactctgttccgccctcctctctctcgactctgagcgggctggcaaggcgcatagnnnnnnnnnnnnnnn

SEQ ID NO: 134777 - DNA, 253 bp, Homo sapiens; identical to SEQ ID NO: 134746
  misc_feature: GYAE6OF01BLEJA.49.11.A11.1.454.CMB.1.raw
  modified_base (251)..(253): a, c, t, g, unknown or other
  misc_feature (251)..(253): n is a, c, g, or t

SEQ ID NO: 134778 - DNA, 262 bp, Homo sapiens
  misc_feature: GYAE6OF01CQNS2.49.11.A11.1.454.CMB.1.raw
  modified_base (252)..(262): a, c, t, g, unknown or other
  misc_feature (252)..(262): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnnn

SEQ ID NO: 134779 - DNA, 308 bp, Homo sapiens
  misc_feature: GYAE6OF01CRQMQ.49.11.A11.1.454.CMB.1.raw
  modified_base (256)..(256): a, c, t, g, unknown or other
  misc_feature (256)..(256): n is a, c, g, or t
  modified_base (258)..(308): a, c, t, g, unknown or other
  misc_feature (258)..(308): n is a, c, g, or t
tcagagtcgagagacacgaccggtgctcgatttagctacgactgcagggaacccggccaccctgaccatcagccgggtcgaagacggggatggaggccgactattactgtcgagggtgtgggatagtggtagtgggtgtcgtcttcggagctgggaccagggtcaccgtcctaggtcagcccaaggccaaccccactgtcactctgtttccacctcctctctcgtcgactctgagcgggctggcaaggcgcatagnannnnnnnnnnnnnnnnnnnnnnnnnnnnnnnnnnnnnnnnnnnnnnnnnnn

SEQ ID NO: 134780 - DNA, 277 bp, Homo sapiens
  misc_feature: GYAE6OF01ATMLZ.49.11.A11.1.454.CMB.1.raw
  modified_base (254)..(277): a, c, t, g, unknown or other
  misc_feature (254)..(277): n is a, c, g, or t
tcagagtcgagagacacgaccggtgctcgatttagctacgactgcagggaacccggccaccctgaccatcagccgggtcgaagacggggatgaggccgacctattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcagtagnnnnnnnnnnnnnnnnnnnnnnnn

SEQ ID NO: 134781 - DNA, 255 bp, Homo sapiens
  misc_feature: GYAE6OF01DKGHR.49.11.A11.1.454.CMB.1.raw
  modified_base (250)..(255): a, c, t, g, unknown or other
  misc_feature (250)..(255): n is a, c, g, or t
tcagagtcgagagacacgaccggtgctcgatttagctacgactgcagggaacccggccaccctgaccatcagccggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnn

SEQ ID NO: 134782 - DNA, 309 bp, Homo sapiens
  misc_feature: GYAE6OF01EI26O.49.11.A11.1.454.CMB.1.raw
  modified_base (256)..(257): a, c, t, g, unknown or other
  misc_feature (256)..(257): n is a, c, g, or t
  modified_base (259)..(309): a, c, t, g, unknown or other
  misc_feature (259)..(309): n is a, c, g, or t
tcagagtcgagagacacgaccggtgctcgatttagctacgactgcagggaacccggccggaccctgaccatcagccgggtcgaagacgggggatgaggccgactattactgtcaggtgtgggatagtggtagtggtgtcgtcttcggagctgggaccagggtcaccgtcctaggtcagcccaaggccaaccccactgtcactctgttcccaccctcctcctctctcgactctgagcgggctggcaaggcgcatagnngnnnnnnnnnnnnnnnnnnnnnnnnnnnnnnnnnnnnnnnnnnnnnnnnnnn

SEQ ID NO: 134783 - DNA, 190 bp, Homo sapiens
  misc_feature: GYAE6OF01CFBS0.49.11.A11.1.454.CMB.1.raw
  modified_base (157)..(157): a, c, t, g, unknown or other
  misc_feature (157)..(157): n is a, c, g, or t
  modified_base (163)..(190): a, c, t, g, unknown or other
  misc_feature (163)..(190): n is a, c, g, or t
tcagagtcgagagacacgaccggtgctcgatttagctacgactgcgagggaggcttactgactaggccggccttaattaaggtcagcctaaggctgccccagcgtcactctgttcccgccctcctctctctcgactcgtgagcgggctggcaaggcncatagnnnnnnnnnnnnnnnnnnnnnnnnnnnn

SEQ ID NO: 134784 - DNA, 256 bp, Homo sapiens
  misc_feature: GYAE6OF01A9AMU.49.11.A11.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnn

SEQ ID NO: 134785 - DNA, 254 bp, Homo sapiens
  misc_feature: GYAE6OF01DI92G.49.11.A11.1.454.CMB.1.raw
  modified_base (251)..(254): a, c, t, g, unknown or other
  misc_feature (251)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnn

SEQ ID NO: 134786 - DNA, 253 bp, Homo sapiens; identical to SEQ ID NO: 134746
  misc_feature: GYAE6OF01CCQN7.49.11.A11.1.454.CMB.1.raw
  modified_base (251)..(253): a, c, t, g, unknown or other
  misc_feature (251)..(253): n is a, c, g, or t

SEQ ID NO: 134787 - DNA, 298 bp, Homo sapiens
  misc_feature: GYAE6OF01B91SI.49.11.A11.1.454.CMB.1.raw
  modified_base (261)..(298): a, c, t, g, unknown or other
  misc_feature (261)..(298): n is a, c, g, or t
tcagagtcgagagacacgaccggtgctcgatttagctacgactgcaggggaacccggccaccctcgaccatcagccgggtcgaagacggggatgaggccgactacttactgtcaggtgtggggatagtggtagtggtgtcgtcttcggagctgggaccagggtcaccgtcctaggtccagcccaaggcccaaccccactgtccactctgttcccaccctcctctctctcgactctgagccgggctggccaaggccgcatgnnnnnnnnnnnnnnnnnnnnnnnnnnnnnnnnnnnnnn

SEQ ID NO: 134788 - DNA, 646 bp, Homo sapiens
  misc_feature: GYAE6OF01D8N0O.49.11.A11.1.454.CMB.1.raw
  modified_base (77)..(77): a, c, t, g, unknown or other
  misc_feature (77)..(77): n is a, c, g, or t
  modified_base (85)..(85): a, c, t, g, unknown or other
  misc_feature (85)..(85): n is a, c, g, or t
  modified_base (131)..(131): a, c, t, g, unknown or other
  misc_feature (131)..(131): n is a, c, g, or t
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
tcagagtcgagagacacgaccggtgctcgatttagctacgactgcaggaacccgcacctgacatcagccggtcgaanacgggatnaggccgactattactgtcaggtgtggactatggtagtggtgtcgtnttccggaggactgggaccaggtcaccgtcctaggtcgagcccaagcaacccactgtnactctgttccacccnctntctncgactctgagacgggtctgtcaacggtacgccnttaagtcgngnacgngtcgactagtcgagtctagtacgtcgtagtacgtacgtcgtacgtacgtacggtacgtacgtactacgtacgtacgtcgtacgtacgttacgacgtcgtacgtacgtacgtacgtaccgttacgcgtagttacgtcgtaccgtaggtacgtacggccttacggttacgacgtacggtacgtcgtacgttacgtacgtacgtacgtcgtacgtacgtacgtacgtacgtacgtacgtcgtacgtacgtaccgtacgtacgtacgtacgtacgtacgtcgtacgtacgtacgtacgtcgtacgtacgacgttaccgtcgtaccgtacgtacgtacgtcgtacggttacgtcgtacgtacgtaccgtacgtacgtagtcgtacgtcgtacg

SEQ ID NO: 134789 - DNA, 252 bp, Homo sapiens; identical to SEQ ID NO: 134741
  misc_feature: GYAE6OF01BC5PL.49.11.A11.1.454.CMB.1.raw
  modified_base (251)..(252): a, c, t, g, unknown or other
  misc_feature (251)..(252): n is a, c, g, or t

SEQ ID NO: 134790 - DNA, 298 bp, Homo sapiens
  misc_feature: GYAE6OF01CI3TA.49.11.A11.1.454.CMB.1.raw
  modified_base (258)..(298): a, c, t, g, unknown or other
  misc_feature (258)..(298): n is a, c, g, or t
tcagagtcgagagacacgaccggtgctcgatttagctacgactgcagggtaacccgggccaccctgaccatctagccgggtcgaagacgggtaatgaggccgactattactgtcaggtgtgggatagtggtaggtggtgtcgtcttcggagcggtcggaccagggtcaccgtcctaggtcagcccaaggccaacccactgtcactctgttcccgcctcctctcgtctcgactctgagcgggctggcaaggcgcatagnnnnnnnnnnnnnnnnnnnnnnnnnnnnnnnnnnnnnnnnn

SEQ ID NO: 134791 - DNA, 256 bp, Homo sapiens
  misc_feature: GYAE6OF01AWF3Z.49.11.A11.1.454.CMB.1.raw
  modified_base (249)..(256): a, c, t, g, unknown or other
  misc_feature (249)..(256): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccacctcctctctctcgactctgagcgggctggcaaggcgcatagnnnnnnnn

SEQ ID NO: 134792 - DNA, 275 bp, Homo sapiens
  misc_feature: GYAE6OF01C5KEV.49.11.A11.1.454.CMB.1.raw
  modified_base (138)..(138): a, c, t, g, unknown or other
  misc_feature (138)..(138): n is a, c, g, or t
  modified_base (212)..(212): a, c, t, g, unknown or other
  misc_feature (212)..(212): n is a, c, g, or t
  modified_base (249)..(275): a, c, t, g, unknown or other
  misc_feature (249)..(275): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtnttcggagctgggaccagggtcaccgtcctaggtcagcccaaggccaaccccatgtcactctgttcccgcctccnctctctcgactctgagcgggctggcaaggcgcatagnnnnnnnnnnnnnnnnnnnnnnnnnnn

SEQ ID NO: 134793 - DNA, 254 bp, Homo sapiens
  misc_feature: GYAE6OF01BNZKW.49.11.A11.1.454.CMB.1.raw
  modified_base (251)..(254): a, c, t, g, unknown or other
  misc_feature (251)..(254): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnn

SEQ ID NO: 134794 - DNA, 293 bp, Homo sapiens
  misc_feature: GYAE6OF01B780T.49.11.A11.1.454.CMB.1.raw
  modified_base (256)..(293): a, c, t, g, unknown or other
  misc_feature (256)..(293): n is a, c, g, or t
tcagagtcgagagacacgaccggtgctcgatttagctacgactgcagggaacccggccgaccctgaccatcagccgggtcgaagacggggatgaggccgactattactgtcaggtgtgggatagtggtagtggtgtcggtcttcggagctgggaccagggtcaccgtcctaggtcagcccaaggccaacccactgtcacgtctgttcccaccctcctctctctcgactctgagcgggctggctaaggcgcactagnnnnnnnnnnnnnnnnnnnnnnnnnnnnnnnnnnnnnn

SEQ ID NO: 134795 - DNA, 257 bp, Homo sapiens
  misc_feature: GYAE6OF01B7JZZ.49.11.A11.1.454.CMB.1.raw
  modified_base (251)..(257): a, c, t, g, unknown or other
  misc_feature (251)..(257): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagccaaggccaacccactgtcactctcgttcccgccctcctctctctcgactcgtgagcgggctggcaaggcgcatagnnnnnnn

SEQ ID NO: 134796 - DNA, 253 bp, Homo sapiens
  misc_feature: GYAE6OF01BNRU9.49.11.A11.1.454.CMB.1.raw
  modified_base (249)..(253): a, c, t, g, unknown or other
  misc_feature (249)..(253): n is a, c, g, or t
tcagagtcgagagacacgaccggtgctcgatttagctacgactgcgggaacccggccaccctgaccatcagccggtcgaagacggggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgagcgggctggcaaggcgcatagnnnnn

SEQ ID NO: 134797 - DNA, 252 bp, Homo sapiens
  misc_feature: GYAE6OF01D2FUB.49.11.A11.1.454.CMB.1.raw
  modified_base (251)..(252): a, c, t, g, unknown or other
  misc_feature (251)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnn

SEQ ID NO: 134798 - DNA, 165 bp, Homo sapiens
  misc_feature: GYAE6OF01A4AAO.49.11.A11.1.454.CMB.1.raw
  modified_base (160)..(165): a, c, t, g, unknown or other
  misc_feature (160)..(165): n is a, c, g, or t
tcagagtcgagagacacgaccggtgctcgatttagctacgactgcagggagcttactgactaggccggccttaattaaggtcagcctaaggctgccccagcgtcactctgttcccaccctcctctctctcgactctgagcgggctggcaaggcgcatagnnnnnn

SEQ ID NO: 134799 - DNA, 255 bp, Homo sapiens
  misc_feature: GYAE6OF01CUIU7.49.11.A11.1.454.CMB.1.raw
  modified_base (252)..(255): a, c, t, g, unknown or other
  misc_feature (252)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnn

SEQ ID NO: 134800 - DNA, 254 bp, Homo sapiens; identical to SEQ ID NO: 134747
  misc_feature: GYAE6OF01D5L9C.49.11.A11.1.454.CMB.1.raw
  modified_base (251)..(254): a, c, t, g, unknown or other
  misc_feature (251)..(254): n is a, c, g, or t

SEQ ID NO: 134801 - DNA, 254 bp, Homo sapiens; identical to SEQ ID NO: 134762
  misc_feature: GYAE6OF01ATCYJ.49.11.A11.1.454.CMB.1.raw
  modified_base (252)..(254): a, c, t, g, unknown or other
  misc_feature (252)..(254): n is a, c, g, or t

SEQ ID NO: 134802 - DNA, 254 bp, Homo sapiens
  misc_feature: GYAE6OF01D3QQD.49.11.A11.1.454.CMB.1.raw
  modified_base (252)..(254): a, c, t, g, unknown or other
  misc_feature (252)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnn

SEQ ID NO: 134803 - DNA, 273 bp, Homo sapiens
  misc_feature: GYAE6OF01BTPJH.49.11.A11.1.454.CMB.1.raw
  modified_base (256)..(273): a, c, t, g, unknown or other
  misc_feature (256)..(273): n is a, c, g, or t
tcagagtcgagagacacgaccggtgctcgatttagctacgactgcagggaacccgggccaccctgaccatcagccgggtcgaaggacggggatgaggccgactattactgtcaggtgtgggactagtggtagtggtgtcgtcttcggagctgggaccagggtcaccgtcctaggtcagcccaaggccaaccccactgtcactctgttcccacctcctctctctcgactctgagcgggctggcaaggcgcaataagnnnnnnnnnnnnnnnnnn

SEQ ID NO: 134804 - DNA, 261 bp, Homo sapiens
  misc_feature: GYAE6OF01A78BV.49.11.A11.1.454.CMB.1.raw
  modified_base (249)..(261): a, c, t, g, unknown or other
  misc_feature (249)..(261): n is a, c, g, or t
tcagagtcgagagacacgaccggtgctcgatttagctacgactgcagggaaccggccacctgaccgatcagccgggtcgaagacgggatgaggccgactattactgtcaggtgtcgggatagtggtagtggtgtcgtcttcggagctgggaccagggtcaccgtcctaggtcagcccaaggccaaccccactgtcactctgttcccacctctctctctcgactctgagcgggctggcaaggcgcatagnnnnnnnnnnnnn

SEQ ID NO: 134805 - DNA, 253 bp, Homo sapiens
  misc_feature: GYAE6OF01CXC5P.49.11.A11.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaaggccaaccccactgtcactctgttcccgccctcctctctctcgactctgagcgggctggcaaggcgcatagnn

SEQ ID NO: 134806 - DNA, 267 bp, Homo sapiens
  misc_feature: GYAE6OF01EFFIW.49.11.A11.1.454.CMB.1.raw
  modified_base (251)..(267): a, c, t, g, unknown or other
  misc_feature (251)..(267): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnnnnnnnnnnnnnn

SEQ ID NO: 134807 - DNA, 254 bp, Homo sapiens
  misc_feature: GYAE6OF01CRT8N.49.11.A11.1.454.CMB.1.raw
  modified_base (249)..(254): a, c, t, g, unknown or other
  misc_feature (249)..(254): n is a, c, g, or t
tcagagtcgagagacacgaccggtgctcgatttagctacgactgcagggaacccggccaccctgaccatcagccggtcgaagacgggatgaggccgactattactgtcaggtgtgggatagtggtagtggtgtcgtcttcggagctgggaccagggtcaccgtcctaggtcagcccaaggccaacccactgtcactctgttcccacctcctctctctcgactctgagcgggctggcaaaggcgcatagnnnnnn

SEQ ID NO: 134808 - DNA, 254 bp, Homo sapiens; identical to SEQ ID NO: 134802
  misc_feature: GYAE6OF01B3C33.49.11.A11.1.454.CMB.1.raw
  modified_base (252)..(254): a, c, t, g, unknown or other
  misc_feature (252)..(254): n is a, c, g, or t

SEQ ID NO: 134809 - DNA, 253 bp, Homo sapiens
  misc_feature: GYAE6OF01BQRC1.49.11.A11.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnn

SEQ ID NO: 134810 - DNA, 255 bp, Homo sapiens; identical to SEQ ID NO: 134799
  misc_feature: GYAE6OF01DUCH0.49.11.A11.1.454.CMB.1.raw
  modified_base (252)..(255): a, c, t, g, unknown or other
  misc_feature (252)..(255): n is a, c, g, or t

SEQ ID NO: 134811 - DNA, 254 bp, Homo sapiens; identical to SEQ ID NO: 134802
  misc_feature: GYAE6OF01DPUBU.49.11.A11.1.454.CMB.1.raw
  modified_base (252)..(254): a, c, t, g, unknown or other
  misc_feature (252)..(254): n is a, c, g, or t

SEQ ID NO: 134812 - DNA, 255 bp, Homo sapiens; identical to SEQ ID NO: 134799
  misc_feature: GYAE6OF01BX34Q.49.11.A11.1.454.CMB.1.raw
  modified_base (252)..(255): a, c, t, g, unknown or other
  misc_feature (252)..(255): n is a, c, g, or t

SEQ ID NO: 134813 - DNA, 255 bp, Homo sapiens
  misc_feature: GYAE6OF01C7QQ0.49.11.A11.1.454.CMB.1.raw
  modified_base (252)..(255): a, c, t, g, unknown or other
  misc_feature (252)..(255): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnn

SEQ ID NO: 134814 - DNA, 259 bp, Homo sapiens
  misc_feature: GYAE6OF01DULR5.49.11.A11.1.454.CMB.1.raw
  modified_base (245)..(245): a, c, t, g, unknown or other
  misc_feature (245)..(245): n is a, c, g, or t
  modified_base (251)..(259): a, c, t, g, unknown or other
  misc_feature (251)..(259): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcncatagnnnnnnnnn

SEQ ID NO: 134815 - DNA, 252 bp, Homo sapiens; identical to SEQ ID NO: 134741
  misc_feature: GYAE6OF01A2MFG.49.11.A11.1.454.CMB.1.raw
  modified_base (251)..(252): a, c, t, g, unknown or other
  misc_feature (251)..(252): n is a, c, g, or t

SEQ ID NO: 134816 - DNA, 528 bp, Homo sapiens
  misc_feature: GYAE6OF01BGJL3.49.11.A11.1.454.CMB.1.raw
  modified_base (432)..(432): a, c, t, g, unknown or other
  misc_feature (432)..(432): n is a, c, g, or t
  modified_base (488)..(488): a, c, t, g, unknown or other
  misc_feature (488)..(488): n is a, c, g, or t
  modified_base (517)..(517): a, c, t, g, unknown or other
  misc_feature (517)..(517): n is a, c, g, or t
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcgagggatccctgagcgattctctggctccaactctgggaacccgccaccctgaccatcagccgggtcgaagacgggatgaggccgactattactgtcaggtgtgggataggtggtagtggtgtcgtntcggagcgtgggaccaggggtccaccgtctaggtcacggcccaaggcccaaccccngtcgtcacgtctcgtccccgccctcctcnctctcgtctcg

SEQ ID NO: 134817 - DNA, 255 bp, Homo sapiens
  misc_feature: GYAE6OF01ALKZ5.49.11.A11.1.454.CMB.1.raw
  modified_base (252)..(255): a, c, t, g, unknown or other
  misc_feature (252)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnn

SEQ ID NO: 134818 - DNA, 253 bp, Homo sapiens; identical to SEQ ID NO: 134746
  misc_feature: GYAE6OF01A1TGE.49.11.A11.1.454.CMB.1.raw
  modified_base (251)..(253): a, c, t, g, unknown or other
  misc_feature (251)..(253): n is a, c, g, or t

SEQ ID NO: 134819 - DNA, 257 bp, Homo sapiens
  misc_feature: GYAE6OF01D9U44.49.11.A11.1.454.CMB.1.raw
  modified_base (250)..(257): a, c, t, g, unknown or other
  misc_feature (250)..(257): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcggctggcaaggcgcatagnnnnnnnn

SEQ ID NO: 134820 - DNA, 254 bp, Homo sapiens; identical to SEQ ID NO: 134802
  misc_feature: GYAE6OF01EH3TN.49.11.A11.1.454.CMB.1.raw
  modified_base (252)..(254): a, c, t, g, unknown or other
  misc_feature (252)..(254): n is a, c, g, or t

SEQ ID NO: 134821 - DNA, 254 bp, Homo sapiens; identical to SEQ ID NO: 134762
  misc_feature: GYAE6OF01D0G3D.49.11.A11.1.454.CMB.1.raw
  modified_base (252)..(254): a, c, t, g, unknown or other
  misc_feature (252)..(254): n is a, c, g, or t

SEQ ID NO: 134822 - DNA, 254 bp, Homo sapiens
  misc_feature: GYAE6OF01A5XI7.49.11.A11.1.454.CMB.1.raw
  modified_base (251)..(254): a, c, t, g, unknown or other
  misc_feature (251)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnn

SEQ ID NO: 134823 - DNA, 256 bp, Homo sapiens; identical to SEQ ID NO: 134784
  misc_feature: GYAE6OF01C88JG.49.11.A11.1.454.CMB.1.raw
  modified_base (252)..(256): a, c, t, g, unknown or other
  misc_feature (252)..(256): n is a, c, g, or t

SEQ ID NO: 134824 - DNA, 254 bp, Homo sapiens
  misc_feature: GYAE6OF01CM6EQ.49.11.A11.1.454.CMB.1.raw
  modified_base (252)..(254): a, c, t, g, unknown or other
  misc_feature (252)..(254): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnn

SEQ ID NO: 134825 - DNA, 254 bp, Homo sapiens; identical to SEQ ID NO: 134762
  misc_feature: GYAE6OF01D6KFP.49.11.A11.1.454.CMB.1.raw
  modified_base (252)..(254): a, c, t, g, unknown or other
  misc_feature (252)..(254): n is a, c, g, or t

SEQ ID NO: 134826 - DNA, 258 bp, Homo sapiens
  misc_feature: GYAE6OF01BV55A.49.11.A11.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnn

SEQ ID NO: 134827 - DNA, 254 bp, Homo sapiens; identical to SEQ ID NO: 134762
  misc_feature: GYAE6OF01C16PC.49.11.A11.1.454.CMB.1.raw
  modified_base (252)..(254): a, c, t, g, unknown or other
  misc_feature (252)..(254): n is a, c, g, or t

SEQ ID NO: 134828 - DNA, 251 bp, Homo sapiens
  misc_feature: GYAE6OF01BUKH5.49.11.A11.1.454.CMB.1.raw
  modified_base (249)..(251): a, c, t, g, unknown or other
  misc_feature (249)..(251): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccacctcctctctctcgactctgagcgggctggcaaggcgcatagnnn

SEQ ID NO: 134829 - DNA, 403 bp, Homo sapiens
  misc_feature: GYAE6OF01CRT5W.49.11.A11.1.454.CMB.1.raw
  modified_base (342)..(342): a, c, t, g, unknown or other
  misc_feature (342)..(342): n is a, c, g, or t
  modified_base (393)..(403): a, c, t, g, unknown or other
  misc_feature (393)..(403): n is a, c, g, or t
tcagagtcgagagacacgaccggtgctcgatttagctacgactgcagggaacccgtcgaccctaccgtacgaacctactacgaccgggtcccggggtaacggaaacgggggaacggggtagtagggaccgggacccgtaactttaactttacgttcgtacggtagggttgggtagggtaagttagggttagggttagggttgggttcggttccgtttccggttagggacgtcgggtaccgggaaccggtacgggtacccgtacccgttacggttacggacgacccgaacccggaaccggaacccccaaaccctgttcgtacctacctcgttcccggtccccnccttcctctcctcactactgagcggcggtgcggaacgacggccataagtgnnnnnnnnnnn

SEQ ID NO: 134830 - DNA, 255 bp, Homo sapiens; identical to SEQ ID NO: 134817
  misc_feature: GYAE6OF01CUGIZ.49.11.A11.1.454.CMB.1.raw
  modified_base (252)..(255): a, c, t, g, unknown or other
  misc_feature (252)..(255): n is a, c, g, or t

SEQ ID NO: 134831 - DNA, 253 bp, Homo sapiens; identical to SEQ ID NO: 134809
  misc_feature: GYAE6OF01EDHT9.49.11.A11.1.454.CMB.1.raw
  modified_base (252)..(253): a, c, t, g, unknown or other
  misc_feature (252)..(253): n is a, c, g, or t

SEQ ID NO: 134832 - DNA, 275 bp, Homo sapiens
  misc_feature: GYAE6OF01BXYII.49.11.A11.1.454.CMB.1.raw
  modified_base (248)..(248): a, c, t, g, unknown or other
  misc_feature (248)..(248): n is a, c, g, or t
  modified_base (254)..(275): a, c, t, g, unknown or other
  misc_feature (254)..(275): n is a, c, g, or t
tcagagtcgagagacacgaccggtgctcgatttagctacgactgcagggaacccggccacccgtgaccatcagccgggtcgaagacgggatgaggccgacttattactgtcaggtgtgggatagtggtagtcggtgtcgtcttcggagctgggaccagggtcaccgtcctaggtcagcccaaggccaaccccgactgtcactctgttcccaccctctctctctcgactctgagcgggctggcaaggcncatagnnnnnnnnnnnnnnnnnnnnnn

SEQ ID NO: 134833 - DNA, 170 bp, Homo sapiens
  misc_feature: GYAE6OF01A04BI.49.11.A11.1.454.CMB.1.raw
  modified_base (160)..(170): a, c, t, g, unknown or other
  misc_feature (160)..(170): n is a, c, g, or t
tcagagtcgagagacacgaccggtgctcgatttagctacgactgcagggagcttactgactaggccggccttaattaaggtcagcctaaggctgccccagcgtcactctgttcccaccctcctctctctcgactctgagcgggctggcaaggcgcatagnnnnnnnnnnn

SEQ ID NO: 134834 - DNA, 254 bp, Homo sapiens; identical to SEQ ID NO: 134762
  misc_feature: GYAE6OF01DMSJU.49.11.A11.1.454.CMB.1.raw
  modified_base (252)..(254): a, c, t, g, unknown or other
  misc_feature (252)..(254): n is a, c, g, or t

SEQ ID NO: 134835 - DNA, 253 bp, Homo sapiens; identical to SEQ ID NO: 134809
  misc_feature: GYAE6OF01ESK71.49.11.A11.1.454.CMB.1.raw
  modified_base (252)..(253): a, c, t, g, unknown or other
  misc_feature (252)..(253): n is a, c, g, or t

SEQ ID NO: 134836 - DNA, 252 bp, Homo sapiens
  misc_feature: GYAE6OF01BDN6H.49.11.A11.1.454.CMB.1.raw
  modified_base (252)..(252): a, c, t, g, unknown or other
  misc_feature (252)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagn

SEQ ID NO: 134837 - DNA, 254 bp, Homo sapiens; identical to SEQ ID NO: 134762
  misc_feature: GYAE6OF01CROX7.49.11.A11.1.454.CMB.1.raw
  modified_base (252)..(254): a, c, t, g, unknown or other
  misc_feature (252)..(254): n is a, c, g, or t

SEQ ID NO: 134838 - DNA, 208 bp, Homo sapiens
  misc_feature: GYAE6OF01A9020.49.11.A11.1.454.CMB.1.raw
  modified_base (160)..(160): a, c, t, g, unknown or other
  misc_feature (160)..(160): n is a, c, g, or t
  modified_base (164)..(208): a, c, t, g, unknown or other
  misc_feature (164)..(208): n is a, c, g, or t
tcagagtcgagagacacgaccggtgctcgatttagctacgactgcaggggaggcttactgactaggccggccttaattaaggtcagcctaaggctggcccccagcgtcacctctgttcccgccctcctctctctcgactctgagcgggctggcaaggcgnatgnnnnnnnnnnnnnnnnnnnnnnnnnnnnnnnnnnnnnnnnnnnnn

SEQ ID NO: 134839 - DNA, 254 bp, Homo sapiens; identical to SEQ ID NO: 134793
  misc_feature: GYAE6OF01CL1RQ.49.11.A11.1.454.CMB.1.raw
  modified_base (251)..(254): a, c, t, g, unknown or other
  misc_feature (251)..(254): n is a, c, g, or t

SEQ ID NO: 134840 - DNA, 256 bp, Homo sapiens
  misc_feature: GYAE6OF01CVI43.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnn

SEQ ID NO: 134841 - DNA, 256 bp, Homo sapiens
  misc_feature: GYAE6OF01DC1NW.49.11.A11.1.454.CMB.1.raw
  modified_base (255)..(256): a, c, t, g, unknown or other
  misc_feature (255)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactctgagcgggctggcaaggcgcatagnn

SEQ ID NO: 134842 - DNA, 253 bp, Homo sapiens; identical to SEQ ID NO: 134759
  misc_feature: GYAE6OF01B57XS.49.11.A11.1.454.CMB.1.raw
  modified_base (252)..(253): a, c, t, g, unknown or other
  misc_feature (252)..(253): n is a, c, g, or t

SEQ ID NO: 134843 - DNA, 253 bp, Homo sapiens
  misc_feature: GYAE6OF01CT5H7.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcagggaacccagccaccctgaccatcagccgggtcgaagacggggatgaggccgactattactgtcaggtgtggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnn

SEQ ID NO: 134844 - DNA, 252 bp, Homo sapiens
  misc_feature: GYAE6OF01D2SF6.49.11.A11.1.454.CMB.1.raw
  modified_base (252)..(252): a, c, t, g, unknown or other
  misc_feature (252)..(252): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagn

SEQ ID NO: 134845 - DNA, 256 bp, Homo sapiens
  misc_feature: GYAE6OF01BGSFZ.49.11.A11.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnn

SEQ ID NO: 134846 - DNA, 254 bp, Homo sapiens; identical to SEQ ID NO: 134785
  misc_feature: GYAE6OF01DO8AT.49.11.A11.1.454.CMB.1.raw
  modified_base (251)..(254): a, c, t, g, unknown or other
  misc_feature (251)..(254): n is a, c, g, or t

SEQ ID NO: 134847 - DNA, 526 bp, Homo sapiens
  misc_feature: GYAE6OF01EH17C.49.11.A11.1.454.CMB.1.raw
  modified_base (399)..(399): a, c, t, g, unknown or other
  misc_feature (399)..(399): n is a, c, g, or t
  modified_base (514)..(514): a, c, t, g, unknown or other
  misc_feature (514)..(514): n is a, c, g, or t
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggcaccctgaccatcagccgggtcgaaggacgggatgaggccgactattacngtcaggtgtgggataggtggtagtggtgtcgtcttcgggagcgtgggaccaggggtcaccgttcaggtcagcccaaggcccaacccactcgtcactctcgttccccacccttccnctctctcgctcg

SEQ ID NO: 134848 - DNA, 271 bp, Homo sapiens
  misc_feature: GYAE6OF01CDLC7.49.11.A11.1.454.CMB.1.raw
  modified_base (260)..(271): a, c, t, g, unknown or other
  misc_feature (260)..(271): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtagtagtgctcttccgggggtgttcggcggagggaccaagttgaccgtcgttggtcagcccaaggctgccccctcggtcactctgttcccaccctcctctctctcgactctgaggcgggctggacaaggcgcatagnnnnnnnnnnnn

SEQ ID NO: 134849 - DNA, 263 bp, Homo sapiens
  misc_feature: GYAE6OF01ER1S1.49.11.A11.1.454.CMB.1.raw
  modified_base (251)..(263): a, c, t, g, unknown or other
  misc_feature (251)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctccgactctgagcgggctggcaaggcgcatagnnnnnnnnnnnnn

SEQ ID NO: 134850 - DNA, 253 bp, Homo sapiens; identical to SEQ ID NO: 134809
  misc_feature: GYAE6OF01AY0G5.49.11.A11.1.454.CMB.1.raw
  modified_base (252)..(253): a, c, t, g, unknown or other
  misc_feature (252)..(253): n is a, c, g, or t

SEQ ID NO: 134851 - DNA, 259 bp, Homo sapiens
  misc_feature: GYAE6OF01DD9LD.49.11.A11.1.454.CMB.1.raw
  modified_base (253)..(259): a, c, t, g, unknown or other
  misc_feature (253)..(259): n is a, c, g, or t
tcagagtcgagagacacgaccggtgctcgatttagctacgactgcgagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnn

SEQ ID NO: 134852 - DNA, 255 bp, Homo sapiens
  misc_feature: GYAE6OF01C6Y4R.49.11.A11.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcactctgagcgggctggcaaggcgcatagnnnnn

SEQ ID NO: 134853 - DNA, 253 bp, Homo sapiens; identical to SEQ ID NO: 134809
  misc_feature: GYAE6OF01A794X.49.11.A11.1.454.CMB.1.raw
  modified_base (252)..(253): a, c, t, g, unknown or other
  misc_feature (252)..(253): n is a, c, g, or t

SEQ ID NO: 134854 - DNA, 255 bp, Homo sapiens; identical to SEQ ID NO: 134799
  misc_feature: GYAE6OF01ASUWP.49.11.A11.1.454.CMB.1.raw
  modified_base (252)..(255): a, c, t, g, unknown or other
  misc_feature (252)..(255): n is a, c, g, or t

SEQ ID NO: 134855 - DNA, 253 bp, Homo sapiens; identical to SEQ ID NO: 134809
  misc_feature: GYAE6OF01B8B0N.49.11.A11.1.454.CMB.1.raw
  modified_base (252)..(253): a, c, t, g, unknown or other
  misc_feature (252)..(253): n is a, c, g, or t

SEQ ID NO: 134856 - DNA, 255 bp, Homo sapiens; identical to SEQ ID NO: 134817
  misc_feature: GYAE6OF01EJUKP.49.11.A11.1.454.CMB.1.raw
  modified_base (252)..(255): a, c, t, g, unknown or other
  misc_feature (252)..(255): n is a, c, g, or t

SEQ ID NO: 134857 - DNA, 281 bp, Homo sapiens
  misc_feature: GYAE6OF01DGDXD.49.11.A11.1.454.CMB.1.raw
  modified_base (247)..(247): a, c, t, g, unknown or other
  misc_feature (247)..(247): n is a, c, g, or t
  modified_base (253)..(281): a, c, t, g, unknown or other
  misc_feature (253)..(281): n is a, c, g, or t
tcagagtcgagagacacgaccggtgctcgatttagctacgactgcagggaacccgggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctagagcgggctggcaaggcncatagnnnnnnnnnnnnnnnnnnnnnnnnnnnnn

SEQ ID NO: 134858 - DNA, 532 bp, Homo sapiens
  misc_feature: GYAE6OF01CS1IR.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccgcaccctgaccatcagccggtcgaagacgggatgaggccgactatactgtcaggtgtgggataggtggtagtggtgtcgtcttcgggagtcgtgggaccaggggtcaccggtcgtaggtcacggcccaagggcccaaccccgactcggtcactctcgttccccaccctcctctcctctcgctccg

SEQ ID NO: 134859 - DNA, 161 bp, Homo sapiens
  misc_feature: GYAE6OF01EN9NO.49.11.A11.1.454.CMB.1.raw
  modified_base (161)..(161): a, c, t, g, unknown or other
  misc_feature (161)..(161): n is a, c, g, or t
tcagagtcgagagacacgaccggtgctcgatttagctacgactgcagggagcttactgactaggccggccttaattaaggtcagcctaaggctgcccccagcgtcactctgttcccgccctcctctctctcgactctgagcgggctggcaaggcgcatagn

SEQ ID NO: 134860 - DNA, 254 bp, Homo sapiens; identical to SEQ ID NO: 134802
  misc_feature: GYAE6OF01E2K0U.49.11.A11.1.454.CMB.1.raw
  modified_base (252)..(254): a, c, t, g, unknown or other
  misc_feature (252)..(254): n is a, c, g, or t

SEQ ID NO: 134861 - DNA, 255 bp, Homo sapiens; identical to SEQ ID NO: 134799
  misc_feature: GYAE6OF01EGPEI.49.11.A11.1.454.CMB.1.raw
  modified_base (252)..(255): a, c, t, g, unknown or other
  misc_feature (252)..(255): n is a, c, g, or t

SEQ ID NO: 134862 - DNA, 252 bp, Homo sapiens; identical to SEQ ID NO: 134773
  misc_feature: GYAE6OF01DC4QO.49.11.A11.1.454.CMB.1.raw
  modified_base (252)..(252): a, c, t, g, unknown or other
  misc_feature (252)..(252): n is a, c, g, or t

SEQ ID NO: 134863 - DNA, 237 bp, Homo sapiens
  misc_feature: GYAE6OF01E310E.49.11.A11.1.454.CMB.1.raw
  modified_base (164)..(237): a, c, t, g, unknown or other
  misc_feature (164)..(237): n is a, c, g, or t
tcagagtcgagagacacgaccggtgctcgatttagctacgactgcaggggagcgttactgactaggccggccttaattaaggtcagcctaaggctgccccagcgtcactctgttcccgccttcctctctctcgactctgagcgggctgggcaaggcgcatagcnnnnnnnnnnnnnnnnnnnnnnnnnnnnnnnnnnnnnnnnnnnnnnnnnnnnnnnnnnnnnnnnnnnnnnnnnn

SEQ ID NO: 134864 - DNA, 160 bp, Homo sapiens
  misc_feature: GYAE6OF01B1HKL.49.11.A11.1.454.CMB.1.raw
  modified_base (160)..(160): a, c, t, g, unknown or other
  misc_feature (160)..(160): n is a, c, g, or t
tcagagtcgagagacacgaccggtgctcgatttagctacgactgcagggagcttactgactaggccggccttaattaaggtcagcctaaggctgccccagcgtcactctgttcccgccctcctctctctcgactctgagcgggctggcaaggcgcatagn

SEQ ID NO: 134865 - DNA, 263 bp, Homo sapiens
  misc_feature: GYAE6OF01CMMUH.49.11.A11.1.454.CMB.1.raw
  modified_base (252)..(263): a, c, t, g, unknown or other
  misc_feature (252)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnnnn

SEQ ID NO: 134866 - DNA, 255 bp, Homo sapiens; identical to SEQ ID NO: 134799
  misc_feature: GYAE6OF01D7UEU.49.11.A11.1.454.CMB.1.raw
  modified_base (252)..(255): a, c, t, g, unknown or other
  misc_feature (252)..(255): n is a, c, g, or t

SEQ ID NO: 134867 - DNA, 258 bp, Homo sapiens
  misc_feature: GYAE6OF01A93BG.49.11.A11.1.454.CMB.1.raw
  modified_base (253)..(258): a, c, t, g, unknown or other
  misc_feature (253)..(258): n is a, c, g, or t
tcagagtcgagagacacgaccggtgctcgatttagctacgactgcgagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnn

SEQ ID NO: 134868 - DNA, 254 bp, Homo sapiens; identical to SEQ ID NO: 134762
  misc_feature: GYAE6OF01EMVLR.49.11.A11.1.454.CMB.1.raw
  modified_base (252)..(254): a, c, t, g, unknown or other
  misc_feature (252)..(254): n is a, c, g, or t

SEQ ID NO: 134869 - DNA, 257 bp, Homo sapiens
  misc_feature: GYAE6OF01CGRNB.49.11.A11.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgactgcagggaacccggccaccctgaccatccagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnn

SEQ ID NO: 134870 - DNA, 253 bp, Homo sapiens; identical to SEQ ID NO: 134746
  misc_feature: GYAE6OF01B8L08.49.11.A11.1.454.CMB.1.raw
  modified_base (251)..(253): a, c, t, g, unknown or other
  misc_feature (251)..(253): n is a, c, g, or t

SEQ ID NO: 134871 - DNA, 254 bp, Homo sapiens; identical to SEQ ID NO: 134762
  misc_feature: GYAE6OF01A1EAT.49.11.A11.1.454.CMB.1.raw
  modified_base (252)..(254): a, c, t, g, unknown or other
  misc_feature (252)..(254): n is a, c, g, or t

SEQ ID NO: 134872 - DNA, 299 bp, Homo sapiens
  misc_feature: GYAE6OF01CDOUJ.49.11.A11.1.454.CMB.1.raw
  modified_base (260)..(299): a, c, t, g, unknown or other
  misc_feature (260)..(299): n is a, c, g, or t
tcagagtcgagagacacgaccggtgctcgatttagctacgactgcagggtaacccggggccaccctgaccatcagccggtcgaagacggggatgaggccgactattactgtcaggtgtgggatagtgggtagtggtgtcgtcttcggagcctgggaccagggtcaccgtcctaggtcaggcccaaggccaaccccactgtcactctgttcccgccctcctcctctctcgactcgtcgagcgggctggcaaggcgcatagnnnnnnnnnnnnnnnnnnnnnnnnnnnnnnnnnnnnnnnn

SEQ ID NO: 134873 - DNA, 254 bp, Homo sapiens; identical to SEQ ID NO: 134762
  misc_feature: GYAE6OF01DW8Z9.49.11.A11.1.454.CMB.1.raw
  modified_base (252)..(254): a, c, t, g, unknown or other
  misc_feature (252)..(254): n is a, c, g, or t

SEQ ID NO: 134874 - DNA, 254 bp, Homo sapiens
  misc_feature: GYAE6OF01BEZCG.49.11.A11.1.454.CMB.1.raw
  modified_base (250)..(254): a, c, t, g, unknown or other
  misc_feature (250)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcactctgagcgggctggcaaggcgcatagnnnnn

SEQ ID NO: 134875 - DNA, 271 bp, Homo sapiens
  misc_feature: GYAE6OF01AR7ZB.49.11.A11.1.454.CMB.1.raw
  modified_base (252)..(271): a, c, t, g, unknown or other
  misc_feature (252)..(271): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnnnnnnn

SEQ ID NO: 134876 - DNA, 256 bp, Homo sapiens; identical to SEQ ID NO: 134845
  misc_feature: GYAE6OF01EE8XX.49.11.A11.1.454.CMB.1.raw
  modified_base (252)..(256): a, c, t, g, unknown or other
  misc_feature (252)..(256): n is a, c, g, or t

SEQ ID NO: 134877 - DNA, 253 bp, Homo sapiens
  misc_feature: GYAE6OF01EREGV.49.11.A11.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnn

SEQ ID NO: 134878 - DNA, 253 bp, Homo sapiens; identical to SEQ ID NO: 134746
  misc_feature: GYAE6OF01BG40Z.49.11.A11.1.454.CMB.1.raw
  modified_base (251)..(253): a, c, t, g, unknown or other
  misc_feature (251)..(253): n is a, c, g, or t

SEQ ID NO: 134879 - DNA, 252 bp, Homo sapiens; identical to SEQ ID NO: 134741
  misc_feature: GYAE6OF01DZ07T.49.11.A11.1.454.CMB.1.raw
  modified_base (251)..(252): a, c, t, g, unknown or other
  misc_feature (251)..(252): n is a, c, g, or t

SEQ ID NO: 134880 - DNA, 256 bp, Homo sapiens; identical to SEQ ID NO: 134845
  misc_feature: GYAE6OF01CRWN5.49.11.A11.1.454.CMB.1.raw
  modified_base (252)..(256): a, c, t, g, unknown or other
  misc_feature (252)..(256): n is a, c, g, or t

SEQ ID NO: 134881 - DNA, 253 bp, Homo sapiens; identical to SEQ ID NO: 134809
  misc_feature: GYAE6OF01CZVLA.49.11.A11.1.454.CMB.1.raw
  modified_base (252)..(253): a, c, t, g, unknown or other
  misc_feature (252)..(253): n is a, c, g, or t

SEQ ID NO: 134882 - DNA, 257 bp, Homo sapiens
  misc_feature: GYAE6OF01B5S61.49.11.A11.1.454.CMB.1.raw
  modified_base (252)..(257): a, c, t, g, unknown or other
  misc_feature (252)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnn

SEQ ID NO: 134883 - DNA, 283 bp, Homo sapiens
  misc_feature: GYAE6OF01EG86S.49.11.A11.1.454.CMB.1.raw
  modified_base (247)..(247): a, c, t, g, unknown or other
  misc_feature (247)..(247): n is a, c, g, or t
  modified_base (253)..(283): a, c, t, g, unknown or other
  misc_feature (253)..(283): n is a, c, g, or t
tcagagtcgagagacacgaccggtgctcgatttagctacgactgcagggaacccggccaacccgtgaccatcagccgggtcgaagacgggatgaggccgactattactgtcacggtgtgggatagtggtaggtggtgtcgtcttcggagctgggaccagggtcaccgtcctaggtcagcccaaggccaacccatgtcactctgttcccaccctcctctctctcgactctgagcgggctggcaaggcncatagnnnnnnnnnnnnnnnnnnnnnnnnnnnnnnn

SEQ ID NO: 134884 - DNA, 290 bp, Homo sapiens
  misc_feature: GYAE6OF01ELWM7.49.11.A11.1.454.CMB.1.raw
  modified_base (254)..(262): a, c, t, g, unknown or other
  misc_feature (254)..(262): n is a, c, g, or t
  modified_base (264)..(290): a, c, t, g, unknown or other
  misc_feature (264)..(290): n is a, c, g, or t
tcagagtcgagagacacgaccggtgctcgatttagctacgactgcgggaacccggccaccctgaccatcagccgggtcgaagaccggggatgaggccgtactattactgtcaggtgtgggatagtggtagtggtgtcggtcttcggagctgggaccagggtcacccgtcctaggtcagcccaaggccaacccactgtcactctgttcccaccctcctctctctcgactctgagcggctggtcaaggcgcatagnnnnnnnnnannnnnnnnnnnnnnnnnnnnnnnnnnn

SEQ ID NO: 134885 - DNA, 543 bp, Homo sapiens
  misc_feature: GYAE6OF01AMSMC.49.11.A11.1.454.CMB.1.raw
  modified_base (219)..(219): a, c, t, g, unknown or other
  misc_feature (219)..(219): n is a, c, g, or t
  modified_base (529)..(529): a, c, t, g, unknown or other
  misc_feature (529)..(529): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggccactggacagacggccaggattaccgtgtgggggaaacncattggaataagactgtgcactggtaccagcagaagccaggccaggcccctgtgctggtcgtctatggtgatggcgaccggccctcgagggatccccgtgagcgattcgtctggctccaactctcgggaacccgccaccctgacccagtcgacggccgggtacgaaggacggggatggacggccgactatactgtcaggtgtgggatagtggtagtggtgtcgtcgtcggagcgtgggaccagggtcaccgtctaggtcagcccgaaggcccaacccgtctcgtcacgttctcgttccccaccttccctnttcctcctcgtacc

SEQ ID NO: 134886 - DNA, 255 bp, Homo sapiens; identical to SEQ ID NO: 134799
  misc_feature: GYAE6OF01C24BP.49.11.A11.1.454.CMB.1.raw
  modified_base (252)..(255): a, c, t, g, unknown or other
  misc_feature (252)..(255): n is a, c, g, or t

SEQ ID NO: 134887 - DNA, 265 bp, Homo sapiens
  misc_feature: GYAE6OF01BB70A.49.11.A11.1.454.CMB.1.raw
  modified_base (252)..(265): a, c, t, g, unknown or other
  misc_feature (252)..(265): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnnnnnn

SEQ ID NO: 134888 - DNA, 253 bp, Homo sapiens
  misc_feature: GYAE6OF01DV0P8.49.11.A11.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggctgccccctcggtcactctgttcccgccctcctctctctcgactctgagcgggctggcaaggcgcatagnn

SEQ ID NO: 134889 - DNA, 268 bp, Homo sapiens
  misc_feature: GYAE6OF01ECVQE.49.11.A11.1.454.CMB.1.raw
  modified_base (243)..(243): a, c, t, g, unknown or other
  misc_feature (243)..(243): n is a, c, g, or t
  modified_base (248)..(268): a, c, t, g, unknown or other
  misc_feature (248)..(268): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaacccactgtcactctgttccgccctcctctctctcgactctgagcgggctggcaaggcncatgnnnnnnnnnnnnnnnnnnnnn

SEQ ID NO: 134890 - DNA, 254 bp, Homo sapiens; identical to SEQ ID NO: 134802
  misc_feature: GYAE6OF01EF3OI.49.11.A11.1.454.CMB.1.raw
  modified_base (252)..(254): a, c, t, g, unknown or other
  misc_feature (252)..(254): n is a, c, g, or t

SEQ ID NO: 134891 - DNA, 163 bp, Homo sapiens
  misc_feature: GYAE6OF01D8O0N.49.11.A11.1.454.CMB.1.raw
  modified_base (161)..(163): a, c, t, g, unknown or other
  misc_feature (161)..(163): n is a, c, g, or t
tcagagtcgagagacacgaccggtgctcgatttagctacgactgcagggagcttactgactaggccggccttaattaaggtcagcctaaggctgcccccagcgtcactctgttcccaccctcctctctctcgactctgagcgggctggcaaggcgcatagnnn

SEQ ID NO: 134892 - DNA, 252 bp, Homo sapiens
  misc_feature: GYAE6OF01BZ97D.49.11.A11.1.454.CMB.1.raw
  modified_base (250)..(252): a, c, t, g, unknown or other
  misc_feature (250)..(252): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnn

SEQ ID NO: 134893 - DNA, 255 bp, Homo sapiens; identical to SEQ ID NO: 134799
  misc_feature: GYAE6OF01EF9PT.49.11.A11.1.454.CMB.1.raw
  modified_base (252)..(255): a, c, t, g, unknown or other
  misc_feature (252)..(255): n is a, c, g, or t

SEQ ID NO: 134894 - DNA, 254 bp, Homo sapiens; identical to SEQ ID NO: 134762
  misc_feature: GYAE6OF01BYD0Q.49.11.A11.1.454.CMB.1.raw
  modified_base (252)..(254): a, c, t, g, unknown or other
  misc_feature (252)..(254): n is a, c, g, or t

SEQ ID NO: 134895 - DNA, 252 bp, Homo sapiens; identical to SEQ ID NO: 134773
  misc_feature: GYAE6OF01BGBW4.49.11.A11.1.454.CMB.1.raw
  modified_base (252)..(252): a, c, t, g, unknown or other
  misc_feature (252)..(252): n is a, c, g, or t

SEQ ID NO: 134896 - DNA, 254 bp, Homo sapiens
  misc_feature: GYAE6OF01DEN0J.49.11.A11.1.454.CMB.1.raw
  modified_base (250)..(254): a, c, t, g, unknown or other
  misc_feature (250)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccactgtcactctgttcccacctcctctctctcgactctgagcgggctggcaaggcgcatagnnnnn

SEQ ID NO: 134897 - DNA, 253 bp, Homo sapiens; identical to SEQ ID NO: 134809
  misc_feature: GYAE6OF01A22FQ.49.11.A11.1.454.CMB.1.raw
  modified_base (252)..(253): a, c, t, g, unknown or other
  misc_feature (252)..(253): n is a, c, g, or t

SEQ ID NO: 134898 - DNA, 257 bp, Homo sapiens
  misc_feature: GYAE6OF01C767W.49.11.A11.1.454.CMB.1.raw
  modified_base (252)..(257): a, c, t, g, unknown or other
  misc_feature (252)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnn

SEQ ID NO: 134899 - DNA, 256 bp, Homo sapiens; identical to SEQ ID NO: 134845
  misc_feature: GYAE6OF01CXGHL.49.11.A11.1.454.CMB.1.raw
  modified_base (252)..(256): a, c, t, g, unknown or other
  misc_feature (252)..(256): n is a, c, g, or t

SEQ ID NO: 134900 - DNA, 253 bp, Homo sapiens; identical to SEQ ID NO: 134809
  misc_feature: GYAE6OF01A37RN.49.11.A11.1.454.CMB.1.raw
  modified_base (252)..(253): a, c, t, g, unknown or other
  misc_feature (252)..(253): n is a, c, g, or t

SEQ ID NO: 134901 - DNA, 537 bp, Homo sapiens
  misc_feature: GYAE6OF01EJDRN.49.11.A11.1.454.CMB.1.raw
  modified_base (498)..(498): a, c, t, g, unknown or other
  misc_feature (498)..(498): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcgagggactccctgagcgattctctggctccaactctgggaacccgcaccctgaccatccaggccgggtacgaaaggacggggatggaggcccgactattactgtcgaggtgtgggataggtggtagtggtgtcgtcttcgggagcgtgggaccaggggtcaccgttctaggtcacgcccaaggcccaaccccngtcgtcactctcgtccccaccctcctctcctctcgctcg

SEQ ID NO: 134902 - DNA, 256 bp, Homo sapiens
  misc_feature: GYAE6OF01CFXBL.49.11.A11.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagttgggaccagggtcaccgtcctaggtcagcccaaggccaaccccactgtcactctgttcccgccctcctctctctcgactctgagcgggctggcaaggcgcatagnnnnn

SEQ ID NO: 134903 - DNA, 252 bp, Homo sapiens; identical to SEQ ID NO: 134844
  misc_feature: GYAE6OF01D7XQ2.49.11.A11.1.454.CMB.1.raw
  modified_base (252)..(252): a, c, t, g, unknown or other
  misc_feature (252)..(252): n is a, c, g, or t

SEQ ID NO: 134904 - DNA, 274 bp, Homo sapiens
  misc_feature: GYAE6OF01AHCUI.49.11.A11.1.454.CMB.1.raw
  modified_base (244)..(244): a, c, t, g, unknown or other
  misc_feature (244)..(244): n is a, c, g, or t
  modified_base (250)..(255): a, c, t, g, unknown or other
  misc_feature (250)..(255): n is a, c, g, or t
  modified_base (257)..(258): a, c, t, g, unknown or other
  misc_feature (257)..(258): n is a, c, g, or t
  modified_base (260)..(274): a, c, t, g, unknown or other
  misc_feature (260)..(274): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcggctggcaaggcncatagnnnnnnanncnnnnnnnnnnnnnnn

SEQ ID NO: 134905 - DNA, 254 bp, Homo sapiens; identical to SEQ ID NO: 134762
  misc_feature: GYAE6OF01AJ91G.49.11.A11.1.454.CMB.1.raw
  modified_base (252)..(254): a, c, t, g, unknown or other
  misc_feature (252)..(254): n is a, c, g, or t

SEQ ID NO: 134906 - DNA, 573 bp, Homo sapiens
  misc_feature: GYAE6OF01EAPOY.49.11.A11.1.454.CMB.1.raw
  modified_base (205)..(205): a, c, t, g, unknown or other
  misc_feature (205)..(205): n is a, c, g, or t
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccnggtgggggaaacacattggaagtaagactgtgcactggtaccagcagaagccaggccaggcccctgtgctggtcgtctatggtgatgggcgaccggccctcgagggatccctgagcgattctctggctccaactctgggaacccgcaccctgaccatcagccggtgaaggacggggatggaggccgactattactgtcaggtgtgggataggtggtagtggtgtcgttcttcgggagtcgtgggaccgtaggggtccaaccgttcgtaagggtccacggcccgaaagggccccaaacccccgacgtcggtcccaacgttcccgtcgttcccccgccccttccctccttcctaccttccgaccttccgg

SEQ ID NO: 134907 - DNA, 252 bp, Homo sapiens; identical to SEQ ID NO: 134797
  misc_feature: GYAE6OF01D2RCI.49.11.A11.1.454.CMB.1.raw
  modified_base (251)..(252): a, c, t, g, unknown or other
  misc_feature (251)..(252): n is a, c, g, or t

SEQ ID NO: 134908 - DNA, 256 bp, Homo sapiens; identical to SEQ ID NO: 134845
  misc_feature: GYAE6OF01BVIIH.49.11.A11.1.454.CMB.1.raw
  modified_base (252)..(256): a, c, t, g, unknown or other
  misc_feature (252)..(256): n is a, c, g, or t

SEQ ID NO: 134909 - DNA, 251 bp, Homo sapiens
  misc_feature: GYAE6OF01C7L2L.49.11.A11.1.454.CMB.1.raw
  modified_base (251)..(251): a, c, t, g, unknown or other
  misc_feature (251)..(251): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcggctggcaaggcgcatagn

SEQ ID NO: 134910 - DNA, 257 bp, Homo sapiens; identical to SEQ ID NO: 134898
  misc_feature: GYAE6OF01EX9J5.49.11.A11.1.454.CMB.1.raw
  modified_base (252)..(257): a, c, t, g, unknown or other
  misc_feature (252)..(257): n is a, c, g, or t

SEQ ID NO: 134911 - DNA, 252 bp, Homo sapiens
  misc_feature: GYAE6OF01EOX0U.49.11.A11.1.454.CMB.1.raw
  modified_base (250)..(252): a, c, t, g, unknown or other
  misc_feature (250)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccgccctcctctctctcgactctgagcggctggcaaggcgcatagnnn

SEQ ID NO: 134912 - DNA, 252 bp, Homo sapiens
  misc_feature: GYAE6OF01DTHBX.49.11.A11.1.454.CMB.1.raw
  modified_base (251)..(252): a, c, t, g, unknown or other
  misc_feature (251)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctctctctctcgactctgagcgggctggcaaggcgcatagnn

SEQ ID NO: 134913 - DNA, 254 bp, Homo sapiens; identical to SEQ ID NO: 134822
  misc_feature: GYAE6OF01DDM97.49.11.A11.1.454.CMB.1.raw
  modified_base (251)..(254): a, c, t, g, unknown or other
  misc_feature (251)..(254): n is a, c, g, or t

SEQ ID NO: 134914 - DNA, 253 bp, Homo sapiens; identical to SEQ ID NO: 134759
  misc_feature: GYAE6OF01C4GK0.49.11.A11.1.454.CMB.1.raw
  modified_base (252)..(253): a, c, t, g, unknown or other
  misc_feature (252)..(253): n is a, c, g, or t

SEQ ID NO: 134915 - DNA, 255 bp, Homo sapiens; identical to SEQ ID NO: 134817
  misc_feature: GYAE6OF01A24B8.49.11.A11.1.454.CMB.1.raw
  modified_base (252)..(255): a, c, t, g, unknown or other
  misc_feature (252)..(255): n is a, c, g, or t

SEQ ID NO: 134916 - DNA, 516 bp, Homo sapiens
  misc_feature: GYAE6OF01D2UI2.49.11.A11.1.454.CMB.1.raw
  modified_base (480)..(480): a, c, t, g, unknown or other
  misc_feature (480)..(480): n is a, c, g, or t
tcagagtcgagagacacgaccggtgctcgatttagctacgactgcagggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccgcaccctgaccatcagccggtcgaagacggggatgaggccgactattactgtcaggtgtgggatagtggtagtggtgtcgtcttcggagcgtgggaccaggggtcaccgtctaggtcagcccaaggccaacccnctgtcactctgttccccgccctctctctctcgctcg

SEQ ID NO: 134917 - DNA, 161 bp, Homo sapiens
  misc_feature: GYAE6OF01CRJJ4.49.11.A11.1.454.CMB.1.raw
  modified_base (160)..(161): a, c, t, g, unknown or other
  misc_feature (160)..(161): n is a, c, g, or t
tcagagtcgagagacacgaccggtgctcgatttagctacgactgcagggagcttactgactaggccggccttaattaaggtcagcctaaggctgccccagcgtcactctgttctcgccctcctctctctcgactctgagcgggctggcaaggcgcatagnn

SEQ ID NO: 134918 - DNA, 253 bp, Homo sapiens; identical to SEQ ID NO: 134877
  misc_feature: GYAE6OF01D2QUA.49.11.A11.1.454.CMB.1.raw
  modified_base (252)..(253): a, c, t, g, unknown or other
  misc_feature (252)..(253): n is a, c, g, or t

SEQ ID NO: 134919 - DNA, 259 bp, Homo sapiens
  misc_feature: GYAE6OF01EO4R3.49.11.A11.1.454.CMB.1.raw
  modified_base (252)..(259): a, c, t, g, unknown or other
  misc_feature (252)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctcgtcccgcctcctctctctcgactctgaggcggctggacgaggcgcatagnnnnnnnn

SEQ ID NO: 134920 - DNA, 263 bp, Homo sapiens
  misc_feature: GYAE6OF01B2W1A.49.11.A11.1.454.CMB.1.raw
  modified_base (253)..(263): a, c, t, g, unknown or other
  misc_feature (253)..(263): n is a, c, g, or t
tcagagtcgagagacacgaccggtgctcgatttagctacgactgcaggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnnn

SEQ ID NO: 134921 - DNA, 253 bp, Homo sapiens; identical to SEQ ID NO: 134809
  misc_feature: GYAE6OF01CRP7M.49.11.A11.1.454.CMB.1.raw
  modified_base (252)..(253): a, c, t, g, unknown or other
  misc_feature (252)..(253): n is a, c, g, or t

SEQ ID NO: 134922 - DNA, 253 bp, Homo sapiens; identical to SEQ ID NO: 134809
  misc_feature: GYAE6OF01AS5IM.49.11.A11.1.454.CMB.1.raw
  modified_base (252)..(253): a, c, t, g, unknown or other
  misc_feature (252)..(253): n is a, c, g, or t

SEQ ID NO: 134923 - DNA, 543 bp, Homo sapiens
  misc_feature: GYAE6OF01DWUT1.49.11.A11.1.454.CMB.1.raw
  modified_base (504)..(504): a, c, t, g, unknown or other
  misc_feature (504)..(504): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacacattggaagtaagactgtgcactggtaccagcagaagccaggccaggcccctgtgctggtcgtctatggtgatggcgaccggccctcagggactccctgagcgattctctggctccaactcgtcgggaacccggcaccctcgaccatcaggccgggtcgaaggacggggatggacggccgactagttactgtcgaggtgtgggataggtggtagtggtgtcgttcttcgggagcgtagggaccaggggtccaccggtcctaggtcacgcccaaggccccaacccncgtcgtcactctcgtccccaccctcctctctctcgctcg

SEQ ID NO: 134924 - DNA, 288 bp, Homo sapiens
  misc_feature: GYAE6OF01AKU4T.49.11.A11.1.454.CMB.1.raw
  modified_base (251)..(252): a, c, t, g, unknown or other
  misc_feature (251)..(252): n is a, c, g, or t
  modified_base (254)..(288): a, c, t, g, unknown or other
  misc_feature (254)..(288): n is a, c, g, or t
tcagagtcgagagacacgaccggtgctcgatttagctacgactgcaggggaacccggccacccttgaccatcagccgggttcgaagacggggatgaggccgactattactgtcaggtgtgggatagtggtagtggtgtcgtcttcggagctgggaccagggtcaccgtctaggtcagcccaaggccaacccatgtcactctgttcccaccctctctctctcgactctgagcgggctggcaaggcgcatagnngnnnnnnnnnnnnnnnnnnnnnnnnnnnnnnnnnnn

SEQ ID NO: 134925 - DNA, 592 bp, Homo sapiens
  misc_feature: GYAE6OF01DIDBS.49.11.A11.1.454.CMB.1.raw
  modified_base (491)..(491): a, c, t, g, unknown or other
  misc_feature (491)..(491): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctgagggactcccgtgacgcgtattctcgtggcctaccaactcgtcggggaaccccgccacccgtgaccagtcacggccgggtcgaaaggacggggatggacggccggtactaagttacgtggtacaagggttggtagggtatagggttgggtaacgtgggttagtcgtcgttcggagtcgtgggaccnggggtaccaccgtcctaggtccacggcccgaaggaccccaacccgctcgtcaaccttccgtcgttcccccgcccttccgtcctaccttcctcgccttccgg

SEQ ID NO: 134926 - DNA, 272 bp, Homo sapiens
  misc_feature: GYAE6OF01DC2JZ.49.11.A11.1.454.CMB.1.raw
  modified_base (253)..(272): a, c, t, g, unknown or other
  misc_feature (253)..(272): n is a, c, g, or t
tcagagtcgagagacacgaccggtgctcgatttagctacgactgcagggaacccgggccaccctgacccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnnnnnnnnnnnnnnnnn

SEQ ID NO: 134927 - DNA, 255 bp, Homo sapiens; identical to SEQ ID NO: 134799
  misc_feature: GYAE6OF01CLPUV.49.11.A11.1.454.CMB.1.raw
  modified_base (252)..(255): a, c, t, g, unknown or other
  misc_feature (252)..(255): n is a, c, g, or t

SEQ ID NO: 134928 - DNA, 254 bp, Homo sapiens; identical to SEQ ID NO: 134762
  misc_feature: GYAE6OF01CA03F.49.11.A11.1.454.CMB.1.raw
  modified_base (252)..(254): a, c, t, g, unknown or other
  misc_feature (252)..(254): n is a, c, g, or t

SEQ ID NO: 134929 - DNA, 256 bp, Homo sapiens; identical to SEQ ID NO: 134784
  misc_feature: GYAE6OF01DZE29.49.11.A11.1.454.CMB.1.raw
  modified_base (252)..(256): a, c, t, g, unknown or other
  misc_feature (252)..(256): n is a, c, g, or t

SEQ ID NO: 134930 - DNA, 254 bp, Homo sapiens; identical to SEQ ID NO: 134802
  misc_feature: GYAE6OF01BTA0Y.49.11.A11.1.454.CMB.1.raw
  modified_base (252)..(254): a, c, t, g, unknown or other
  misc_feature (252)..(254): n is a, c, g, or t

SEQ ID NO: 134931 - DNA, 252 bp, Homo sapiens; identical to SEQ ID NO: 134836
  misc_feature: GYAE6OF01EDNOK.49.11.A11.1.454.CMB.1.raw
  modified_base (252)..(252): a, c, t, g, unknown or other
  misc_feature (252)..(252): n is a, c, g, or t

SEQ ID NO: 134932 - DNA, 530 bp, Homo sapiens
  misc_feature: GYAE6OF01DPIEP.49.11.A11.1.454.CMB.1.raw
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
  modified_base (491)..(491): a, c, t, g, unknown or other
  misc_feature (491)..(491): n is a, c, g, or t
tcagagtcgagagacacgaccggtgctcgatttagctacgactgcagggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtggggaaacgacattggaagtaagactgtgcactggtaccagcagaagccaggccaggcccctgtgctggtcgtctatggtgatggcgaccggccctcagggatccctgagcgattctctggctccaactctgggaacccgccaccctgaccatcagccggtcgaagacggggntgaggccgactattacngtcaggtgtgggataggtggtagtggtgtcgtcttcgggagtcgtggggaccaggggtccaccggttcctaggtcagccccaaggcccaaccccntcgtcactctcgttcccaccctcctctctctcgcctcgg

SEQ ID NO: 134933 - DNA, 269 bp, Homo sapiens
  misc_feature: GYAE6OF01BYS3A.49.11.A11.1.454.CMB.1.raw
  modified_base (253)..(269): a, c, t, g, unknown or other
  misc_feature (253)..(269): n is a, c, g, or t
tcagagtcgagagacacgaccggtgctcgatttagctacgactgcagggaacccggccaccctgacccaatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnnnnnnnnnnnnnn

SEQ ID NO: 134934 - DNA, 256 bp, Homo sapiens; identical to SEQ ID NO: 134784
  misc_feature: GYAE6OF01CF23S.49.11.A11.1.454.CMB.1.raw
  modified_base (252)..(256): a, c, t, g, unknown or other
  misc_feature (252)..(256): n is a, c, g, or t

SEQ ID NO: 134935 - DNA, 254 bp, Homo sapiens; identical to SEQ ID NO: 134802
  misc_feature: GYAE6OF01DIU70.49.11.A11.1.454.CMB.1.raw
  modified_base (252)..(254): a, c, t, g, unknown or other
  misc_feature (252)..(254): n is a, c, g, or t

SEQ ID NO: 134936 - DNA, 254 bp, Homo sapiens; identical to SEQ ID NO: 134802
  misc_feature: GYAE6OF01DD91W.49.11.A11.1.454.CMB.1.raw
  modified_base (252)..(254): a, c, t, g, unknown or other
  misc_feature (252)..(254): n is a, c, g, or t

SEQ ID NO: 134937 - DNA, 257 bp, Homo sapiens
  misc_feature: GYAE6OF01BG70Z.49.11.A11.1.454.CMB.1.raw
  modified_base (252)..(257): a, c, t, g, unknown or other
  misc_feature (252)..(257): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnn

SEQ ID NO: 134938 - DNA, 258 bp, Homo sapiens
  misc_feature: GYAE6OF01BT5GW.49.11.A11.1.454.CMB.1.raw
  modified_base (255)..(258): a, c, t, g, unknown or other
  misc_feature (255)..(258): n is a, c, g, or t
tcagagtcgagagacacgaccggtgctcgatttagctacgactgcagggaacccggccaccctgaccatcagccgggtcgaagacggggatgaggccgactattactgtcacgtgtgggacagtagtagtgatcatgtggtgttcggcggagggaccaagctgaccgtcctaggtcagcccaaggctgccccctcggtcactctgttcccaccctcctctctctcgactctgagcgggctggcaaggcgcatagnnnn

SEQ ID NO: 134939 - DNA, 254 bp, Homo sapiens; identical to SEQ ID NO: 134762
  misc_feature: GYAE6OF01C8AKP.49.11.A11.1.454.CMB.1.raw
  modified_base (252)..(254): a, c, t, g, unknown or other
  misc_feature (252)..(254): n is a, c, g, or t

SEQ ID NO: 134940 - DNA, 253 bp, Homo sapiens
  misc_feature: GYAE6OF01AKIET.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnn

SEQ ID NO: 134941 - DNA, 255 bp, Homo sapiens; identical to SEQ ID NO: 134799
  misc_feature: GYAE6OF01C8F7L.49.11.A11.1.454.CMB.1.raw
  modified_base (252)..(255): a, c, t, g, unknown or other
  misc_feature (252)..(255): n is a, c, g, or t

SEQ ID NO: 134942 - DNA, 260 bp, Homo sapiens
  misc_feature: GYAE6OF01DH1R9.49.11.A11.1.454.CMB.1.raw
  modified_base (251)..(260): a, c, t, g, unknown or other
  misc_feature (251)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnnnnnnnn

SEQ ID NO: 134943 - DNA, 254 bp, Homo sapiens; identical to SEQ ID NO: 134762
  misc_feature: GYAE6OF01BCOS5.49.11.A11.1.454.CMB.1.raw
  modified_base (252)..(254): a, c, t, g, unknown or other
  misc_feature (252)..(254): n is a, c, g, or t

SEQ ID NO: 134944 - DNA, 255 bp, Homo sapiens; identical to SEQ ID NO: 134817
  misc_feature: GYAE6OF01E44PW.49.11.A11.1.454.CMB.1.raw
  modified_base (252)..(255): a, c, t, g, unknown or other
  misc_feature (252)..(255): n is a, c, g, or t

SEQ ID NO: 134945 - DNA, 253 bp, Homo sapiens; identical to SEQ ID NO: 134759
  misc_feature: GYAE6OF01A61ZH.49.11.A11.1.454.CMB.1.raw
  modified_base (252)..(253): a, c, t, g, unknown or other
  misc_feature (252)..(253): n is a, c, g, or t

SEQ ID NO: 134946 - DNA, 280 bp, Homo sapiens
  misc_feature: GYAE6OF01BEWUK.49.11.A11.1.454.CMB.1.raw
  modified_base (256)..(256): a, c, t, g, unknown or other
  misc_feature (256)..(256): n is a, c, g, or t
  modified_base (258)..(280): a, c, t, g, unknown or other
  misc_feature (258)..(280): n is a, c, g, or t
tcagagtcgagagacacgaccggtgctcgatttagctacgactgcaggggaacccggccacccgtgaccatcagccgggtcgaagacggggatgaggccgactattactgtcacggtgtgggatagtcggtagtggtgtcgtcttcggagctgggaccagggtcaccgtcctaggtcagcccaaggccaaccccactgtcactctgttcccgccctcctctctctcgactctgagcgggctggcaaggcgcatagnannnnnnnnnnnnnnnnnnnnnnn

SEQ ID NO: 134947 - DNA, 255 bp, Homo sapiens; identical to SEQ ID NO: 134799
  misc_feature: GYAE6OF01B9D1H.49.11.A11.1.454.CMB.1.raw
  modified_base (252)..(255): a, c, t, g, unknown or other
  misc_feature (252)..(255): n is a, c, g, or t

SEQ ID NO: 134948 - DNA, 256 bp, Homo sapiens
  misc_feature: GYAE6OF01EE23W.49.11.A11.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcagtagnnnn

SEQ ID NO: 134949 - DNA, 255 bp, Homo sapiens
  misc_feature: GYAE6OF01DWL9M.49.11.A11.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnn

SEQ ID NO: 134950 - DNA, 251 bp, Homo sapiens; identical to SEQ ID NO: 134740
  misc_feature: GYAE6OF01AY04X.49.11.A11.1.454.CMB.1.raw
  modified_base (251)..(251): a, c, t, g, unknown or other
  misc_feature (251)..(251): n is a, c, g, or t

SEQ ID NO: 134951 - DNA, 253 bp, Homo sapiens
  misc_feature: GYAE6OF01C4ZNO.49.11.A11.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtctttggagctgggaccagggtcaccgtcctaggtcagcccaaggccaaccccactgtcactctgttcccgccctcctctctctcgactctgagcgggctggcaaggcgcatagnn

SEQ ID NO: 134952 - DNA, 254 bp, Homo sapiens; identical to SEQ ID NO: 134802
  misc_feature: GYAE6OF01CDM82.49.11.A11.1.454.CMB.1.raw
  modified_base (252)..(254): a, c, t, g, unknown or other
  misc_feature (252)..(254): n is a, c, g, or t

SEQ ID NO: 134953 - DNA, 264 bp, Homo sapiens
  misc_feature: GYAE6OF01E2IRX.49.11.A11.1.454.CMB.1.raw
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (242)..(264): a, c, t, g, unknown or other
  misc_feature (242)..(264): n is a, c, g, or t
tcagagtcgagagacacgaccggtgctcgatttagctacgactgcagggaacccggccaccctgaccatcagccgggtcgaagacgggatgaggcccgatattactgtcaggtgtgggatagtggtagtggtgtcgtcttcggagctgggaccaggtcaccgtctaggcacgccagccaacccntgtcactctcgtcccncctcgtctctctcgactcagcgcggactggcaaggcatatgnnnnnnnnnnnnnnnnnnnnnnn

SEQ ID NO: 134954 - DNA, 259 bp, Homo sapiens
  misc_feature: GYAE6OF01BPHJ3.49.11.A11.1.454.CMB.1.raw
  modified_base (252)..(259): a, c, t, g, unknown or other
  misc_feature (252)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnn

SEQ ID NO: 134955 - DNA, 256 bp, Homo sapiens
  misc_feature: GYAE6OF01CCYNY.49.11.A11.1.454.CMB.1.raw
  modified_base (249)..(256): a, c, t, g, unknown or other
  misc_feature (249)..(256): n is a, c, g, or t
tcagagtcgagagacacgaccggtgctcgatttagctacgactgcagggaacccggccaccctgaccatcagccggtcgaagacgggatgaggccgactattactgtcaggtgtgggatagtggtagtggtgtcgtcttcggagctgggaccagggtcaccgtcctaggtcagcccaaggccaacccactgtcactctgttcccgccctcctctctctcgactctgagcgggctggcaaggcgcatagnnnnnnnn

SEQ ID NO: 134956 - DNA, 291 bp, Homo sapiens
  misc_feature: GYAE6OF01CAMFE.49.11.A11.1.454.CMB.1.raw
  modified_base (257)..(257): a, c, t, g, unknown or other
  misc_feature (257)..(257): n is a, c, g, or t
  modified_base (259)..(291): a, c, t, g, unknown or other
  misc_feature (259)..(291): n is a, c, g, or t
tcagagtcgagagacacgaccggtgctcgatttagctacgactgcagggaacccggccgacccttgaccatcagccgggtcgaagacggggatgacggccgactattactgtcaggtgtgggatagtggtagtggtgtcgtcttcggagctgggaccagggtcaccggtcctaggtcagcccaaggccaaccccactgtcactctgttcccacctcctcttctctcgactctgagcgggctggcaaggccgcatagntnnnnnnnnnnnnnnnnnnnnnnnnnnnnnnnnn

SEQ ID NO: 134957 - DNA, 253 bp, Homo sapiens; identical to SEQ ID NO: 134877
  misc_feature: GYAE6OF01BBXD6.49.11.A11.1.454.CMB.1.raw
  modified_base (252)..(253): a, c, t, g, unknown or other
  misc_feature (252)..(253): n is a, c, g, or t

SEQ ID NO: 134958 - DNA, 264 bp, Homo sapiens
  misc_feature: GYAE6OF01D3NDQ.49.11.A11.1.454.CMB.1.raw
  modified_base (252)..(264): a, c, t, g, unknown or other
  misc_feature (252)..(264): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnn

SEQ ID NO: 134959 - DNA, 162 bp, Homo sapiens
  misc_feature: GYAE6OF01BGSDV.49.11.A11.1.454.CMB.1.raw
  modified_base (161)..(162): a, c, t, g, unknown or other
  misc_feature (161)..(162): n is a, c, g, or t
tcagagtcgagagacacgaccggtgctcgatttagctacgactgcagggagcttactgactaggccggccttaattaaggtcagcctaaggctgcccccagcgtcactctgttcccaccctcctctctctcgactctgagcgggctggcaaggcgcatagnn

SEQ ID NO: 134960 - DNA, 283 bp, Homo sapiens
  misc_feature: GYAE6OF01ARJY9.49.11.A11.1.454.CMB.1.raw
  modified_base (255)..(283): a, c, t, g, unknown or other
  misc_feature (255)..(283): n is a, c, g, or t
tcagagtcgagagacacgaccggtgctcgatttagctacgactgcagggaacccggccacccgtgaccatcgagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagccgggctggcaaggcgcatagnnnnnnnnnnnnnnnnnnnnnnnnnnnnn

SEQ ID NO: 134961 - DNA, 254 bp, Homo sapiens
  misc_feature: GYAE6OF01A9I4P.49.11.A11.1.454.CMB.1.raw
  modified_base (252)..(254): a, c, t, g, unknown or other
  misc_feature (252)..(254): n is a, c, g, or t
tcagagtcgagagacacgaccggtgctcgatttagctacgactgcagggaacccggccaccctgaccatcagccgggtcaaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnn

SEQ ID NO: 134962 - DNA, 260 bp, Homo sapiens
  misc_feature: GYAE6OF01EW1IH.49.11.A11.1.454.CMB.1.raw
  modified_base (252)..(260): a, c, t, g, unknown or other
  misc_feature (252)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccttcctctctctcgactctgagcgggctggcaaggcgcatagnnnnnnnnn

SEQ ID NO: 134963 - DNA, 519 bp, Homo sapiens
  misc_feature: GYAE6OF01AWSC6.49.11.A11.1.454.CMB.1.raw
  modified_base (449)..(449): a, c, t, g, unknown or other
  misc_feature (449)..(449): n is a, c, g, or t
  modified_base (473)..(473): a, c, t, g, unknown or other
  misc_feature (473)..(473): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtccgtggcccccagggacagacggccaggtttccctgtgagggcaacaacattggtggtaaaggtgtgcactggtaccagcagaagccaggccaggcccctgtgttggtcgtccatgatgacagccgaccggccctcgagggatccctgacgcgtattttctggctccaagtctgggaacacggccaccctgaccgtcagcgagggtcgaagccggggatggaggccgactatatctgtcaggtgtgggatagtagtagtgctcgtcggggtgtcggnggaggacaggttcgacgtgtgtcngccagctcgcccctggcactctcgtcccacctctctcnctcgntcg

SEQ ID NO: 134964 - DNA, 254 bp, Homo sapiens; identical to SEQ ID NO: 134762
  misc_feature: GYAE6OF01CTP8Z.49.11.A11.1.454.CMB.1.raw
  modified_base (252)..(254): a, c, t, g, unknown or other
  misc_feature (252)..(254): n is a, c, g, or t

SEQ ID NO: 134965 - DNA, 253 bp, Homo sapiens
  misc_feature: GYAE6OF01A5WHF.49.11.A11.1.454.CMB.1.raw
  modified_base (138)..(138): a, c, t, g, unknown or other
  misc_feature (138)..(138): n is a, c, g, or t
  modified_base (249)..(253): a, c, t, g, unknown or other
  misc_feature (249)..(253): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtnttcggagctgggaccagggtcaccgtcctaggtcagcccaaggccaacccactgtcactctgttcccacctcctctctctcgactctgagcgggctggcaaggcgcatagnnnnn

SEQ ID NO: 134966 - DNA, 255 bp, Homo sapiens; identical to SEQ ID NO: 134799
  misc_feature: GYAE6OF01EGZJ6.49.11.A11.1.454.CMB.1.raw
  modified_base (252)..(255): a, c, t, g, unknown or other
  misc_feature (252)..(255): n is a, c, g, or t

SEQ ID NO: 134967 - DNA, 267 bp, Homo sapiens
  misc_feature: GYAE6OF01DQUGS.49.11.A11.1.454.CMB.1.raw
  modified_base (251)..(267): a, c, t, g, unknown or other
  misc_feature (251)..(267): n is a, c, g, or t
tcagagtcgagagacacgaccggtgctcgatttagctacgactgcaggggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaaggcgcatagnnnnnnnnnnnnnnnnn

SEQ ID NO: 134968 - DNA, 267 bp, Homo sapiens
  misc_feature: GYAE6OF01AMTCT.49.11.A11.1.454.CMB.1.raw
  modified_base (253)..(267): a, c, t, g, unknown or other
  misc_feature (253)..(267): n is a, c, g, or t
tcagagtcgagagacacgaccggtgctcgatttagctacgactgcagggaacccggccaccctgaccatcagcccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnn

SEQ ID NO: 134969 - DNA, 255 bp, Homo sapiens; identical to SEQ ID NO: 134817
  misc_feature: GYAE6OF01C7FO8.49.11.A11.1.454.CMB.1.raw
  modified_base (252)..(255): a, c, t, g, unknown or other
  misc_feature (252)..(255): n is a, c, g, or t

SEQ ID NO: 134970 - DNA, 253 bp, Homo sapiens; identical to SEQ ID NO: 134759
  misc_feature: GYAE6OF01DKJJU.49.11.A11.1.454.CMB.1.raw
  modified_base (252)..(253): a, c, t, g, unknown or other
  misc_feature (252)..(253): n is a, c, g, or t

SEQ ID NO: 134971 - DNA, 256 bp, Homo sapiens; identical to SEQ ID NO: 134784
  misc_feature: GYAE6OF01EWINN.49.11.A11.1.454.CMB.1.raw
  modified_base (252)..(256): a, c, t, g, unknown or other
  misc_feature (252)..(256): n is a, c, g, or t

SEQ ID NO: 134972 - DNA, 257 bp, Homo sapiens
  misc_feature: GYAE6OF01CU9J6.49.11.A11.1.454.CMB.1.raw
  modified_base (252)..(257): a, c, t, g, unknown or other
  misc_feature (252)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaaggcgcatagnnnnnn

SEQ ID NO: 134973 - DNA, 273 bp, Homo sapiens
  misc_feature: GYAE6OF01CK03L.49.11.A11.1.454.CMB.1.raw
  modified_base (247)..(247): a, c, t, g, unknown or other
  misc_feature (247)..(247): n is a, c, g, or t
  modified_base (253)..(273): a, c, t, g, unknown or other
  misc_feature (253)..(273): n is a, c, g, or t
tcagagtcgagagacacgaccggtgctcgatttagctacgactgcaggggaacccggccaccctgaccatcagccggggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctctctctctcgactctgagcgggctggcaaggcncatagnnnnnnnnnnnnnnnnnnnnn

SEQ ID NO: 134974 - DNA, 254 bp, Homo sapiens; identical to SEQ ID NO: 134762
  misc_feature: GYAE6OF01C39VP.49.11.A11.1.454.CMB.1.raw
  modified_base (252)..(254): a, c, t, g, unknown or other
  misc_feature (252)..(254): n is a, c, g, or t

SEQ ID NO: 134975 - DNA, 255 bp, Homo sapiens; identical to SEQ ID NO: 134799
  misc_feature: GYAE6OF01DP3L7.49.11.A11.1.454.CMB.1.raw
  modified_base (252)..(255): a, c, t, g, unknown or other
  misc_feature (252)..(255): n is a, c, g, or t

SEQ ID NO: 134976 - DNA, 252 bp, Homo sapiens; identical to SEQ ID NO: 134836
  misc_feature: GYAE6OF01EGW6Z.49.11.A11.1.454.CMB.1.raw
  modified_base (252)..(252): a, c, t, g, unknown or other
  misc_feature (252)..(252): n is a, c, g, or t

SEQ ID NO: 134977 - DNA, 533 bp, Homo sapiens
  misc_feature: GYAE6OF01BXL1Q.49.11.A11.1.454.CMB.1.raw
  modified_base (172)..(172): a, c, t, g, unknown or other
  misc_feature (172)..(172): n is a, c, g, or t
  modified_base (439)..(439): a, c, t, g, unknown or other
  misc_feature (439)..(439): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtntcagtggcccctggacagacggccaggattacctggtgggggaaacacattggaagtaagactgtgcactggtaccagcagaagccaggccaggcccctgtgactggtctctatggtgagtggcgaccggccctgagggactccctgagcgtattctctggctaccaactcgtcgggaacccgcaccctgaccatcaggccggtcaaggcgggatggaggctgactattactgcaggtgtggatggtgtagtgtgtacgtcgtcggngtcgtgggacctagggtccaccggtcctacggtcacggcccaagggcccaacccgctagcactctcgtccccacctcctactcctctcgtaccg

SEQ ID NO: 134978 - DNA, 263 bp, Homo sapiens
  misc_feature: GYAE6OF01CEEGF.49.11.A11.1.454.CMB.1.raw
  modified_base (243)..(243): a, c, t, g, unknown or other
  misc_feature (243)..(243): n is a, c, g, or t
  modified_base (249)..(263): a, c, t, g, unknown or other
  misc_feature (249)..(263): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtctaggtcagcccaaggccaacccactgtcactctgttccccacctcctctctctcgactctgagcgggctggcaaggcncatagnnnnnnnnnnnnnnn

SEQ ID NO: 134979 - DNA, 261 bp, Homo sapiens
  misc_feature: GYAE6OF01EUZZA.49.11.A11.1.454.CMB.1.raw
  modified_base (196)..(196): a, c, t, g, unknown or other
  misc_feature (196)..(196): n is a, c, g, or t
  modified_base (251)..(261): a, c, t, g, unknown or other
  misc_feature (251)..(261): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcnctctgttcccgccctcctctctctcgactctgagcgggctggcaaggcgcatagnnnnnnnnnnn

SEQ ID NO: 134980 - DNA, 253 bp, Homo sapiens
  misc_feature: GYAE6OF01DFIBM.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcactctgagcgggctggcaaggcgcatagnnn

SEQ ID NO: 134981 - DNA, 251 bp, Homo sapiens
  misc_feature: GYAE6OF01DSBW1.49.11.A11.1.454.CMB.1.raw
  modified_base (251)..(251): a, c, t, g, unknown or other
  misc_feature (251)..(251): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagn

SEQ ID NO: 134982 - DNA, 164 bp, Homo sapiens
  misc_feature: GYAE6OF01C9KGG.49.11.A11.1.454.CMB.1.raw
  modified_base (156)..(156): a, c, t, g, unknown or other
  misc_feature (156)..(156): n is a, c, g, or t
  modified_base (162)..(164): a, c, t, g, unknown or other
  misc_feature (162)..(164): n is a, c, g, or t
tcagagtcgagagacacgaccggtgctcgatttagctacgactgcagggagcttactgactaggccggccttaattaaggtcagcctaaggctcgccccagcgtcactctcgttcccaccctcctctctctcgactctgagcggctggacaaggcncatagnnn

SEQ ID NO: 134983 - DNA, 257 bp, Homo sapiens
  misc_feature: GYAE6OF01CH4JF.49.11.A11.1.454.CMB.1.raw
  modified_base (255)..(257): a, c, t, g, unknown or other
  misc_feature (255)..(257): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaaccccactgtcactctgttccccaccctcctctctctcgactctgagcgggctggcaaggcgcatagnnn

SEQ ID NO: 134984 - DNA, 259 bp, Homo sapiens
  misc_feature: GYAE6OF01DSM9J.49.11.A11.1.454.CMB.1.raw
  modified_base (250)..(259): a, c, t, g, unknown or other
  misc_feature (250)..(259): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcggctggcaaggcgcatagnnnnnnnnnn

SEQ ID NO: 134985 - DNA, 677 bp, Homo sapiens
  misc_feature: GYAE6OF01BJTBQ.49.11.A11.1.454.CMB.1.raw
tcagagtcgagagacacgaccggtgctcgatttagctacgactgcaggggggcctaaggaagcagcacgtggtcggtgccctcgagttccagtggtcctggtaccgttctcctcctcgggcctcctactctcactagcaccagacgtcttggtgacctcctatggtgttcttgactcagtaccgacctcggtgttagtggccctggacagacgcctaggattaccgtgggtgggggaaactacgattggaacgtaggacctgtgctactggtaccagcagacgccaggcctaggccccttgtcgctggtcgtctactggtgacttgggccgaccggcccgtcgacgggacgtacccggtgaggcgtagtttctcgtcgggctacctaaacgtcgtacggggaacccggcctaccctcgaccatccgacggccgggttcggaacgggaccggggtactacgggacggtcccgaaccgttaagttaccgtacgtacctacgggtgggtacgggatacgtgggttagtgggttacgtcggtcgtttacggaggcgttacggggacccgagggtccgaacggttccgtaggtccgacgacccgaggccctaaacccgtgttcggtccacgttcgtcgttacccctacccctaccgttcctacctcctcgtccgtcttcggg

SEQ ID NO: 134986 - DNA, 555 bp, Homo sapiens
  misc_feature: GYAE6OF01EMU44.49.11.A11.1.454.CMB.1.raw
  modified_base (218)..(218): a, c, t, g, unknown or other
  misc_feature (218)..(218): n is a, c, g, or t
  modified_base (329)..(329): a, c, t, g, unknown or other
  misc_feature (329)..(329): n is a, c, g, or t
  modified_base (509)..(509): a, c, t, g, unknown or other
  misc_feature (509)..(509): n is a, c, g, or t
tcagagtcgagagacacgaccggtgctcgatttagctacgactgcagggggggccgtaaggaagcagcactggtggtgcctcagccatggcctggaccgttctcctcctcggcctcctctctcactgcacagactctgtgacctcctatgtgctgactcagccaccctcggtgtcagtggccctggacagacggccaggattacctggtggggaaacncattggaagtaagactgtgcactggtaccagcagaagccaggccaggccctgtgctggtcgtctatggtgatgggcgaccggccctcgagggactcccgtgacgcgattcnctggctcaactcgtgggaacccgcacctgaccatcgagccggtcgaaggacgggatgaggctgactattactgtcgaggtggtaggattaggtggtagtggtgttcgtcgttgggagtcgtcgggaccgtagggttccacccgtcgtaggtccaggacccgaaacggcccaaaccccgtntacggtcacgttcctcgttaccccaccctccttctcctctcgtacc

SEQ ID NO: 134987 - DNA, 253 bp, Homo sapiens; identical to SEQ ID NO: 134759
  misc_feature: GYAE6OF01CMCVJ.49.11.A11.1.454.CMB.1.raw
  modified_base (252)..(253): a, c, t, g, unknown or other
  misc_feature (252)..(253): n is a, c, g, or t

SEQ ID NO: 134988 - DNA, 558 bp, Homo sapiens
  misc_feature: GYAE6OF01ETSKQ.49.11.A11.1.454.CMB.1.raw
  modified_base (518)..(518): a, c, t, g, unknown or other
  misc_feature (518)..(518): n is a, c, g, or t
  modified_base (538)..(538): a, c, t, g, unknown or other
  misc_feature (538)..(538): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggcctcgagggactccctgagcgattctctggctccaactcgtcggggaaccccgccacccgtcgaccatcgacggccgggtcgaaaggacgggggatggacggccgactattacgtgtcgaggtgtgggataggtggtagtgggtgtcgtcgttcgggagtcgtggggacccgaggggtccaccggtcctagggtcacggcccaagggcccaaaccccncgtcgtcactctcgtccccncctcctctcctctcgactcg

SEQ ID NO: 134989 - DNA, 256 bp, Homo sapiens; identical to SEQ ID NO: 134784
  misc_feature: GYAE6OF01CPYV5.49.11.A11.1.454.CMB.1.raw
  modified_base (252)..(256): a, c, t, g, unknown or other
  misc_feature (252)..(256): n is a, c, g, or t

SEQ ID NO: 134990 - DNA, 257 bp, Homo sapiens; identical to SEQ ID NO: 134898
  misc_feature: GYAE6OF01ANHVS.49.11.A11.1.454.CMB.1.raw
  modified_base (252)..(257): a, c, t, g, unknown or other
  misc_feature (252)..(257): n is a, c, g, or t

SEQ ID NO: 134991 - DNA, 554 bp, Homo sapiens
  misc_feature: GYAE6OF01C6PPT.49.11.A11.1.454.CMB.1.raw
  modified_base (520)..(520): a, c, t, g, unknown or other
  misc_feature (520)..(520): n is a, c, g, or t
  modified_base (542)..(542): a, c, t, g, unknown or other
  misc_feature (542)..(542): n is a, c, g, or t
  modified_base (548)..(548): a, c, t, g, unknown or other
  misc_feature (548)..(548): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggtcaggattacctgtgggggaaacacattggaaagtaagactgtgcactggtaccagcagaagccaggccaggcccctgtgctggtcgtctatggtgatggcgaccggccctcagggactccctgagcgattctctggctccaactcgtacgggaacccggccaccctgaccatcacggccggggtacgaaacggacgggggataggacgggcccgaacttaagttaacctggttacaggggtgtggggattaggtggtagtgggtgtcgtcttcgggagcgtgggaccaggggtcaccgtctaggtcacgcccaaggcccaacccntcgcactctcgtcccacctccnctctcncgctcg

SEQ ID NO: 134992 - DNA, 527 bp, Homo sapiens
  misc_feature: GYAE6OF01CDUQC.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcaggggatccctgagcgattctctggctccaactcgtgggaacccgcaccctgaccatcagccggtcgaagacgggatgaggccgactattacgtgtcagggtgtgggatagtggtagtggtgtcgtcttcgggagtcgtgggaccaggggtcaccgtctaggtcacgcccaaggcccaaccccgcgtcgtcactctcgttcccaccctctctctctcgctcg

SEQ ID NO: 134993 - DNA, 255 bp, Homo sapiens
  misc_feature: GYAE6OF01BT0BI.49.11.A11.1.454.CMB.1.raw
  modified_base (255)..(255): a, c, t, g, unknown or other
  misc_feature (255)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgcgttttttctcggagctgggaccagggtcaccgtcctaggtcagcccaaggccaaccccactgtcactctgttcccaccctcctctctctcgactctgagcgggctggcaaggcgcatagn

SEQ ID NO: 134994 - DNA, 265 bp, Homo sapiens
  misc_feature: GYAE6OF01EF7GA.49.11.A11.1.454.CMB.1.raw
  modified_base (248)..(265): a, c, t, g, unknown or other
  misc_feature (248)..(265): n is a, c, g, or t
tcagagtcgagagacacgaccggtgctcgatttagctacgactgcagggaacccggccaccctgaccatcagccggtcgaagacgggatgaggccgactattacctgtcaggtgtgggatagtggtagtggtgtcgtcttcggagctgggaccagggtcaccgtcctaggtcagcccaaggccaacccactgtcactctgttcccacctcctctctctcgactctgagcggctggcaaggcgcatagnnnnnnnnnnnnnnnnnn

SEQ ID NO: 134995 - DNA, 255 bp, Homo sapiens; identical to SEQ ID NO: 134817
  misc_feature: GYAE6OF01D5KRS.49.11.A11.1.454.CMB.1.raw
  modified_base (252)..(255): a, c, t, g, unknown or other
  misc_feature (252)..(255): n is a, c, g, or t

SEQ ID NO: 134996 - DNA, 254 bp, Homo sapiens; identical to SEQ ID NO: 134762
  misc_feature: GYAE6OF01EHCFV.49.11.A11.1.454.CMB.1.raw
  modified_base (252)..(254): a, c, t, g, unknown or other
  misc_feature (252)..(254): n is a, c, g, or t

SEQ ID NO: 134997 - DNA, 252 bp, Homo sapiens; identical to SEQ ID NO: 134844
  misc_feature: GYAE6OF01CZL98.49.11.A11.1.454.CMB.1.raw
  modified_base (252)..(252): a, c, t, g, unknown or other
  misc_feature (252)..(252): n is a, c, g, or t

SEQ ID NO: 134998 - DNA, 255 bp, Homo sapiens
  misc_feature: GYAE6OF01A526D.49.11.A11.1.454.CMB.1.raw
  modified_base (252)..(255): a, c, t, g, unknown or other
  misc_feature (252)..(255): n is a, c, g, or t
tcagagtcgagagacacgaccggtgctcgatttagctacgactgcagggaacccggccaccctgaccatcagccgggtcgaagacggggatgaggccgactattactgtaaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnn

SEQ ID NO: 134999 - DNA, 254 bp, Homo sapiens; identical to SEQ ID NO: 134762
  misc_feature: GYAE6OF01AW6NV.49.11.A11.1.454.CMB.1.raw
  modified_base (252)..(254): a, c, t, g, unknown or other
  misc_feature (252)..(254): n is a, c, g, or t

SEQ ID NO: 135000 - DNA, 252 bp, Homo sapiens; identical to SEQ ID NO: 134836
  misc_feature: GYAE6OF01BVLC2.49.11.A11.1.454.CMB.1.raw
  modified_base (252)..(252): a, c, t, g, unknown or other
  misc_feature (252)..(252): n is a, c, g, or t

SEQ ID NO: 135001 - DNA, 609 bp, Homo sapiens
  misc_feature: GYAE6OF01EMZWO.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtggggaaacacagttggaagtaagactgtgcactggtaccagcagaagccaggccaggcccctgtgctggtcgtctatggtgatggcgaccggccctcgagggactcccgtgacgcgtattcctcgtggcctaccaacgtcgtcggggaaccccggccacccgtgaccatccgacggccgggtacgaaaggacggggatcggacggccgtacgttagttacgtggtacgagggttcgtgggattaggtgggttagtggttgtcgttcgttcgggacgtcggtacggggaccgtaggggtcctaccggttcgtaggtccacggcccgaacggccccaaaccccgtacgtcgtaccacgttccttcgttaccccacccgttcctccttcctccgtgaccgttcg

SEQ ID NO: 135002 - DNA, 256 bp, Homo sapiens
  misc_feature: GYAE6OF01CJM2E.49.11.A11.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnn

SEQ ID NO: 135003 - DNA, 254 bp, Homo sapiens; identical to SEQ ID NO: 134762
  misc_feature: GYAE6OF01BHY1D.49.11.A11.1.454.CMB.1.raw
  modified_base (252)..(254): a, c, t, g, unknown or other
  misc_feature (252)..(254): n is a, c, g, or t

SEQ ID NO: 135004 - DNA, 539 bp, Homo sapiens
  misc_feature: GYAE6OF01ASSYL.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctcgggaacccggccaccctgaccatcagccgggtcgaaggacggggatgaggccgactattactgtcaggtgtgggatagtgagtacggaccagttgggtgttcgggcggagggaccgaagggtcgaccgtcgtaggtcagcccgaaggcctcgcccccgtcggtccactctcgttccccgccctcctctctctcgctcg

SEQ ID NO: 135005 - DNA, 256 bp, Homo sapiens
  misc_feature: GYAE6OF01BXZ3L.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaaggcgcatagnnnnnn

SEQ ID NO: 135006 - DNA, 253 bp, Homo sapiens
  misc_feature: GYAE6OF01D8ZI3.49.11.A11.1.454.CMB.1.raw
  modified_base (250)..(253): a, c, t, g, unknown or other
  misc_feature (250)..(253): n is a, c, g, or t
tcagagtcgagagacacgaccggtgctcgatttagctacgactgcagggaacccggcaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnn

SEQ ID NO: 135007 - DNA, 253 bp, Homo sapiens; identical to SEQ ID NO: 134759
  misc_feature: GYAE6OF01EJHZV.49.11.A11.1.454.CMB.1.raw
  modified_base (252)..(253): a, c, t, g, unknown or other
  misc_feature (252)..(253): n is a, c, g, or t

SEQ ID NO: 135008 - DNA, 212 bp, Homo sapiens
  misc_feature: GYAE6OF01EDCOB.49.11.A11.1.454.CMB.1.raw
  modified_base (208)..(212): a, c, t, g, unknown or other
  misc_feature (208)..(212): n is a, c, g, or t
tcagagtcgagagacacgaccggtgctcgatttagctacgactgcagggcacgaccggtgctcgatttagcacacgatagttgggtttgggggaagaggaagactgacggtccccccaggagttcaggtgctgggcacagcggcctgggctgcctggtcaaggactacttcctcgtagcactctgagcgggctggcaaggcgcatagnnnnn

SEQ ID NO: 135009 - DNA, 549 bp, Homo sapiens
  misc_feature: GYAE6OF01B2MNL.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcgagggactccctgacgcgattctctggctccaactcgtcgggaaccccgccaccctgaccatccgaggccggggtcgaaggacggggatcggaggccgatagttactgtcgaggtgtggatagtgggtagtggtgtcgtcttcggagcgtgggaccgagggtccaccgttccgtaggtcacgccccaagggcccaaaccccgcgtcgtcactctcgttccccaccctcctctcctctcgctccg

SEQ ID NO: 135010 - DNA, 264 bp, Homo sapiens
  misc_feature: GYAE6OF01E3MVN.49.11.A11.1.454.CMB.1.raw
  modified_base (249)..(264): a, c, t, g, unknown or other
  misc_feature (249)..(264): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctctctctctcactctgagcgggctggcaaggcgcatagnnnnnnnnnnnnnnnn

SEQ ID NO: 135011 - DNA, 255 bp, Homo sapiens; identical to SEQ ID NO: 134817
  misc_feature: GYAE6OF01CJ5GJ.49.11.A11.1.454.CMB.1.raw
  modified_base (252)..(255): a, c, t, g, unknown or other
  misc_feature (252)..(255): n is a, c, g, or t

SEQ ID NO: 135012 - DNA, 256 bp, Homo sapiens; identical to SEQ ID NO: 135005
  misc_feature: GYAE6OF01BYX4V.49.11.A11.1.454.CMB.1.raw
  modified_base (251)..(256): a, c, t, g, unknown or other
  misc_feature (251)..(256): n is a, c, g, or t

SEQ ID NO: 135013 - DNA, 275 bp, Homo sapiens
  misc_feature: GYAE6OF01BXHQZ.49.11.A11.1.454.CMB.1.raw
  modified_base (251)..(252): a, c, t, g, unknown or other
  misc_feature (251)..(252): n is a, c, g, or t
  modified_base (254)..(275): a, c, t, g, unknown or other
  misc_feature (254)..(275): n is a, c, g, or t
tcagagtcgagagacacgaccggtgctcgatttagctacgactgcagggaacccggccaccctgaccatcagccgggtcgaagacgggatgaggccgactattactgtcaggtgtcgggatagtggtagtggtgtcgtcttcggagctgggaccagggtcaccgtctaggtcagcccaaggccaaccccactgtcactctgttccccacctcctctctctcgactctgagcgggctggcaaggcgcatagnnannnnnnnnnnnnnnnnnnnnnn

SEQ ID NO: 135014 - DNA, 531 bp, Homo sapiens
  misc_feature: GYAE6OF01B6BJV.49.11.A11.1.454.CMB.1.raw
  modified_base (492)..(492): a, c, t, g, unknown or other
  misc_feature (492)..(492): n is a, c, g, or t
tcagagtcgagagacacgaccggtgctcgatttagctacgactgcagggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcgagggatccctgagcgattctctggctccaactcgtcgggaacccggccaccctgaccatcagccggtcgaaggacggggatgacggccgactattactgtcaggtgtgggataggtggtagtggtgtcgtcttcgggagcgtgggaccagggtccaccggtcctaggtcagcccgaaggcccaacccncgtcgtcactctcgtccccaccctcctctctctcgctcg

SEQ ID NO: 135015 - DNA, 557 bp, Homo sapiens
  misc_feature: GYAE6OF01CH8PY.49.11.A11.1.454.CMB.1.raw
  modified_base (511)..(511): a, c, t, g, unknown or other
  misc_feature (511)..(511): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaaacacattggaagtaagactgtgcactggtaccagcagaagccaggccaggcccctgtgctggtcgtctatggtgatgggcgaccggccctcgaggggactcccgtgagcgattctctggctccaactcgtcggggaaccccgccaccctgaccatcacggccgggtcgaaggacggggatggaggccgactatactgtcaggtgtgggataggtggtagtggtgtcgtcgttcgggagtcgtggggacctaggggtccaccgtcgtaggtcacggcccgaaggccccaaccccncgtcgtcaccttctccgttccccaccctcctctcctctccgctccg

SEQ ID NO: 135016 - DNA, 254 bp, Homo sapiens; identical to SEQ ID NO: 134762
  misc_feature: GYAE6OF01B7R7X.49.11.A11.1.454.CMB.1.raw
  modified_base (252)..(254): a, c, t, g, unknown or other
  misc_feature (252)..(254): n is a, c, g, or t

SEQ ID NO: 135017 - DNA, 248 bp, Homo sapiens
  misc_feature: GYAE6OF01DSDJT.49.11.A11.1.454.CMB.1.raw
  modified_base (248)..(248): a, c, t, g, unknown or other
  misc_feature (248)..(248): n is a, c, g, or t
tcagagtcgagagacacgaccggtgctcgatttagctacgactgcgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccgccctctctctctcgactctgagcggctggcaaggcgcatagn

SEQ ID NO: 135018 - DNA, 255 bp, Homo sapiens; identical to SEQ ID NO: 134799
  misc_feature: GYAE6OF01CJMA2.49.11.A11.1.454.CMB.1.raw
  modified_base (252)..(255): a, c, t, g, unknown or other
  misc_feature (252)..(255): n is a, c, g, or t

SEQ ID NO: 135019 - DNA, 256 bp, Homo sapiens; identical to SEQ ID NO: 134784
  misc_feature: GYAE6OF01C5792.49.11.A11.1.454.CMB.1.raw
  modified_base (252)..(256): a, c, t, g, unknown or other
  misc_feature (252)..(256): n is a, c, g, or t

SEQ ID NO: 135020 - DNA, 254 bp, Homo sapiens; identical to SEQ ID NO: 134762
  misc_feature: GYAE6OF01CNXJL.49.11.A11.1.454.CMB.1.raw
  modified_base (252)..(254): a, c, t, g, unknown or other
  misc_feature (252)..(254): n is a, c, g, or t

SEQ ID NO: 135021 - DNA, 257 bp, Homo sapiens
  misc_feature: GYAE6OF01BWL8V.49.11.A11.1.454.CMB.1.raw
  modified_base (249)..(257): a, c, t, g, unknown or other
  misc_feature (249)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccgcctcctcctctcgactctgagcggcgtgcgacgacgcatagnnnnnnnnn

SEQ ID NO: 135022 - DNA, 254 bp, Homo sapiens; identical to SEQ ID NO: 134762
  misc_feature: GYAE6OF01BE3EF.49.11.A11.1.454.CMB.1.raw
  modified_base (252)..(254): a, c, t, g, unknown or other
  misc_feature (252)..(254): n is a, c, g, or t

SEQ ID NO: 135023 - DNA, 255 bp, Homo sapiens; identical to SEQ ID NO: 134817
  misc_feature: GYAE6OF01B2O3X.49.11.A11.1.454.CMB.1.raw
  modified_base (252)..(255): a, c, t, g, unknown or other
  misc_feature (252)..(255): n is a, c, g, or t

SEQ ID NO: 135024 - DNA, 279 bp, Homo sapiens
  misc_feature: GYAE6OF01CTZDL.49.11.A11.1.454.CMB.1.raw
  modified_base (257)..(279): a, c, t, g, unknown or other
  misc_feature (257)..(279): n is a, c, g, or t
tcagagtcgagagacacgaccggtgctcgatttagctacgactgcagggaacccggccaccctggaccatcagccgggtcgaagacggggatgaggccgactattacctgtcaggtgtgggatagtggtagtggtgtcgtcttcggagctgggaccagggtcaaccgtcctaggtcagcccaaggccaaccccatgtccactctgttcccgccctcctcgtctctcgacctctgagcgggctggcaaggcgcatagnnnnnnnnnnnnnnnnnnnnnnn

SEQ ID NO: 135025 - DNA, 254 bp, Homo sapiens; identical to SEQ ID NO: 134802
  misc_feature: GYAE6OF01A1M8F.49.11.A11.1.454.CMB.1.raw
  modified_base (252)..(254): a, c, t, g, unknown or other
  misc_feature (252)..(254): n is a, c, g, or t

SEQ ID NO: 135026 - DNA, 254 bp, Homo sapiens; identical to SEQ ID NO: 134762
  misc_feature: GYAE6OF01B1O2F.49.11.A11.1.454.CMB.1.raw
  modified_base (252)..(254): a, c, t, g, unknown or other
  misc_feature (252)..(254): n is a, c, g, or t

SEQ ID NO: 135027 - DNA, 252 bp, Homo sapiens
  misc_feature: GYAE6OF01A6DMW.49.11.A11.1.454.CMB.1.raw
  modified_base (251)..(252): a, c, t, g, unknown or other
  misc_feature (251)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcggctggcaaggcgcatagnn

SEQ ID NO: 135028 - DNA, 268 bp, Homo sapiens
  misc_feature: GYAE6OF01DG868.49.11.A11.1.454.CMB.1.raw
  modified_base (244)..(244): a, c, t, g, unknown or other
  misc_feature (244)..(244): n is a, c, g, or t
  modified_base (250)..(268): a, c, t, g, unknown or other
  misc_feature (250)..(268): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcncatagnnnnnnnnnnnnnnnnnnn

SEQ ID NO: 135029 - DNA, 255 bp, Homo sapiens
  misc_feature: GYAE6OF01AOH55.49.11.A11.1.454.CMB.1.raw
  modified_base (247)..(247): a, c, t, g, unknown or other
  misc_feature (247)..(247): n is a, c, g, or t
  modified_base (252)..(255): a, c, t, g, unknown or other
  misc_feature (252)..(255): n is a, c, g, or t
tcagagtcgagagacacgaccggtgctcgatttagctacgactgcgggaacccggccaccctgaccatcagccgggtcgaagacggggatgaggccgaccattactgtcaggtgtgggatagtggtagtggtgtcgtcttcggagctgggaccagggtcaccgtcctaggtcagcccaaggccaaccccatgtcactctcgttccccaccctcctctctctcgactctgagcgggctggcaaggcgnatagnnnn

SEQ ID NO: 135030 - DNA, 257 bp, Homo sapiens
  misc_feature: GYAE6OF01CP4QZ.49.11.A11.1.454.CMB.1.raw
  modified_base (250)..(257): a, c, t, g, unknown or other
  misc_feature (250)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctctctctctcactctgagcgggctggcaaggcgcatagnnnnnnnn

SEQ ID NO: 135031 - DNA, 254 bp, Homo sapiens; identical to SEQ ID NO: 134762
  misc_feature: GYAE6OF01D48NH.49.11.A11.1.454.CMB.1.raw
  modified_base (252)..(254): a, c, t, g, unknown or other
  misc_feature (252)..(254): n is a, c, g, or t

SEQ ID NO: 135032 - DNA, 266 bp, Homo sapiens
  misc_feature: GYAE6OF01BENCR.49.11.A11.1.454.CMB.1.raw
  modified_base (252)..(266): a, c, t, g, unknown or other
  misc_feature (252)..(266): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnn

SEQ ID NO: 135033 - DNA, 253 bp, Homo sapiens; identical to SEQ ID NO: 134809
  misc_feature: GYAE6OF01EYM98.49.11.A11.1.454.CMB.1.raw
  modified_base (252)..(253): a, c, t, g, unknown or other
  misc_feature (252)..(253): n is a, c, g, or t

SEQ ID NO: 135034 - DNA, 737 bp, Homo sapiens
  misc_feature: GYAE6OF01B79C2.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggattaccgtggtagggggaaacacagttaggaagtaagactgtgcacgtggtaccagcagaagccaggccaggcccctgtgctggtcgtctagtggtgatgggccgacccggccctcgagggactcccgtgacgcgtattctcgtggcctacccaacgtccggtacggggaaaccccggtccctaaccccgtcggaaccctacgtacccgacgggaccccggggtaacggaaacgggaccgggggtatacgggaacgggtacccgtaacgttaacgtttaccgtggtaccgtaaggggttggtaggggtaagttaagggttggggttaggttgggttagttccggttcggtttaccggggaggtccggtacgggggacccgtagggggttaccctaacccgggttccgttaacggggtaccaaccggtccccgaaacgggccccctaaaaccccgtcgttcggtaccctaccgttcccgttcccggttacccccctaccccttcccgtacccttaccctccgtcccggtacccttccgg

SEQ ID NO: 135035 - DNA, 557 bp, Homo sapiens
  misc_feature: GYAE6OF01B7S6R.49.11.A11.1.454.CMB.1.raw
  modified_base (461)..(461): a, c, t, g, unknown or other
  misc_feature (461)..(461): n is a, c, g, or t
tcagagtcgagagacacgaccggtgctcgatttagctacgactgcagggggggcctaaggaagcagcactggtggtgcctcagccatgggcctggaccgttctcctcctcggcctcctctctcactgcacagactctgtgacctcctatgtgctgactcgagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcgagggactccctgacgcgattctctggctccaactcgtcgggaacccggcacccctgaccatcaggccgggtacgaaggaccggggatcggacggcccgaactattacgtgtcgagggttgtgggataggtggtagtggtgtcgtcgttcgggngcgtgggaccagggtccacgtccgtaggtcacgcccaaggcccaaccccgactcgtacacctcgtcgttccccgccctcctcctctctccgactcg

SEQ ID NO: 135036 - DNA, 253 bp, Homo sapiens
  misc_feature: GYAE6OF01BREPE.49.11.A11.1.454.CMB.1.raw
  modified_base (243)..(243): a, c, t, g, unknown or other
  misc_feature (243)..(243): n is a, c, g, or t
  modified_base (248)..(253): a, c, t, g, unknown or other
  misc_feature (248)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctcgttcccacctcctctctctcgactctgagcggctggcaggcncatgnnnnnn

SEQ ID NO: 135037 - DNA, 257 bp, Homo sapiens; identical to SEQ ID NO: 134898
  misc_feature: GYAE6OF01ALTSF.49.11.A11.1.454.CMB.1.raw
  modified_base (252)..(257): a, c, t, g, unknown or other
  misc_feature (252)..(257): n is a, c, g, or t

SEQ ID NO: 135038 - DNA, 254 bp, Homo sapiens; identical to SEQ ID NO: 134762
  misc_feature: GYAE6OF01D7CP6.49.11.A11.1.454.CMB.1.raw
  modified_base (252)..(254): a, c, t, g, unknown or other
  misc_feature (252)..(254): n is a, c, g, or t

SEQ ID NO: 135039 - DNA, 265 bp, Homo sapiens
  misc_feature: GYAE6OF01DB4FQ.49.11.A11.1.454.CMB.1.raw
  modified_base (250)..(265): a, c, t, g, unknown or other
  misc_feature (250)..(265): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccacctcctctctctcgactctgagcgggctggcaaggcgcatagnnnnnnnnnnnnnnnn

SEQ ID NO: 135040 - DNA, 256 bp, Homo sapiens
  misc_feature: GYAE6OF01DHQ7U.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcggctggcaaggcgcatagnnnnnn

SEQ ID NO: 135041 - DNA, 254 bp, Homo sapiens; identical to SEQ ID NO: 134802
  misc_feature: GYAE6OF01BS09O.49.11.A11.1.454.CMB.1.raw
  modified_base (252)..(254): a, c, t, g, unknown or other
  misc_feature (252)..(254): n is a, c, g, or t

SEQ ID NO: 135042 - DNA, 275 bp, Homo sapiens
  misc_feature: GYAE6OF01A194R.49.11.A11.1.454.CMB.1.raw
  modified_base (249)..(275): a, c, t, g, unknown or other
  misc_feature (249)..(275): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctcctcgactctgagcggctggcaaggcgcatagnnnnnnnnnnnnnnnnnnnnnnnnnnn

SEQ ID NO: 135043 - DNA, 640 bp, Homo sapiens
  misc_feature: GYAE6OF01C5V8P.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtcggcccctggacaggacggccaggacttaccgtggtagggggaaacacagttagggaaagtaagactgtgacacgtggtaccagcaaggaagccaggccaggccctgtgctggtcgtctagtggtgagtcggccgacccggccctcgagggactcccgtgacgcgtattctcgtggcctacccaacgtccgtacggggaaccccgcccacccgtacgaacccagtccgacgggcccggggtacggaaacgggacgggggatacgggacggaccgtaacgttattacgtgtacgtagggtggtagggagtaggtggtaggttggtggtcgtcgttcggagtcggtcgggaccgagggtccaccgttcgtacggcgacgacccgagacccctaaccgcgtcgtacctaccgtccgttcccgttccccgtaccccttccgtacctccgttcctccgtccgttcgg

SEQ ID NO: 135044 - DNA, 567 bp, Homo sapiens
  misc_feature: GYAE6OF01C9COE.49.11.A11.1.454.CMB.1.raw
  modified_base (462)..(462): a, c, t, g, unknown or other
  misc_feature (462)..(462): n is a, c, g, or t
  modified_base (517)..(517): a, c, t, g, unknown or other
  misc_feature (517)..(517): n is a, c, g, or t
  modified_base (559)..(559): a, c, t, g, unknown or other
  misc_feature (559)..(559): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctgagggatcccgtgagcgattctctggctccaactcgtaggggaaccccgccaccctgaccatccgaggcccgggtacgaaggacggggatggaacggcccgaacttattacgtggtacagggtgtgggataggtgggtagtggtgtcgtcttcgggngtcgtgggaccgagggtcaccggtctaggtcacgacccgaacggacccaaccccncgtcgtaccaccttcgtcgttccccgcccttcctcctctccncgtcctcg

SEQ ID NO: 135045 - DNA, 254 bp, Homo sapiens; identical to SEQ ID NO: 134762
  misc_feature: GYAE6OF01EQZB2.49.11.A11.1.454.CMB.1.raw
  modified_base (252)..(254): a, c, t, g, unknown or other
  misc_feature (252)..(254): n is a, c, g, or t

SEQ ID NO: 135046 - DNA, 254 bp, Homo sapiens; identical to SEQ ID NO: 134762
  misc_feature: GYAE6OF01EA3VE.49.11.A11.1.454.CMB.1.raw
  modified_base (252)..(254): a, c, t, g, unknown or other
  misc_feature (252)..(254): n is a, c, g, or t

SEQ ID NO: 135047 - DNA, 272 bp, Homo sapiens
  misc_feature: GYAE6OF01A4WG7.49.11.A11.1.454.CMB.1.raw
  modified_base (251)..(272): a, c, t, g, unknown or other
  misc_feature (251)..(272): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaaggcgcatagnnnnnnnnnnnnnnnnnnnnnn

SEQ ID NO: 135048 - DNA, 261 bp, Homo sapiens
  misc_feature: GYAE6OF01BOW0K.49.11.A11.1.454.CMB.1.raw
  modified_base (251)..(261): a, c, t, g, unknown or other
  misc_feature (251)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcactctgagcgggctggcaaggcgcatagnnnnnnnnnnn

SEQ ID NO: 135049 - DNA, 589 bp, Homo sapiens
  misc_feature: GYAE6OF01A4AAH.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcgagggactccctgagcgattctctggcctccaactcgtacgggaaccccgccacccgtgaccatccgacggccgggtacgaaaggaccggggatcggaggcccgaagtacttacgtgtcgaggtgtgggataggtggtagtggtgtcgtcgttcgggagtcgtgggaccgtaggggtccaccggtcctagggtccacggcccaagggcccaaacccccgtacgtcggtaccaccgtccgttccggttcccccgccccttcctccttacctcctccgaccgttcg

SEQ ID NO: 135050 - DNA, 254 bp, Homo sapiens; identical to SEQ ID NO: 134762
  misc_feature: GYAE6OF01C1MEH.49.11.A11.1.454.CMB.1.raw
  modified_base (252)..(254): a, c, t, g, unknown or other
  misc_feature (252)..(254): n is a, c, g, or t

SEQ ID NO: 135051 - DNA, 306 bp, Homo sapiens
  misc_feature: GYAE6OF01B6M01.49.11.A11.1.454.CMB.1.raw
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (253)..(257): a, c, t, g, unknown or other
  misc_feature (253)..(257): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (270)..(306): a, c, t, g, unknown or other
  misc_feature (270)..(306): n is a, c, g, or t
tcagagtcgagagacacgaccggtgctcgatttagctacgactgcagggacccggccaccctgaccatctagccgggtcgaaggacgggatgaggcccgagtattactgtcaggtagtgggactagtggtagtggtgtcgtcttcggagctgggaccagggtcaccgtcctaggtcagcccaaggctaaccccatgtcactctgttcccgcctctctctctcggactcgngagcggctggcaaggcncatagnnnnncngccnaccngcnnnnnnnnnnnnnnnnnnnnnnnnnnnnnnnnnnnnn

SEQ ID NO: 135052 - DNA, 256 bp, Homo sapiens
  misc_feature: GYAE6OF01C2EUJ.49.11.A11.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccgagggtcaccgtcctaggtcagcccaacggccaaccccacctgtcactctgttcccaccctcctctctctcgactctgagcggctgcaagcgcatagnnnnn

SEQ ID NO: 135053 - DNA, 290 bp, Homo sapiens
  misc_feature: GYAE6OF01CAMVJ.49.11.A11.1.454.CMB.1.raw
  modified_base (192)..(192): a, c, t, g, unknown or other
  misc_feature (192)..(192): n is a, c, g, or t
  modified_base (248)..(248): a, c, t, g, unknown or other
  misc_feature (248)..(248): n is a, c, g, or t
  modified_base (253)..(290): a, c, t, g, unknown or other
  misc_feature (253)..(290): n is a, c, g, or t
tcagagtcgagagacacgaccggtgctcgatttagctacgactgcagggaacccggccaccctgaccatcagcccgggtcgaagacggggatgtaggccgacttattactggtcaggtgtgggatagtggtagtggtgtcgtcttcggagctgggaccaggtcaccgtctaggtcagcccaagcctaacccntgtcactctgttcccgcctctctctctcgactcgtgacgcgggctggccaagggcnatagnnnnnnnnnnnnnnnnnnnnnnnnnnnnnnnnnnnnnn

SEQ ID NO: 135054 - DNA, 256 bp, Homo sapiens; identical to SEQ ID NO: 134845
  misc_feature: GYAE6OF01B5FAZ.49.11.A11.1.454.CMB.1.raw
  modified_base (252)..(256): a, c, t, g, unknown or other
  misc_feature (252)..(256): n is a, c, g, or t

SEQ ID NO: 135055 - DNA, 257 bp, Homo sapiens; identical to SEQ ID NO: 134882
  misc_feature: GYAE6OF01ER6DV.49.11.A11.1.454.CMB.1.raw
  modified_base (252)..(257): a, c, t, g, unknown or other
  misc_feature (252)..(257): n is a, c, g, or t

SEQ ID NO: 135056 - DNA, 260 bp, Homo sapiens
  misc_feature: GYAE6OF01AP5TN.49.11.A11.1.454.CMB.1.raw
  modified_base (252)..(260): a, c, t, g, unknown or other
  misc_feature (252)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnn

SEQ ID NO: 135057 - DNA, 263 bp, Homo sapiens
  misc_feature: GYAE6OF01A9BHZ.49.11.A11.1.454.CMB.1.raw
  modified_base (251)..(263): a, c, t, g, unknown or other
  misc_feature (251)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccatgtcactctcgttcccgccctcctctctctcgactctgagcgggctggcaaggcgcatagnnnnnnnnnnnnn

SEQ ID NO: 135058 - DNA, 254 bp, Homo sapiens
  misc_feature: GYAE6OF01D4KS4.49.11.A11.1.454.CMB.1.raw
  modified_base (251)..(254): a, c, t, g, unknown or other
  misc_feature (251)..(254): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcgactctgagcgggctggcaaggcgcatagnnnn

SEQ ID NO: 135059 - DNA, 254 bp, Homo sapiens; identical to SEQ ID NO: 134762
  misc_feature: GYAE6OF01AS1UN.49.11.A11.1.454.CMB.1.raw
  modified_base (252)..(254): a, c, t, g, unknown or other
  misc_feature (252)..(254): n is a, c, g, or t

SEQ ID NO: 135060 - DNA, 255 bp, Homo sapiens; identical to SEQ ID NO: 134817
  misc_feature: GYAE6OF01AVESF.49.11.A11.1.454.CMB.1.raw
  modified_base (252)..(255): a, c, t, g, unknown or other
  misc_feature (252)..(255): n is a, c, g, or t

SEQ ID NO: 135061 - DNA, 254 bp, Homo sapiens; identical to SEQ ID NO: 134762
  misc_feature: GYAE6OF01EQZVC.49.11.A11.1.454.CMB.1.raw
  modified_base (252)..(254): a, c, t, g, unknown or other
  misc_feature (252)..(254): n is a, c, g, or t

SEQ ID NO: 135062 - DNA, 256 bp, Homo sapiens
  misc_feature: GYAE6OF01DJLER.49.11.A11.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaaccccactgtcactctgttcccgcctcctctctctcgactctgagcgggctggcaaggcgcatagnnnnn

SEQ ID NO: 135063 - DNA, 572 bp, Homo sapiens
  misc_feature: GYAE6OF01BF8E6.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcagggactccctgagcgattctctggctccaactcgtcgggaacccgccaccctgaccatccaggccgggtacgaaggacggggatggacggccgactattactgtcaggtgtgggatagtggtagtggtgtcgtcttgggagcgtgggaccgaggggtccaccggtccgtaggtccacggaccccgaacggccccaaaccccgtacgtcgtccaaccgttccgttccgttcccccaccccttcccttcctccctcctccgacttccg

SEQ ID NO: 135064 - DNA, 253 bp, Homo sapiens
  misc_feature: GYAE6OF01D7J8G.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctcgttcccaccctccctctctcgactctgagcggctggcaaggcgcatagnnn

SEQ ID NO: 135065 - DNA, 254 bp, Homo sapiens; identical to SEQ ID NO: 134747
  misc_feature: GYAE6OF01CIRR0.49.11.A11.1.454.CMB.1.raw
  modified_base (251)..(254): a, c, t, g, unknown or other
  misc_feature (251)..(254): n is a, c, g, or t

SEQ ID NO: 135066 - DNA, 254 bp, Homo sapiens
  misc_feature: GYAE6OF01C5Y6P.49.11.A11.1.454.CMB.1.raw
  modified_base (250)..(254): a, c, t, g, unknown or other
  misc_feature (250)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccactgtcactctgttcccgcctcctctctctcgactctgagcgggctggcaaggcgcatagnnnnn

SEQ ID NO: 135067 - DNA, 254 bp, Homo sapiens; identical to SEQ ID NO: 134762
  misc_feature: GYAE6OF01ASI8Y.49.11.A11.1.454.CMB.1.raw
  modified_base (252)..(254): a, c, t, g, unknown or other
  misc_feature (252)..(254): n is a, c, g, or t

SEQ ID NO: 135068 - DNA, 255 bp, Homo sapiens; identical to SEQ ID NO: 134817
  misc_feature: GYAE6OF01D0OQV.49.11.A11.1.454.CMB.1.raw
  modified_base (252)..(255): a, c, t, g, unknown or other
  misc_feature (252)..(255): n is a, c, g, or t

SEQ ID NO: 135069 - DNA, 286 bp, Homo sapiens
  misc_feature: GYAE6OF01DE9ZQ.49.11.A11.1.454.CMB.1.raw
  modified_base (256)..(286): a, c, t, g, unknown or other
  misc_feature (256)..(286): n is a, c, g, or t
tcagagtcgagagacacgaccggtgctcgatttagctacgactgcgagggaacccggccaccctgaccatcagccgggtcgaaggacggggatgaggccgactattactgtcaggtgtgggactagtggtagtggtgtcgtattcggagctgggaccagggtcaccgtctaggtcagcccaaggccaaccccactgtcactctcgttcccacctcctctctctcgactctgagcgggctggcaaggcgacaatagnnnnnnnnnnnnnnnnnnnnnnnnnnnnnnn

SEQ ID NO: 135070 - DNA, 253 bp, Homo sapiens; identical to SEQ ID NO: 134809
  misc_feature: GYAE6OF01BW6UD.49.11.A11.1.454.CMB.1.raw
  modified_base (252)..(253): a, c, t, g, unknown or other
  misc_feature (252)..(253): n is a, c, g, or t

SEQ ID NO: 135071 - DNA, 201 bp, Homo sapiens
  misc_feature: GYAE6OF01CC4RR.49.11.A11.1.454.CMB.1.raw
  modified_base (157)..(157): a, c, t, g, unknown or other
  misc_feature (157)..(157): n is a, c, g, or t
  modified_base (163)..(201): a, c, t, g, unknown or other
  misc_feature (163)..(201): n is a, c, g, or t
tcagagtcgagagacacgaccggtgctcgatttagctacgactgcaggggagcgttactgactaggccggccttaattaaggtcagcctaaggctgcccccagcgtcactctgttcccacctcctcctctctcgactctgagcgggctggcaaggcncatagnnnnnnnnnnnnnnnnnnnnnnnnnnnnnnnnnnnnnnn

SEQ ID NO: 135072 - DNA, 263 bp, Homo sapiens
  misc_feature: GYAE6OF01AYPL8.49.11.A11.1.454.CMB.1.raw
  modified_base (251)..(263): a, c, t, g, unknown or other
  misc_feature (251)..(263): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnnnnn

SEQ ID NO: 135073 - DNA, 271 bp, Homo sapiens
  misc_feature: GYAE6OF01DNKXE.49.11.A11.1.454.CMB.1.raw
  modified_base (254)..(271): a, c, t, g, unknown or other
  misc_feature (254)..(271): n is a, c, g, or t
tcagagtcgagagacacgaccggtgctcgatttagctacgactgcagggaacccgggccaccctgaccatcagccgggtcgaagacggggatgaggccgactattactgtcaggtgtcgggatagtggtagtggtgtcgtcttcggagctgggaccagggtcaccgtcctaggtcagcccaaggccaaccccactgtcactctgttcccacctcctctctctcgactcctgagcgggctggcaaggcgcatagnnnnnnnnnnnnnnnnnn

SEQ ID NO: 135074 - DNA, 624 bp, Homo sapiens
  misc_feature: GYAE6OF01ERCVP.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacattggaagtaagactgtgcactggtaccagcagaagccaggccaggcccctgtgctggtcgtctatggtgagtggcgaccggcctcgagggactccctgagcgattctctggctccaactctcgggaacccgcaccctgaccatccaggccgggtacgaaggacggggatggacggccgactattactgtcgagggtgtgggataggtggtagtggtgtcgtcgttcgggagtcgtacgggaccgtaggggtccacccggttccgtacgggtccgaacggtccccgaaacgggtccccaaaacccccgtcgtcggttacccaccgtttccgttacccggtttaccccccaacccccgtttccccgttacccttacccttcccgttaccggaccctttcccggg

SEQ ID NO: 135075 - DNA, 541 bp, Homo sapiens
  misc_feature: GYAE6OF01EDMOT.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcgagggactccctgagcgattctctggctccaactcgtcgggaacccgccaccctgaccatcaggccgggtcgaaggacggggatgaggccgactattactgtcaggtgtgggataggtggtagtggtgtcgtcgttcggagcgtgggaccaggggtccaccggttcgtaggtcacgcccaacggcccaaccccgcgtcgtccactctcgttccccaccctcctctcctctcgctcg

SEQ ID NO: 135076 - DNA, 252 bp, Homo sapiens
  misc_feature: GYAE6OF01EV913.49.11.A11.1.454.CMB.1.raw
  modified_base (251)..(252): a, c, t, g, unknown or other
  misc_feature (251)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnn

SEQ ID NO: 135077 - DNA, 571 bp, Homo sapiens
  misc_feature: GYAE6OF01DQ6VW.49.11.A11.1.454.CMB.1.raw
  modified_base (462)..(462): a, c, t, g, unknown or other
  misc_feature (462)..(462): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgtggtagggggaaacacattggaagtaagactgtgcactggtaccagcagagccaggccaggcccctgtgctggtcgtctagtggtgatggcgaccggccctcaggggactcccgtgacgcgattctcgtggctccaactcgtcgggaaccccgcaccctgaccatcgacggccgggtacgaacggacggggatggaggcccgaacttattactgtcgagggtgtgggatggtggtaggtggtgtcgttcgttcggngcgtgggaccgtgggtcaccggtcctaggtcacggtaccccaagggccccaacccgacgtcgtaccgactccgtccgttccccgcccttccctactctctccgctccgg

SEQ ID NO: 135078 - DNA, 568 bp, Homo sapiens
  misc_feature: GYAE6OF01BR6CV.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcacgtggtaccagcagaagccaggccaggcccctgtgctggtcgtctatggtgagtggcgaccggccctcgagggactcccgtgacgcgtattctcgtggcctccaactcgtacgggaacccgccaccctgaccatcgacggccgggtacgaaggacggggatggacggccgactattacgtgtcgaggtgtgggataggtggtagtggtgtcgtcgtcggagtcgtgggaccagggtccaccgttcgtaggtcacggccccgaaggccccaaccccgcgttcgtccaccttccgtccgttcccccgccccttcctcctcttcctcgctcg

SEQ ID NO: 135079 - DNA, 272 bp, Homo sapiens
  misc_feature: GYAE6OF01AY8P3.49.11.A11.1.454.CMB.1.raw
  modified_base (252)..(272): a, c, t, g, unknown or other
  misc_feature (252)..(272): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnnnnnnnnnnnnn

SEQ ID NO: 135080 - DNA, 283 bp, Homo sapiens
  misc_feature: GYAE6OF01EFQS8.49.11.A11.1.454.CMB.1.raw
  modified_base (254)..(283): a, c, t, g, unknown or other
  misc_feature (254)..(283): n is a, c, g, or t
tcagagtcgagagacacgaccggtgctcgatttagctacgactgcagggaacccgggccaccctgaccatcagccgggtcgaaggacggggatgaggccgactattactgtcaggtgtgggatagtggtagtggtgtcgtattcggagctgggaccagggtcaccgtcctaggtcagcccaaggccaaccccactgtcactctgttcccaccctcctctctctcgactctgagcgggctggcaaggcgcatagnnnnnnnnnnnnnnnnnnnnnnnnnnnnnn

SEQ ID NO: 135081 - DNA, 252 bp, Homo sapiens; identical to SEQ ID NO: 134892
  misc_feature: GYAE6OF01CF7OR.49.11.A11.1.454.CMB.1.raw
  modified_base (250)..(252): a, c, t, g, unknown or other
  misc_feature (250)..(252): n is a, c, g, or t

SEQ ID NO: 135082 - DNA, 282 bp, Homo sapiens
  misc_feature: GYAE6OF01DMLZC.49.11.A11.1.454.CMB.1.raw
  modified_base (249)..(282): a, c, t, g, unknown or other
  misc_feature (249)..(282): n is a, c, g, or t
tcagagtcgagagacacgaccggtgctcgatttagctacgactgcaggaacccggccaccctggaccatcagccgggtcgaagacggggatgaggccgactattaactagtcaggtgtgggatagtggtagtggtgtcgtcttcggagctgggaccagggtcaccgtcctaggtcagcccaaggccaaccccactgtcactctgttcctcctctctctcgactctgagcgggctggcaaggcgcatagnnnnnnnnnnnnnnnnnnnnnnnnnnnnnnnnnn

SEQ ID NO: 135083 - DNA, 255 bp, Homo sapiens; identical to SEQ ID NO: 134799
  misc_feature: GYAE6OF01EP0SE.49.11.A11.1.454.CMB.1.raw
  modified_base (252)..(255): a, c, t, g, unknown or other
  misc_feature (252)..(255): n is a, c, g, or t

SEQ ID NO: 135084 - DNA, 164 bp, Homo sapiens
  misc_feature: GYAE6OF01CU8XI.49.11.A11.1.454.CMB.1.raw
  modified_base (160)..(164): a, c, t, g, unknown or other
  misc_feature (160)..(164): n is a, c, g, or t
tcagagtcgagagacacgaccggtgctcgatttagctacgactgcagggagcttactgactaggccggccttaattaaggtcagcctaaggctgccccagcgtcactctgttcccaccctcctctctctcgactctgagcgggctggcaaggcgcatagnnnnn

SEQ ID NO: 135085 - DNA, 176 bp, Homo sapiens
  misc_feature: GYAE6OF01ACDIQ.49.11.A11.1.454.CMB.1.raw
  modified_base (157)..(157): a, c, t, g, unknown or other
  misc_feature (157)..(157): n is a, c, g, or t
  modified_base (163)..(176): a, c, t, g, unknown or other
  misc_feature (163)..(176): n is a, c, g, or t
tcagagtcgagagacacgaccggtgctcgatttagctacgactgcgaggggagcttactgactaggccggccttaattaaggtcagcctaaggctgcccccagcgtcactctgttcccaccctctctctctcgactctgagcgggctggcaaggtcncatagnnnnnnnnnnnnnn

SEQ ID NO: 135086 - DNA, 255 bp, Homo sapiens; identical to SEQ ID NO: 134817
  misc_feature: GYAE6OF01C236P.49.11.A11.1.454.CMB.1.raw
  modified_base (252)..(255): a, c, t, g, unknown or other
  misc_feature (252)..(255): n is a, c, g, or t

SEQ ID NO: 135087 - DNA, 555 bp, Homo sapiens
  misc_feature: GYAE6OF01ELD3V.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacacattggaagtaagactgtgcactggtaccagcagaagccaggccaggcccctgtgctggtcgtctatggtgatggcgaccggcctcgagggatccctgagcgattctctggctccaactcgtcgggaacccggccaccctgaccatcaggccgggtcgaaggacggggatggacggccgactattacgtgtcgaggtgtgggataggtggtagtggtgtcgtcttcgggagcgtgggacctaggggtccaccggttccgtaggtccacggccccgaagggccccaaaccccgcgtcgtcacttcctcgttccccacccttcctctcctctcgctcg

SEQ ID NO: 135088 - DNA, 606 bp, Homo sapiens
  misc_feature: GYAE6OF01CWWY4.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaaacgacattggaagtaagactgtgcactggtaccagcagaagccaggccaggcccctgtgctggtcgtctatggtgatggccgaccggccctcgagggactcccgtgacgcgattctctggctccaactcgtacgggaacccgccaccctgaccatccgacggccgggtacgaacggacggggatcggacggacccgtacttaacgttacgtggtacgagggttgtagggattaggtgggtacgtgggttgtcggttcgttcgggagtcggtcgggaccgtaggggtccacccggttcctaagggtccacggccccgaaaggccccaaaccccgcgtcgtaccaccgtccttccgttccccaccccttctccttcctcctccgtactccg

SEQ ID NO: 135089 - DNA, 254 bp, Homo sapiens; identical to SEQ ID NO: 134762
  misc_feature: GYAE6OF01C5E22.49.11.A11.1.454.CMB.1.raw
  modified_base (252)..(254): a, c, t, g, unknown or other
  misc_feature (252)..(254): n is a, c, g, or t

SEQ ID NO: 135090 - DNA, 262 bp, Homo sapiens
  misc_feature: GYAE6OF01B7B9T.49.11.A11.1.454.CMB.1.raw
  modified_base (252)..(262): a, c, t, g, unknown or other
  misc_feature (252)..(262): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnnnnnn

SEQ ID NO: 135091 - DNA, 255 bp, Homo sapiens; identical to SEQ ID NO: 134799
  misc_feature: GYAE6OF01BZC22.49.11.A11.1.454.CMB.1.raw
  modified_base (252)..(255): a, c, t, g, unknown or other
  misc_feature (252)..(255): n is a, c, g, or t

SEQ ID NO: 135092 - DNA, 256 bp, Homo sapiens
  misc_feature: GYAE6OF01EFCYG.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnnn

SEQ ID NO: 135093 - DNA, 259 bp, Homo sapiens; identical to SEQ ID NO: 134814
  misc_feature: GYAE6OF01AL5VO.49.11.A11.1.454.CMB.1.raw
  modified_base (245)..(245): a, c, t, g, unknown or other
  misc_feature (245)..(245): n is a, c, g, or t
  modified_base (251)..(259): a, c, t, g, unknown or other
  misc_feature (251)..(259): n is a, c, g, or t

SEQ ID NO: 135094 - DNA, 824 bp, Homo sapiens
  misc_feature: GYAE6OF01D84OX.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggccctggacagacggccaggtattaccgtggtagggggaaaacactagttaggaagtaagactgtgcacgtggtaccagcagaagccaggccaggcccctgtcgctggtcgtctagtggtgagtgggccggaccggccctcggagggtactcccgtaggacgtcgtattccgtcgtcgggtcctacccgaaacgttccggtaccggggaacccccggtcccctaaccccgttcggaaccctaacgttacccggaaccggggtcccgggggttaacggaaacggggaccggggggtaacttacggggaaccgggtacccggtaacgttaacgtttaccgtggttaccggaggggtttgggtacggggtaagttagggttaggggttagggttgggtttcggttacggtttcggttaccggggacggtccggttacgggggacccggtagggggttcccctaacccgggttacccggttaagggtacccgaaccgggtacccccggaaaccgggtaccccccaaaaaccccccggttcggttccggttaacccgtaaccccgtttccggtacccccgggttttcccccccgaccccctttccccgttccctttacccgttcccgttccccggtaccgtttcccgggg

SEQ ID NO: 135095 - DNA, 254 bp, Homo sapiens; identical to SEQ ID NO: 134785
  misc_feature: GYAE6OF01DSEX6.49.11.A11.1.454.CMB.1.raw
  modified_base (251)..(254): a, c, t, g, unknown or other
  misc_feature (251)..(254): n is a, c, g, or t

SEQ ID NO: 135096 - DNA, 544 bp, Homo sapiens
  misc_feature: GYAE6OF01BDRZT.49.11.A11.1.454.CMB.1.raw
  modified_base (433)..(433): a, c, t, g, unknown or other
  misc_feature (433)..(433): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactggtgcactggtaccagcagaagccaggccaggcccctgtgctggtcgtctatggtgatggcgaccggccctcagggatccctgagcgattctctggctccaactctgggaacccgccaccctgaccatcagccggtacgaagacgggatagaggccgactattactgtcgaggtgtggagtagtggtagtggtgtcgtnttcggagcgtgggaccgaggggtcaccgtccgtaggtcgacgcccgtaacggccaacccccgactcgtaccactcgtcgttccccgcccctcctcttcctccttcgactcg

SEQ ID NO: 135097 - DNA, 256 bp, Homo sapiens; identical to SEQ ID NO: 134784
  misc_feature: GYAE6OF01BDUYL.49.11.A11.1.454.CMB.1.raw
  modified_base (252)..(256): a, c, t, g, unknown or other
  misc_feature (252)..(256): n is a, c, g, or t

SEQ ID NO: 135098 - DNA, 256 bp, Homo sapiens; identical to SEQ ID NO: 135092
  misc_feature: GYAE6OF01ACMME.49.11.A11.1.454.CMB.1.raw
  modified_base (251)..(256): a, c, t, g, unknown or other
  misc_feature (251)..(256): n is a, c, g, or t

SEQ ID NO: 135099 - DNA, 255 bp, Homo sapiens; identical to SEQ ID NO: 134817
  misc_feature: GYAE6OF01ES7IQ.49.11.A11.1.454.CMB.1.raw
  modified_base (252)..(255): a, c, t, g, unknown or other
  misc_feature (252)..(255): n is a, c, g, or t

SEQ ID NO: 135100 - DNA, 257 bp, Homo sapiens; identical to SEQ ID NO: 134882
  misc_feature: GYAE6OF01DEGJ0.49.11.A11.1.454.CMB.1.raw
  modified_base (252)..(257): a, c, t, g, unknown or other
  misc_feature (252)..(257): n is a, c, g, or t

SEQ ID NO: 135101 - DNA, 272 bp, Homo sapiens
  misc_feature: GYAE6OF01C2JN1.49.11.A11.1.454.CMB.1.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
  modified_base (256)..(272): a, c, t, g, unknown or other
  misc_feature (256)..(272): n is a, c, g, or t
tcagagtcgagagacacgaccggtgctcgatttagctacgactgcagggaacccgggccaccctgaccatcagccgggtcgaaggacggggatgaggccgatattactgtcaggtgtggattagtggtagtggtgtcgtcttcggagcgtgggaccagggtcaccgtctaggcagcccaaggccaaccccntgtcactctcgttcccacctctctctctcgacttcngacgcgggctggcaaggcgatagtagnannnnnnnnnnnnnnnnn

SEQ ID NO: 135102 - DNA, 806 bp, Homo sapiens
  misc_feature: GYAE6OF01DB43K.49.11.A11.1.454.CMB.1.raw
  modified_base (102)..(102): a, c, t, g, unknown or other
  misc_feature (102)..(102): n is a, c, g, or t
  modified_base (174)..(174): a, c, t, g, unknown or other
  misc_feature (174)..(174): n is a, c, g, or t
  modified_base (215)..(215): a, c, t, g, unknown or other
  misc_feature (215)..(215): n is a, c, g, or t
  modified_base (499)..(499): a, c, t, g, unknown or other
  misc_feature (499)..(499): n is a, c, g, or t
tcagagtcgagagacacgaccggtgctcgatttagctacgactgcagggggggcctaaggaagcagcactggtggtgcctcagccatggcctggaccgttcncctcctcggcctcctctctcactgcacagactctgtgacctcctatcgtgctgactcacgccacccgtggtntcagtcggccctaggacaggacggccaagggtacttaccgngggtagggggaaacacgtagttagggaagtaagctggtcgacctacgtggtaccagacaacggacgtacccgagggaccaccggtcccctggtcgcgttggtctctaaggtggtacgagttcggaccgtaccggccctaggagggtcctccggtgacgacggtattccgtcgtacggtcctaccgtaaacgttcggtaacccggggaaccccgtccctaaccccgtcggaaccctacgtacccggacggggtacccggggttaacggaaacgggtaccggggtntaacgggacgtgtacgtaaccgttagttacgtcggtaacggtaaggttgggtaggtaggttagggttcggtagttcgggtacgttcgtacgggttcgggagtacgggttaccggaccgggttacgggtacccttaacccgggttaccgtacggggtacctaaaccccgggtaccccgggaaacccggtaaccccccgaaacccgttacggttaccggttaaccccgttccgttaccccgttcccggttaaccccccccctccccgttcgtttaccccggttccctttacccgcccgggtttaacccg

SEQ ID NO: 135103 - DNA, 257 bp, Homo sapiens
  misc_feature: GYAE6OF01ENHSY.49.11.A11.1.454.CMB.1.raw
  modified_base (251)..(257): a, c, t, g, unknown or other
  misc_feature (251)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaaggcgcatagnnnnnnn

SEQ ID NO: 135104 - DNA, 262 bp, Homo sapiens
  misc_feature: GYAE6OF01BEVAS.49.11.A11.1.454.CMB.1.raw
  modified_base (92)..(92): a, c, t, g, unknown or other
  misc_feature (92)..(92): n is a, c, g, or t
  modified_base (258)..(262): a, c, t, g, unknown or other
  misc_feature (258)..(262): n is a, c, g, or t
tcagagtcgagagacacgaccggtgctcgatttagctacgactgcagggaacccggccacctgaccatcagccgggtcggaagacgggagtnaggccgactattactgtcaggtgtgggatagtggtagtggtggtcgtcgttcggtaggctgggaccgacgggtcaccgtcctaggtcagccaaggcaacccactgtcactctgttcccgccctccttctctcgacgtctgagcgggcgtggcaaggacgcactagnnnnn

SEQ ID NO: 135105 - DNA, 260 bp, Homo sapiens
  misc_feature: GYAE6OF01CRXMG.49.11.A11.1.454.CMB.1.raw
  modified_base (249)..(260): a, c, t, g, unknown or other
  misc_feature (249)..(260): n is a, c, g, or t
tcagagtcgagagacacgaccggtgctcgatttagctacgactgcgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccatgtcactctgttccccgcctctctcgtctcgactctgagcgggctggcaaggcgcatagnnnnnnnnnnnn

SEQ ID NO: 135106 - DNA, 526 bp, Homo sapiens
  misc_feature: GYAE6OF01A9QYO.49.11.A11.1.454.CMB.1.raw
  modified_base (455)..(455): a, c, t, g, unknown or other
  misc_feature (455)..(455): n is a, c, g, or t
  modified_base (486)..(486): a, c, t, g, unknown or other
  misc_feature (486)..(486): n is a, c, g, or t
  modified_base (504)..(504): a, c, t, g, unknown or other
  misc_feature (504)..(504): n is a, c, g, or t
  modified_base (517)..(517): a, c, t, g, unknown or other
  misc_feature (517)..(517): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactcgtgggaacccgccaccctgaccatcagccggtcgaagacggggatgaggccgactatactgtcaggtgtgggatagtggtagtggtgtcgtcttcgggagcgtgggaccagggtcnccgtctaggtcacgcccaaggcccaaccccntcgtcactctcgttcccnccccctctcctcncgctctcgg

SEQ ID NO: 135107 - DNA, 606 bp, Homo sapiens
  misc_feature: GYAE6OF01BIPGB.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtggcccctggacagacggccaggattacctggtgggggaaacacagttggaagtaagactgtgcactggtaccagcagaagccaggccaggcccctgtgctggtcgtctatggtgagtggccgaccggccctcgagggactcccgtgagcgacttctctggcctacccaacgtccgtacggggaaccccggccacccgtgaccatccgacggcccgggtacgaaggacggggatggacggccgtactattacgtggtacgagggtggtagggattaggttggtagtggtcgtcgttcgttcgggagtcgtaggggaccgtagggttccacccgttcgtaggtccaacggccccgaacggaccccaaccccgtacgtcgtaccaccgttccttccgttaccccaccccttcctctcctccgtccgcttcg

SEQ ID NO: 135108 - DNA, 252 bp, Homo sapiens; identical to SEQ ID NO: 134773
  misc_feature: GYAE6OF01B549F.49.11.A11.1.454.CMB.1.raw
  modified_base (252)..(252): a, c, t, g, unknown or other
  misc_feature (252)..(252): n is a, c, g, or t

SEQ ID NO: 135109 - DNA, 253 bp, Homo sapiens; identical to SEQ ID NO: 134809
  misc_feature: GYAE6OF01BV6IP.49.11.A11.1.454.CMB.1.raw
  modified_base (252)..(253): a, c, t, g, unknown or other
  misc_feature (252)..(253): n is a, c, g, or t

SEQ ID NO: 135110 - DNA, 715 bp, Homo sapiens
  misc_feature: GYAE6OF01AJ6K9.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgtgtgggggaaacgacattgggaagtaagactgtgcacgtggtaccagcagaacgccaggccacggcccctgtcgcgtggtcgtctagtggtgatggccgaccggccctcgagggtactcccgtgacgcgtattctctcggcctaccaactcgtacgggaaccccgccacccgtgaccatccgacggccgggtacgaaacgggacggggtatcgggacgggtcccgtaacgttacgttacgtcggttacgagggttgggttacggggatttaagggttggggttaaggttggggttcggttaccgggttccgtttccggggtaacggtcgggttacgggggacccggtagggggttacccgaacccgggttccgttacgggtaccgaccgggtaccccgaaacggggtacccccaaaccccgtacgtccggtcccgaaccctttcccgtacccggtttcccccccgtccccttaccccgttccttcccgttcccttccgtaccgttccgg

SEQ ID NO: 135111 - DNA, 255 bp, Homo sapiens; identical to SEQ ID NO: 134817
  misc_feature: GYAE6OF01CS7XC.49.11.A11.1.454.CMB.1.raw
  modified_base (252)..(255): a, c, t, g, unknown or other
  misc_feature (252)..(255): n is a, c, g, or t

SEQ ID NO: 135112 - DNA, 616 bp, Homo sapiens
  misc_feature: GYAE6OF01C6UV3.49.11.A11.1.454.CMB.1.raw
  modified_base (206)..(206): a, c, t, g, unknown or other
  misc_feature (206)..(206): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (333)..(333): a, c, t, g, unknown or other
  misc_feature (333)..(333): n is a, c, g, or t
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgnggtgggggaaacgacagttggaaagtagactgtgcactggtaccagcagaagccaggccaggccctggngctggtctctatggngatcggccgaccggcctcgagggactcccgtgacgcgtattcncgtggctaccaacgtcgtacggggaaccccgcacccgtggaacccagtccgacgggtccgggtacgaaacggacggggtatggaacgaccgacttagtactgtcgagggtgtaggataggtggtagtgtcgtcgtcgttcggaggtcgtgggaccgtacgggtctaccggttccgtacggtacgacgtaccccgaacggaccccgaacccgtaccgtacgtaccaccgttccgttaccgtttcccccacccgttcctaccttccgttcgtacgttcgtacggg

SEQ ID NO: 135113 - DNA, 260 bp, Homo sapiens
  misc_feature: GYAE6OF01CCD0X.49.11.A11.1.454.CMB.1.raw
  modified_base (245)..(245): a, c, t, g, unknown or other
  misc_feature (245)..(245): n is a, c, g, or t
  modified_base (251)..(260): a, c, t, g, unknown or other
  misc_feature (251)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccatgtcactctgttccccaccctcctctctctcgactctgagcgggctggcaaggcncatagnnnnnnnnnn

SEQ ID NO: 135114 - DNA, 255 bp, Homo sapiens
  misc_feature: GYAE6OF01DG9TN.49.11.A11.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcggctggcaaggcgcatagnnnnn

SEQ ID NO: 135115 - DNA, 567 bp, Homo sapiens
  misc_feature: GYAE6OF01DVG3J.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacacagttggaagtaagactgtgcactggtaccagcagaagccaggccaggcccctgtgctggtcgtctatggtgagtggccgaccggccctcgagggtactcccgtagacgcgtattcctcgtggcctccaactcgtacggggaaccccggccaccctcgacccatcgacggccgggtacgaaaggaccgggggatcggacggcccgtaacgttattaacgtgtcgaagggttggtagggataggtggtagtggtgttcgtgtcggagcgtgggacctagggtcaccgtctaggtcacggcccaaggcccacccagtcgtcactctcgtcccacctctctctctcgctcg

SEQ ID NO: 135116 - DNA, 252 bp, Homo sapiens
  misc_feature: GYAE6OF01DUQKI.49.11.A11.1.454.CMB.1.raw
  modified_base (249)..(252): a, c, t, g, unknown or other
  misc_feature (249)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaacccactgtcactctgttcccacctcctctctctcgactctgagcgggctggcaaggcgcatagnnnn

SEQ ID NO: 135117 - DNA, 813 bp, Homo sapiens
  misc_feature: GYAE6OF01EHBH4.49.11.A11.1.454.CMB.1.raw
tcagagtcgagagacacgaccggtgctcgatttagctacgactgcagggggggcctaaggaagcagcactggtggtgcctcagccatggcctggacctttctcctcctcggcctcctctctcactgcacagactctgtgacctcctatgtgctgactcagccaccctcggtgtcagtcggcccctggacagacggccaggattaccgtggtaggggaaaacacagttgggaaagttaagacttggtagcacgtggtaccagcaagaagcccgaggccacggccccctgtgcgttggtcgtctagtggtgagtcgggccgacccggccctacgacgggacctcccgtgaacgcgtactttcctcgtcggcctaccgaaccgtcgtacggggaaccccgccctaaccccgtacgacccactccgacggtacccggggtacggaaacgggaccggggtaactacgggaccgggtacccggtaacgttacgtttaacgtggtaccgtagggttaggtagggtacgttagggtgggttaacggttcgggtttacggtccggtttccgggtttaccgggacggtcccgggttacggggtaaccccggtagggggtttacccctaccccgggtttacgttaacccggggtacccgtaacccggaacccccggtaaaccgggtaacccccccgtaaacccccgttaccggttaccggttacccgtaacccgttcccgttaccccgggtttaccccccctaaccccccgtttcccttacccgtttaccccttcccgtttaccccggtacccgtttacccggg

SEQ ID NO: 135118 - DNA, 257 bp, Homo sapiens; identical to SEQ ID NO: 134898
  misc_feature: GYAE6OF01EUE92.49.11.A11.1.454.CMB.1.raw
  modified_base (252)..(257): a, c, t, g, unknown or other
  misc_feature (252)..(257): n is a, c, g, or t

SEQ ID NO: 135119 - DNA, 253 bp, Homo sapiens; identical to SEQ ID NO: 134759
  misc_feature: GYAE6OF01A3OAI.49.11.A11.1.454.CMB.1.raw
  modified_base (252)..(253): a, c, t, g, unknown or other
  misc_feature (252)..(253): n is a, c, g, or t

SEQ ID NO: 135120 - DNA, 253 bp, Homo sapiens
  misc_feature: GYAE6OF01BY6HT.49.11.A11.1.454.CMB.1.raw
  modified_base (252)..(253): a, c, t, g, unknown or other
  misc_feature (252)..(253): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnn

SEQ ID NO: 135121 - DNA, 754 bp, Homo sapiens
  misc_feature: GYAE6OF01CAWAK.49.11.A11.1.454.CMB.1.raw
tcagagtcgagagacacgaccggtgctcgatttagctacgactgcgagggggggcctaaggaagcagcactggtggtgcctcagccatggcctggaccgttctcctcctcggcctcctctctcactgcacagactctgtgacctcctatgtgctgactcagccaccctggtgtcagtcggccctggacagacggccaggattaccgtggtagggggaaacactagttaggaagtaagactggtgcacgtggaccagcagaagccaggccaggccctgtgctggtcgtactagtcgggtagagtcgggaccgaccggccctacgaggggtaccttcccgaggacgcgtaattcctcgtcggaccttacccaaacgttccggtacgggggaaaccccgtccacccgtacgaaccgtacgtaccgacggggtcccgggtaacggaaacggggaccggggtatacggggacggtaccgtaacgttaagtttaccgtaggtaccggtaggggttggttaggggtaataggggtttagggtaagggtttcgggtcggtttacggttccgggtttacggggacggttaccggtacgggggacccggttaacggggtccctaacccgggttacggttaaccgggacccgtaaccggaccccggaaacgggaccccctaacccgtcgttacccgacgttaccctcccgtttcccggtacccccctacccttccctacttccctaccgtccgtacttacccggg

SEQ ID NO: 135122 - DNA, 611 bp, Homo sapiens
  misc_feature: GYAE6OF01AGX6I.49.11.A11.1.454.CMB.1.raw
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggattaccgtggtagggggaaacacattggaagtagactgtgcactggtaccagcagaagccaggccaggcccctgtgctggtcgtctatggtgatggcgaccggcctcgagggactcccgtgacgcgtattctcgtcggcctccaacctcgtacggggaaccccggccaccccgtgaccactcgacggtcccggggtcgaacggacggggatggacggccgtactacttactgtcgaggtgtgggatagtggtagtggtgtcgtcttcgggngtcgngggaccagggtccaccgttcgtaggtccacggtaccccgaacgggaccccaaccccgtacgttcggtccctaacttcccttacccggttcccccacccctttcccttccttcccttccctccgtacccttccggg

SEQ ID NO: 135123 - DNA, 280 bp, Homo sapiens
  misc_feature: GYAE6OF01D3GUQ.49.11.A11.1.454.CMB.1.raw
  modified_base (255)..(280): a, c, t, g, unknown or other
  misc_feature (255)..(280): n is a, c, g, or t
tcagagtcgagagacacgaccggtgctcgatttagctacgactgcagggaacccgggcctaccctgaccatcagccgggtcgaagacggggatgaggccgactattactgtcaggtgtgggatagtggtagtggtgtcgtcttcggagctgggaccagggtcaccgtctaggtcagcccaaggccaaccccatgtcactctgttcccaccctctctctcttcgactctgagcgggctggcaaaggccgacatagnnnnnnnnnnnnnnnnnnnnnnnnnn

SEQ ID NO: 135124 - DNA, 254 bp, Homo sapiens; identical to SEQ ID NO: 134802
  misc_feature: GYAE6OF01AZEVV.49.11.A11.1.454.CMB.1.raw
  modified_base (252)..(254): a, c, t, g, unknown or other
  misc_feature (252)..(254): n is a, c, g, or t

SEQ ID NO: 135125 - DNA, 257 bp, Homo sapiens; identical to SEQ ID NO: 134882
  misc_feature: GYAE6OF01D9FVJ.49.11.A11.1.454.CMB.1.raw
  modified_base (252)..(257): a, c, t, g, unknown or other
  misc_feature (252)..(257): n is a, c, g, or t

SEQ ID NO: 135126 - DNA, 768 bp, Homo sapiens
  misc_feature: GYAE6OF01DMFW9.49.11.A11.1.454.CMB.1.raw
tcagagtcgagagacacgaccggtgctcgatttagctacgactgcagggggggcctaaggaagcagcactggttggtgcctcagtaccatggccttggaccgttctcctcctcggcctcctctctcacgtgcacagactctgtgacctcctatgtgctgactcagccaccctcggtgtcagtcggccctggacagacggccagggacttaccgtggtacgggggaaaacgactagttagggaaagttaagacgtggtcgccacgtggtaccaggacgaaggaacgccgaggccacggcccctgtcgcgtggtcgtctagtgggtgagtcggccgaccggccctacgagggtactcccgtagacgcgtacttccgtcgtcggcctccaactcggtacggggaaccccggcctaacccgtcgaccctagtccgaacggtcccggggtaacggaaacgggaccggggtatacgggaacggtcccgtaacgttacgttaaccggtggttaccggtaaggggttggtacggggtaagtttagggttgggttacggttgggtttcggttcgggttccgttcggggacggtccggtacggggacccgtacggggtccctacccggttccgttaacgggtccaaccggaccccgaaacgggacccccaaaccccgtacgttccggtaccctacccgttcccgttccccggtttacccccctacccccgttccccttaccccgttcccgtccccgttcccggtaacccgttcccggg

SEQ ID NO: 135127 - DNA, 296 bp, Homo sapiens
  misc_feature: GYAE6OF01C7GBA.49.11.A11.1.454.CMB.1.raw
  modified_base (258)..(296): a, c, t, g, unknown or other
  misc_feature (258)..(296): n is a, c, g, or t
tcagagtcgagagacacgaccggtgctcgatttagctacgactgcagggaacccgggccaccctgaccatcagccgggtcgaagacggggatgaggccgactattactgtcaggtgtgggatagtggtagtggtgtcgtcttcggagtcgtgggaccaggggtcaccggttcctaggtcagccctaaggccaacccactgtcactctgttcccaccctctctctctcggactctgagcgggctggcaaggcgcatagnnnnnnnnnnnnnnnnnnnnnnnnnnnnnnnnnnnnnnn

SEQ ID NO: 135128 - DNA, 259 bp, Homo sapiens
  misc_feature: GYAE6OF01E24WA.49.11.A11.1.454.CMB.1.raw
  modified_base (210)..(210): a, c, t, g, unknown or other
  misc_feature (210)..(210): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (255)..(259): a, c, t, g, unknown or other
  misc_feature (255)..(259): n is a, c, g, or t
tcagagtcgagagacacgaccggtgctcgatttagctacgactgcgggaacccggccaccctgaccatcagccgggtcgaagacggggatgaggccgactattactgtcaggtgtgggatagtggtagtggtgtcgtcttcggagcgtgggaccagggtcaccgtcctaggtcacgcccaaggcccaaccccatgtcactctcgttcccnccctcctctctctcgactcgtgagcggctggacaaggcncatncnnnnn

SEQ ID NO: 135129 - DNA, 643 bp, Homo sapiens
  misc_feature: GYAE6OF01D69Q0.49.11.A11.1.454.CMB.1.raw
  modified_base (207)..(207): a, c, t, g, unknown or other
  misc_feature (207)..(207): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggccctggacagacggccaggattaccgnggtaggggaaacacagttaggaagtaagactgtgcacgtggtaccagcagaagccaggccaggcccctgtgctggtcgtctatggtgagtggcgaccggccctcgagggactcccgtgacgcgtattcgtctggctaccgaactcgtacggggaaccccgccaacccgtcgaccagtccgacggccgggtacggaacggacggggatcgggaacggcccgtaacttagttacgtggtacgagggttggtacgggtattagggtggtaggtggttggtcgttcgttcgggagtcgtacggggaccgtaggggtccaccggttccgtaggtaccgacggtaccccgaaacgggccccaaaccccgtacgttccgtacctaccttcccttaccgttacccccaccccgttcccttactcccttccgtccgccgttccgg

SEQ ID NO: 135130 - DNA, 702 bp, Homo sapiens
  misc_feature: GYAE6OF01DEZ8I.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggccctggacagacggccaggtattaccgtgggtagggggaaacgactagttaggaaagtaagactgtgcacgtggtaccagcagaagccaggccacggcccctgtgctggtcgtctagtgggtgagtcgggccggacccggccctacggacggggaccttcccgtaggacgcgtacttccgtcgtcggtcctaccgaacgttcggtaccggggaaccccgcccacccgtacgaaccacgtaccgacgggtccgggtacgaacgggacggggtataggacggtacccgtaacttagttaccgttggtacgtaggggttcggtagggtaagttagggttgggttacggttgggttacggttcggtttcggttcgggaggtccggtacggggaaccgtaggggtcccacccggttcgtacggtccgacgtaccccgaacggccccaaaccccgtcgtcgtaccctaccgttcccgttcccgttcccccgccccttaccctccttaccctccgtccgtcgttccggg

SEQ ID NO: 135131 - DNA, 598 bp, Homo sapiens
  misc_feature: GYAE6OF01BS8DB.49.11.A11.1.454.CMB.1.raw
  modified_base (491)..(491): a, c, t, g, unknown or other
  misc_feature (491)..(491): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacacattggaagtaagactgtgcactggtaccagcagaagccaggccaggcccctgtgctggtcgtctatggtgagtggccgaccggccctcgaggggatccccgtgagcgatttcctctcggcctaccaacgtccgtacggggaacccccggccaccctcgaccatccgacggccgggtacgaacgggacggggatcggacggcccgtacgtaactttacgtgtcgagggtggtgggagttaggttgggtaggtggtggttcgttcgttcgggngtcgtacggggaccgaggggtccaccggtccttagggtcacggcccaacggcccaaccccgtgtcgtcactccttcgttccccacccgttcctcctctctccgctcg

SEQ ID NO: 135132 - DNA, 256 bp, Homo sapiens; identical to SEQ ID NO: 134845
  misc_feature: GYAE6OF01B2RBI.49.11.A11.1.454.CMB.1.raw
  modified_base (252)..(256): a, c, t, g, unknown or other
  misc_feature (252)..(256): n is a, c, g, or t

SEQ ID NO: 135133 - DNA, 263 bp, Homo sapiens
  misc_feature: GYAE6OF01AW0JI.49.11.A11.1.454.CMB.1.raw
  modified_base (245)..(245): a, c, t, g, unknown or other
  misc_feature (245)..(245): n is a, c, g, or t
  modified_base (251)..(263): a, c, t, g, unknown or other
  misc_feature (251)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcncatagnnnnnnnnnnnnn

SEQ ID NO: 135134 - DNA, 254 bp, Homo sapiens; identical to SEQ ID NO: 134762
  misc_feature: GYAE6OF01AUAPJ.49.11.A11.1.454.CMB.1.raw
  modified_base (252)..(254): a, c, t, g, unknown or other
  misc_feature (252)..(254): n is a, c, g, or t

SEQ ID NO: 135135 - DNA, 720 bp, Homo sapiens
  misc_feature: GYAE6OF01DM4CX.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtggcccctggacaggacggccaggattaccgtggtagggggaaacgacattgggaaagtaagactgtgcactggtaccagcagaagccaggccacggccctgtgcgtggtcgtctagtggtgagtggccggaccggccctcgagggtactcccgtggacgcgtatttccgtcgtcggccttaccctaacgtccggtaccgggggaaacccccggccctaaccccgtcgaaccctactccgacgggtacccggggtagaaacgggacggggtatacgggacgggacccgtaacttagttacgtgtacgtagggttggtagggagttagggttagggtaggttgggttcggtcggttcggtttacgggaggtccggtcggggaaccgtcggggttaccctacccgggttccgtacggggtccaccggacccccgaaacgggccccctaaacccccgtagttaccgtaccctaccgttccgtttacccggttccccccgtcccccgttcccttcccttacccttccgttccccggtacttcccggg

SEQ ID NO: 135136 - DNA, 283 bp, Homo sapiens
  misc_feature: GYAE6OF01AY4K8.49.11.A11.1.454.CMB.1.raw
  modified_base (251)..(251): a, c, t, g, unknown or other
  misc_feature (251)..(251): n is a, c, g, or t
  modified_base (253)..(283): a, c, t, g, unknown or other
  misc_feature (253)..(283): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctccctctctcgactctgagcgggctggcaaggcgcatagntnnnnnnnnnnnnnnnnnnnnnnnnnnnnnnn

SEQ ID NO: 135137 - DNA, 281 bp, Homo sapiens
  misc_feature: GYAE6OF01CT790.49.11.A11.1.454.CMB.1.raw
  modified_base (190)..(190): a, c, t, g, unknown or other
  misc_feature (190)..(190): n is a, c, g, or t
  modified_base (253)..(253): a, c, t, g, unknown or other
  misc_feature (253)..(253): n is a, c, g, or t
  modified_base (255)..(281): a, c, t, g, unknown or other
  misc_feature (255)..(281): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggcccaacccntgtcactctgttccccacctctctctctcactctgacgcggggctggacaaggcgacaagtgnannnnnnnnnnnnnnnnnnnnnnnnnnn

SEQ ID NO: 135138 - DNA, 252 bp, Homo sapiens
  misc_feature: GYAE6OF01CC0LY.49.11.A11.1.454.CMB.1.raw
  modified_base (249)..(252): a, c, t, g, unknown or other
  misc_feature (249)..(252): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctctctcctctgagcgggctggcaaggcgcatagnnnn

SEQ ID NO: 135139 - DNA, 705 bp, Homo sapiens
  misc_feature: GYAE6OF01DL0GR.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccacccgtcggtgtcagtcggccctggacagacggccaggattaccgtggtagggggaaacactagttaggaagtaagactgtgcacgtggtaccagcagaacgccgaggccacggcccctggtgctggtcgtctagtggtgagtggccggaccggtccctcggagggactcccgtaggacgacgtattccgtcgtcggcctacccgtaacgtccggtaccggggaaccccggtccacccgtacgaaccctacgtccgaacgggcccggggtaaggaaacgggacggggtagtagggaccggaccgtaacttagttacgtgtcgtagggtggtgggtagtaggttcgggttaggtgggttcggttcggttcggttacgggtaggtcggttacggggtaccgtacggggttaccgtacccggttccgttacgggtaccgaccgacccgaaccggaccccaacccgtaccgtacgtacctaccttccgttacccgtttcccctacccccttcccttcccttcccttccctccggggtccttaccgg

SEQ ID NO: 135140 - DNA, 254 bp, Homo sapiens
  misc_feature: GYAE6OF01DZHND.49.11.A11.1.454.CMB.1.raw
  modified_base (206)..(206): a, c, t, g, unknown or other
  misc_feature (206)..(206): n is a, c, g, or t
  modified_base (243)..(243): a, c, t, g, unknown or other
  misc_feature (243)..(243): n is a, c, g, or t
  modified_base (247)..(254): a, c, t, g, unknown or other
  misc_feature (247)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccatgtcactctgttcccnccctctctctctcgactctgagcgggctggcaaggcnatgnnnnnnnn

SEQ ID NO: 135141 - DNA, 262 bp, Homo sapiens
  misc_feature: GYAE6OF01ATROF.49.11.A11.1.454.CMB.1.raw
  modified_base (252)..(262): a, c, t, g, unknown or other
  misc_feature (252)..(262): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnn

SEQ ID NO: 135142 - DNA, 255 bp, Homo sapiens; identical to SEQ ID NO: 134799
  misc_feature: GYAE6OF01EMYNZ.49.11.A11.1.454.CMB.1.raw
  modified_base (252)..(255): a, c, t, g, unknown or other
  misc_feature (252)..(255): n is a, c, g, or t

SEQ ID NO: 135143 - DNA, 269 bp, Homo sapiens
  misc_feature: GYAE6OF01ASOEQ.49.11.A11.1.454.CMB.1.raw
  modified_base (253)..(258): a, c, t, g, unknown or other
  misc_feature (253)..(258): n is a, c, g, or t
  modified_base (260)..(269): a, c, t, g, unknown or other
  misc_feature (260)..(269): n is a, c, g, or t
tcagagtcgagagacacgaccggtgctcgatttagctacgactgcagggtaacccgggccaccctgaccatcagccgggtcgaagacggggatgaggccgactattactgtcaggtgtgggatagtggtagtggtgtcgtcttcggagctgggaccagggtcacgtcctaggtcagcccaaggccaaccccactgtcactctgttcccacctctctctctcgactctgagcgggctgggcaaggcgcagtagnnnnnncnnnnnnnnnn

SEQ ID NO: 135144 - DNA, 688 bp, Homo sapiens
  misc_feature: GYAE6OF01DCD65.49.11.A11.1.454.CMB.1.raw
tcagagtcgagagacacgaccggtgctcgatttagctacgactgcgagggggggcctaaggaagcagcactggtggtgcctcagccatggcctggaccgttctcctcctcggcctcctctctcactgcacagactctgtcgacctctatgtgctgactcagcccaccctcggtgtcaggtcggccccgtggaccaggaccggccgagggtacttaccgtgggtacggggggaaaacgactaagttagggaaagttaaagactgtcgcacgtcggtaccagacaagaacgccgacggccgtacggccctgtcgcgtggtctcgtagtggtgtacgtcgggaccggaccggcccgtacgagggtactcccgtagacgcgttacttcgtcgtcggtctacccgtacgtccggtaccggggaccccgacctacccgtacgacctacgtcgacgggaccgggtacgaagggacgggtaatggaacggccgtattaacgttacgtagtacgtagggtggttgggtaagtggtaggtgtcggtgtcgtcgtgggacgtcgacgggtaccggtcgtaccgtaccgtacgtaccggtacacccggaaccgtaccggacccgaccccgtagtcccggtactacccgttcgtcccgtccccgtcccttccctccttactcccgttacgtccgttaccgg

SEQ ID NO: 135145 - DNA, 765 bp, Homo sapiens
  misc_feature: GYAE6OF01CS4S0.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtggggaaacacattggaagtaagactgtgcacgtggtaccagcaagaacgccaggccaggcccctgtcgctggtcgtctagtggtgagtggccgacccggccctcgagggactccccgtgacgcgtattcctcgtggcctaccaacctcgtaccgggaaccccgcccaccctcgacctacgtcgacggcccggggtagaacgggacggggatacgggacggacccgtaacgttaacgttacgtgttaccggtaagggttcgggtagggtaattaggggttagggttaacgggttggggtttcggttcggttccgtttaccggggaacggtccggttaacgggggaccccgtaagggggttccctaaccccgggttacccgttaacgggtaccgtaaccggacccccggtaaaaccggggacccccctaaaacccccgtacggtttcccggtaaccctaaccccgtttcccgtttacccccggtttaccccccccgaaccccccttttccccgttacccttaccccgtttcccctacccggtaaccccgtttcccggg

SEQ ID NO: 135146 - DNA, 630 bp, Homo sapiens
  misc_feature: GYAE6OF01D4AE8.49.11.A11.1.454.CMB.1.raw
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
  modified_base (275)..(276): a, c, t, g, unknown or other
  misc_feature (275)..(276): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
tcagagtcgagagacacgaccggtgctcgatttagctacgactgcaggggacccggccaccctgaccatcagccgggtcgaagacgggatgaggccgatattactgtcaggtgtgggatagtggtagtggtgtcgtctcggagctagggaccagggtcaaccgttcctaggtcacgcccaaggcccaaacccctntgttacactcgttcgttcccacctcctctcctctcgattcgaggaggtccgggactcgganaacgggtcgactagttagnngtagatnactntgctgctatcgnccgntagctagagtcgngaactcgtctgagcacgtatacgtntcgttaacncgttanacgtacgtacgacgacgtacgtacgacgtacgacgacgacgacgtacgtacgtacgacgtacgtacgtacgtacgtacgacgtacgtacgtacgtacgtacgtacgtacgtacgtacgtacgtacgtacgtacgtacgtacgtacgtacgtacgtacgtacggtaacgtacgtacgtacgtacggtacggtacgtcgtacggtaccgtaccgtacgtacgtaccgtacggtacgtacgtcgtaccgtaccgtacgtacgtaccgtacgtcgtcg

SEQ ID NO: 135147 - DNA, 258 bp, Homo sapiens
  misc_feature: GYAE6OF01CPUXR.49.11.A11.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggacaaggcgcatagnnnnnnn

SEQ ID NO: 135148 - DNA, 253 bp, Homo sapiens; identical to SEQ ID NO: 134809
  misc_feature: GYAE6OF01ARSXN.49.11.A11.1.454.CMB.1.raw
  modified_base (252)..(253): a, c, t, g, unknown or other
  misc_feature (252)..(253): n is a, c, g, or t

SEQ ID NO: 135149 - DNA, 618 bp, Homo sapiens
  misc_feature: GYAE6OF01DVD0F.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgtggtgggggaaacacattggaagtaagactgtgcactggtaccagcagaagccaggccaggcccctgtgcgtggtcgtctagtggtgagtggccgacccggccctcgagggactcccgtgacgcgtattcctcgtggcctcccaacgtcgtacgggaacccgccaccctgaccatcgacggccggggtacgaaacgggaccggggatcggacgggaccgtaacttaagtttacgtggtaccgaagggttggtaggggtattagggtgggttaggtgggttcgtcgttcgttcgggagtcgtgggaccgtaggggtcctaccggttccgtaggtccacgcccgaaggaccccaacccgacgtcgtaccaccttccgtaccgttcccccacccttccctactcctcctcgctcg

SEQ ID NO: 135150 - DNA, 700 bp, Homo sapiens
  misc_feature: GYAE6OF01BPPT9.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccgtggtagggggaaacacattggaagtaagactgtgcactggtaccagcagaagccaggccaggccctgtgctggtcgtctatggtgatggcgaccggccctgagggactcccgtgacgcgtattcgtcgtggcctaccaactcgtacgggaaccccgccaccctcgacctactccgacggtccgggtacgaaacgggtacggggatacggacggtcctaggtaacttacgtttaaccgtggttaccgtaagggtcggttaggggtattagggttgggttaaggttgggttggttccgttacgttcgggaacggtccggttacggggaacccgtacggggttcctacccggttccggtacgggttaccgaacggaccccggtaaacgggaccccctaaacccccgtcgttaccggtacccgtaaccgttccgttacccgtttacccccctaccccgttccccttacccgttcccgttcccgtcccggttaaccccg

SEQ ID NO: 135151 - DNA, 569 bp, Homo sapiens
  misc_feature: GYAE6OF01B7F26.49.11.A11.1.454.CMB.1.raw
  modified_base (497)..(497): a, c, t, g, unknown or other
  misc_feature (497)..(497): n is a, c, g, or t
  modified_base (551)..(551): a, c, t, g, unknown or other
  misc_feature (551)..(551): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctggtgtcagtggcccctggacagacggccaggattacctggtgggggaaaacacagttggaaagtaagactgtgcactggtaccagcagaagccaggccaggcccctgtcgctggtcgtctagtgggtgagtggcgacccggccctcgagggactccctggacgcgtattctctggcctccaactcgtcgggaaccccggccacccgtcgaccatcgacgggcccggggtacggaacggacgggggatgggacgggacccgtaagtacttacgtggtcgagggttggtgggattaggtggtagtggtgtcgtcgtcggagcgtcgggacgngggtcacgtcaggtcacggccagcccaacccacgtcgtcactcctcgttccccnccctctctctctcgctcg

SEQ ID NO: 135152 - DNA, 254 bp, Homo sapiens; identical to SEQ ID NO: 134822
  misc_feature: GYAE6OF01ETG92.49.11.A11.1.454.CMB.1.raw
  modified_base (251)..(254): a, c, t, g, unknown or other
  misc_feature (251)..(254): n is a, c, g, or t

SEQ ID NO: 135153 - DNA, 554 bp, Homo sapiens
  misc_feature: GYAE6OF01C3AJE.49.11.A11.1.454.CMB.1.raw
  modified_base (506)..(506): a, c, t, g, unknown or other
  misc_feature (506)..(506): n is a, c, g, or t
  modified_base (530)..(530): a, c, t, g, unknown or other
  misc_feature (530)..(530): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtagggggaaacacattggaagtaagactgtgcactggtaccagcagaagccaggccaggcccctgtgctggtcgtctatggtgatggcgaccggccctcgagggatccctgagcgattctctggctccaactctcgggaacccgccaccctgaccatcgacgccgggtacgaaggacggggatggacggccgaacttattacgtgtcgaggtggtgggataggtggtagtggtgtcgtcgtcggagcgtgggacctaggggtccaccggtcgtaggtcacgcccgaaggcccaacccncgtcgtacactccgtcgttccccnccgttccctctcctctccgctcgg

SEQ ID NO: 135154 - DNA, 733 bp, Homo sapiens
  misc_feature: GYAE6OF01C2WDV.49.11.A11.1.454.CMB.1.raw
tcagagtcgagagacacgaccggtgctcgatttagctacgactgcgagggggggcctaaggaagcagcactggtggtgcctcagccatggcctggaccgttctcctcctcggcctcctctctcactgcacagactctgtcgacctcctatgtgctgactcagccacctcggtgtcaggtcggcccctggacacggacggccaggtacttaccgtgggtagggggaaaacacgtagttagggaaagttaaggacttggtagaccacgttgggtaaccagccgaaggaaacgccgagggccacggccctggtcgctggtcgtctagtggtgagtcggccgaccgcctacgagggtactccgtaggacggtcgtacttccgtcgtcggcctaccgaaacgttccggtacggggaacccccgcctaacccgtcggaaccagtacccgacggggtaccgggtaacggaaacgggaccgggggtaatcgggacggtaccgtaacgttacgttacgtggtacgagggttcggaggggtataggttaggtaggtcggtagttcgtacggttagggcgtcggtacgggaccgtacgggtcctaaccggtcgttaacggccgtaaccggacccgtaaccgggacccctaaacccctggttaccgtacctaccgtcccggtttacccgggtccccctcccccgtttacttccgttaccccttccggtaccgtcccgtttacggg

SEQ ID NO: 135155 - DNA, 304 bp, Homo sapiens
  misc_feature: GYAE6OF01CIWWP.49.11.A11.1.454.CMB.1.raw
  modified_base (252)..(252): a, c, t, g, unknown or other
  misc_feature (252)..(252): n is a, c, g, or t
  modified_base (258)..(304): a, c, t, g, unknown or other
  misc_feature (258)..(304): n is a, c, g, or t
tcagagtcgagagacacgaccggtgctcgatttagctacgactgcagggaacccggccaacccgtgaccagtcaggccgggtccgaagacggggatgaggccgactattactgtcaggtgtgggatagtggtagtggtgtcgtcttcggagctgggaccagggttcaccgtcctaggtcagtcccaaggtcctaacccatgtcactctgttcccgcctctctctcgtcggactctgagcgggctggcaggcncatagnnnnnnnnnnnnnnnnnnnnnnnnnnnnnnnnnnnnnnnnnnnnnnn

SEQ ID NO: 135156 - DNA, 299 bp, Homo sapiens
  misc_feature: GYAE6OF01D0MSH.49.11.A11.1.454.CMB.1.raw
  modified_base (267)..(299): a, c, t, g, unknown or other
  misc_feature (267)..(299): n is a, c, g, or t
tcagagtcgagagacacgaccggtgctcgatttagctacgactgcaggggaacccggccacccgtgaccatcagccgggtcgaagacggggatgaggccgactattactgtcacggtgtgggatagtcggtagtggtgtcgtcttcggagctgggaccagggtcaccgtcctaggtcagcccaaggcccaaccccactcgtccacgttctcgttcccaccctcctacgtcctcgtcgactctgagcgggctggcaaggcgtcatagnnnnnnnnnnnnnnnnnnnnnnnnnnnnnnnnn

SEQ ID NO: 135157 - DNA, 785 bp, Homo sapiens
  misc_feature: GYAE6OF01CVQUU.49.11.A11.1.454.CMB.1.raw
  modified_base (209)..(209): a, c, t, g, unknown or other
  misc_feature (209)..(209): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgaccctctatgtgctgactcagccaccctggtgtcaggtcggccctggacaggacggccaggacttaccgngggtaagggggaaacactagttagggaaacgttagacgtggtgcacgtagggtaccagacaagaacgaccaggccacggccctggtcgctggtacgtctagtggtagacgtggaccgaccggtccctacgacgggtactcccgtaggacgtccgtacttcctaccggtgtaccgtaccgtaaccgtcggtacccgggggaaccccgtcccgaaccccggttcgaacccgtagtaccggtaccgggtacccgggggttacggaaacgggtaacggggtagacgggtaacggtccgttacgtaactacgttagttacggtacggtaaggggttcggtagggtaacgttaggggttacgggttagggttgggtttacggtcccggtttacgttacggggtaacggtcgggtttaaccggggaccgtaccgggtacctaccggttacccggtaggacccgtaaccgaacccggtaaacggaccccgtaaaccccgtaggtaccgtaccgtaaaccgttcccgttacccgtttaccccgtccccgtttacctcccctttcgttcccggtaaccttacccgg

SEQ ID NO: 135158 - DNA, 254 bp, Homo sapiens
  misc_feature: GYAE6OF01DWM47.49.11.A11.1.454.CMB.1.raw
  modified_base (247)..(247): a, c, t, g, unknown or other
  misc_feature (247)..(247): n is a, c, g, or t
  modified_base (253)..(254): a, c, t, g, unknown or other
  misc_feature (253)..(254): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaacccccatgtcactctgttcccaccctcctctctctcgactctgagcgggctggcaaggcncatagnn

SEQ ID NO: 135159 - DNA, 256 bp, Homo sapiens
  misc_feature: GYAE6OF01EQMYP.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgagcgggctggcaaggcgcatagnnnnnn

SEQ ID NO: 135160 - DNA, 263 bp, Homo sapiens
  misc_feature: GYAE6OF01DHHXM.49.11.A11.1.454.CMB.1.raw
  modified_base (252)..(263): a, c, t, g, unknown or other
  misc_feature (252)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccactgtcactctcgttcccacctcctctctctcgactctgacgcgggctggcaaggcgcatagnnnnnnnnnnnn

SEQ ID NO: 135161 - DNA, 650 bp, Homo sapiens
  misc_feature: GYAE6OF01CUML9.49.11.A11.1.454.CMB.1.raw
  modified_base (492)..(492): a, c, t, g, unknown or other
  misc_feature (492)..(492): n is a, c, g, or t
  modified_base (527)..(527): a, c, t, g, unknown or other
  misc_feature (527)..(527): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctggtgtcagtcggcccctggacaggaccggccaagggacttaccgtgggtacgggggaaaacactagttagggaagtaagactggtgccagtcggaccagacagaacgccaggccaggccctgtcgctggtcgtctagtggtgacgtggccgaccggccctaggacgggtactccccgtggacgcgtattccgtcgtcggcctacctaacgtcggtaaccggggaaccccgccaacccgttggaaccctagccgacgggcccggggtagaaacgggacggggatacggacgggtaccctaagttacttcgtacggcgtaggttggnggtagtaggtggtaggtggtcgtcggttctagggngtcgtgggaccgcggtaccaccgtcgtgaccacggacccgacggaccccacccgtcgtcgtaccctaccgttccgtacccgttcccccgcccttaccctctccttaccggtccgtccttacgg

SEQ ID NO: 135162 - DNA, 254 bp, Homo sapiens
  misc_feature: GYAE6OF01CAM93.49.11.A11.1.454.CMB.1.raw
  modified_base (250)..(254): a, c, t, g, unknown or other
  misc_feature (250)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgagcggctggcaaggcgcatagnnnnn

SEQ ID NO: 135163 - DNA, 259 bp, Homo sapiens
  misc_feature: GYAE6OF01BWKJN.49.11.A11.1.454.CMB.1.raw
  modified_base (252)..(259): a, c, t, g, unknown or other
  misc_feature (252)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnn

SEQ ID NO: 135164 - DNA, 654 bp, Homo sapiens
  misc_feature: GYAE6OF01ERILV.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggattaccgtggtagggggaaacacattgggaaagtaagactgtgcactggtaccagcagaagccgaggccaggcccctgtgcttggtcgtctagtggtgagtgggccgacccggccctcgacgggactccccgtgacgcgtatttccgtcgtcggcctacccaaacgtccggtaccggggaaaccccggcccaccccgtgacccactccgacggcccggggtagaaacgggacggggatgggacggacccgtaactactttacgtggtacgagggttggtgggagttggtggtaggtggtgtcggttcgtgggacgtcggtacggggaccgtacggggtaccaccggttccgtaagggtccgacgacccggaacggccccaaaccccgtcgtccgtacctacctccgttacccgttccccgaccccttcctaccttcctccttccgaccttccgg

SEQ ID NO: 135165 - DNA, 256 bp, Homo sapiens
  misc_feature: GYAE6OF01AMU3A.49.11.A11.1.454.CMB.1.raw
  modified_base (250)..(256): a, c, t, g, unknown or other
  misc_feature (250)..(256): n is a, c, g, or t
tcagagtcgagagacacgaccggtgctcgatttagctacgactgcagggaacccggccaccctgaccatcagccggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnn

SEQ ID NO: 135166 - DNA, 310 bp, Homo sapiens
  misc_feature: GYAE6OF01CZI63.49.11.A11.1.454.CMB.1.raw
  modified_base (251)..(251): a, c, t, g, unknown or other
  misc_feature (251)..(251): n is a, c, g, or t
  modified_base (257)..(263): a, c, t, g, unknown or other
  misc_feature (257)..(263): n is a, c, g, or t
  modified_base (265)..(310): a, c, t, g, unknown or other
  misc_feature (265)..(310): n is a, c, g, or t
tcagagtcgagagacacgaccggtgctcgatttagctacgactgcagggaacccggccaaccctgtaccattcagccgggtcgaagacggggtatgaggccgactattactgtcaggtgtgggatagtggtagtggtgtcgtcttcggagcgtggaccagggtcaccgtcctaggtcagcccaaaggccaaccccactgtcactctgttcccaccctcctctctctcgactctgagcgggctggcaaggcncatagnnnnnnncnnnnnnnnnnnnnnnnnnnnnnnnnnnnnnnnnnnnnnnnnnnnnn

SEQ ID NO: 135167 - DNA, 263 bp, Homo sapiens
  misc_feature: GYAE6OF01ALHCI.49.11.A11.1.454.CMB.1.raw
  modified_base (255)..(263): a, c, t, g, unknown or other
  misc_feature (255)..(263): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccactgtcactctgttccccaccctcctctcctctcgactctgagcgggctggcaaggcgcatagnnnnnnnnn

SEQ ID NO: 135168 - DNA, 259 bp, Homo sapiens
  misc_feature: GYAE6OF01BD2LL.49.11.A11.1.454.CMB.1.raw
  modified_base (251)..(259): a, c, t, g, unknown or other
  misc_feature (251)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccactgtcactctgttcccgccctcctctctctcgactctgagcgggctggcaaggcgcatagnnnnnnnnn

SEQ ID NO: 135169 - DNA, 616 bp, Homo sapiens
  misc_feature: GYAE6OF01BJDGL.49.11.A11.1.454.CMB.1.raw
  modified_base (206)..(206): a, c, t, g, unknown or other
  misc_feature (206)..(206): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattaccnggtggggaaacacattggaagtaagactgtgcactggtaccagcagaagccaggccacggcccctgtgctggtcgtctagtggtgagtggccgaccggccctcgagggactcccgtgacgcggtacttctcgtcggcctacccaacgtcgtaccggggaacccgcccaccccgtcgaccataccgacggcccggggtacgaaacgggacggggatcgggacggccggtaactagtttacgtggtacgagggtcggtgggattagggtggtaggtggtcgttcgttcgttcgggcgtcgtacgggaccgacgggtccaccggtccgtacggtccacggacccgaacggccccaacccgtcgtcgtccaccgttcctaccgttccccacccttcctctcctcctcgtctccg

SEQ ID NO: 135170 - DNA, 613 bp, Homo sapiens
  misc_feature: GYAE6OF01E5NAK.49.11.A11.1.454.CMB.1.raw
  modified_base (499)..(499): a, c, t, g, unknown or other
  misc_feature (499)..(499): n is a, c, g, or t
  modified_base (556)..(556): a, c, t, g, unknown or other
  misc_feature (556)..(556): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgaccctctatgtgctgactcagcccaccctggtgtcagtcggccctggacaggacggccaggtacttaccgtggtaggggaaacactagttggaaagtaagactgtgcacgtggtaccagcaagaacgccgaggccacggccctgtgcgtggtcgtctagtggtgagtcggccgacccggccctcggacgggtacctccccggagcgtacttcctcgtcggcctaccgaacgtcgtaccggggaaccccgcccacccgtcgaccatcgacggccgggtacggaacgggacggggatggacggccgtaacttattacgtgtacgtagggtggtggataggtggtagtggtgtcgtcgtcggngcgtggaccgtggtccaccggtccgtaggtcgacgacccgaacggccccaaacccgngtcgtccactctcccgttcccccacccttccctctcctcctaccgtcctcgtacggg

SEQ ID NO: 135171 - DNA, 790 bp, Homo sapiens
  misc_feature: GYAE6OF01AGAPI.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtcggcccctggacaggaccggccaggattaccgtggtagggggaaacgactagttgggaaagtaagactgtcgcacgtggtaccagcagaacgccaggccacggccctgtgcgtggtcgtctagtgggtgagtcgggccgacccggtccctcggaggggaccttcccgtggacggccgtactttccgtcgtcgggtcccttacccgtaaccgttccggtaccgggggaaacccccggtcccctaaccccgtcggaacccctacgttacccggaacggggtaccccggggtaacggaaacggggaccgggggtaacgtcgggaaccgggacccgtaacgtttaacgtttaccgtggtacggtaggggttcgggttaggggtattagggttgggtaggttgggttcggttccgggttcggttaccgggacggtccggttacgggggaacccgtacggggttacccgtacccggttccgttaacgggtaccgaccggtaccccgaaccgggacccccctaaacccgtccgttccgtaccctacccgttccgttaccccggttccccctaccccgttccccttcccttacccgttcccgttccgtaccgttcccggg

SEQ ID NO: 135172 - DNA, 257 bp, Homo sapiens
  misc_feature: GYAE6OF01CWX4Y.49.11.A11.1.454.CMB.1.raw
  modified_base (247)..(247): a, c, t, g, unknown or other
  misc_feature (247)..(247): n is a, c, g, or t
  modified_base (253)..(257): a, c, t, g, unknown or other
  misc_feature (253)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaacccactgtcactctcgttcccgccctcctctctctcgactctgagcgggctggcaaggcncatagnnnnn

SEQ ID NO: 135173 - DNA, 262 bp, Homo sapiens
  misc_feature: GYAE6OF01ELL05.49.11.A11.1.454.CMB.1.raw
  modified_base (252)..(262): a, c, t, g, unknown or other
  misc_feature (252)..(262): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaaggccaaccccactgtcactctgttcccaccctcctctctctcgactctgagcgggctggcaaggcgcatagnnnnnnnnnnn

SEQ ID NO: 135174 - DNA, 361 bp, Homo sapiens
  misc_feature: GYAE6OF01EU187.49.11.A11.1.454.CMB.1.raw
  modified_base (104)..(104): a, c, t, g, unknown or other
  misc_feature (104)..(104): n is a, c, g, or t
  modified_base (107)..(107): a, c, t, g, unknown or other
  misc_feature (107)..(107): n is a, c, g, or t
  modified_base (330)..(361): a, c, t, g, unknown or other
  misc_feature (330)..(361): n is a, c, g, or t
tcagagtcgagagacacgaccggtgctcgatttagctacgactgcggggacccggccaccctgaccatcagccgggtcgaagacgggggatgagtcgccgtaanacnttacgtgtgtggtgggtaggtagtaggtaggtggtggtcgttcgttcggtacggcgtcggaccggaccgggtacggtaccgtacccgttaccggtacggtacgacccgaacccggaacccgaacccccaacccctacgtcgacttctcgttcccgtcccttccctccctccttcctcgtcctcctacgcgtcgggcgtcgggcgtagggccgacgacgacgannnnnnnnnnnnnnnnnnnnnnnnnnnnnnnn

SEQ ID NO: 135175 - DNA, 780 bp, Homo sapiens
  misc_feature: GYAE6OF01A2LTZ.49.11.A11.1.454.CMB.1.raw
tcagagtcgagagacacgaccggtgctcgatttagctacgactgcagggggggcctaaggaagcagcactggtggtgcctcagccatggcctggaccgttctcctctcggcctcctctctcactgcacagactctgtgacctcctatgtgctgactcacgcccacccgtcggtgtcaggtcggccctggacacggaccggccaggtacttaccgtgggtacggggggaaaacacgtagttagggaaagtaagactgtcgcacgttacggtaaccaggacgaaggaacgccgacggaccgacggcccgtggtcgtcgttcggtcgtcgtagtaggtggtagtcggccggacccggtcccgtacggacgggtaccgtccgtaggacccccccgtagtacttcctcgtacgtcctacccgtaacgtccggtaccggggaaccccggcccgacccgtcgaaccgtacgtccggaccgggtaccggggtaacggaaacggggaacggggtacggtacgggaacgggtaccgtaacgttaacgtttacgtacggtacggtagggttagggtacgggtagtagggttagggtaggttcgggttggttccggttcggttacgggaggtccggtacgggtaccggtacgggtaccgtaccgttacgtacggtccgaaccggacccgaaccggtaccccgaacccgtacggtcgtaccgtaccgttcccgttacccggttcccccgtccccgttacccgttcccgttaccctccgttccggtccgtacgg

SEQ ID NO: 135176 - DNA, 257 bp, Homo sapiens
  misc_feature: GYAE6OF01AYDPM.49.11.A11.1.454.CMB.1.raw
  modified_base (249)..(257): a, c, t, g, unknown or other
  misc_feature (249)..(257): n is a, c, g, or t
tcagagtcgagagacacgaccggtgctcgatttagctacgactgcgagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccatgtcactctgttcccacctcctctctctcgactctgagcggctggcaaggcgcatagnnnnnnnnn

SEQ ID NO: 135177 - DNA, 256 bp, Homo sapiens
  misc_feature: GYAE6OF01C8H16.49.11.A11.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaaccccactgtcactctgttcccaccctcctctctctcgactctgagcgggctggcaaggcgcatagnnnn

SEQ ID NO: 135178 - DNA, 640 bp, Homo sapiens
  misc_feature: GYAE6OF01BIXP1.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggacttaccgtggtagggggaaacacagttaggaagtaagactgtgcacgtggtaccagcagaagccaggccaggcccctgtgcgtggtcgtctagtgggtgagtggccggaccggccctgacggggactcccgtgacgcgtacttctcgtcggcctacccaaacgtcgtacggggaaccccgccaccctacgaccagtccgaacgggtccgggtaacgaagggacggggataggacggacccgtaacgtacttacgtgtcgagggtgtgggataggtggtagtggtgtcgtcgttcggagtcgtcgggaccgtacgggtcctacccggttcgtaggtccgaacggaccccgaacggaccccaaaccccgtacgtcgtacctaccgttcccgttccgttacccccaccccttccctacctcccttccgtccgtcgttaccgg

SEQ ID NO: 135179 - DNA, 256 bp, Homo sapiens; identical to SEQ ID NO: 134845
  misc_feature: GYAE6OF01C42KB.49.11.A11.1.454.CMB.1.raw
  modified_base (252)..(256): a, c, t, g, unknown or other
  misc_feature (252)..(256): n is a, c, g, or t

SEQ ID NO: 135180 - DNA, 255 bp, Homo sapiens
  misc_feature: GYAE6OF01DBUG8.49.11.A11.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaaggcgcatagnnnnn

SEQ ID NO: 135181 - DNA, 257 bp, Homo sapiens; identical to SEQ ID NO: 134898
  misc_feature: GYAE6OF01BP5P2.49.11.A11.1.454.CMB.1.raw
  modified_base (252)..(257): a, c, t, g, unknown or other
  misc_feature (252)..(257): n is a, c, g, or t

SEQ ID NO: 135182 - DNA, 254 bp, Homo sapiens; identical to SEQ ID NO: 134762
  misc_feature: GYAE6OF01CHPA1.49.11.A11.1.454.CMB.1.raw
  modified_base (252)..(254): a, c, t, g, unknown or other
  misc_feature (252)..(254): n is a, c, g, or t

SEQ ID NO: 135183 - DNA, 257 bp, Homo sapiens
  misc_feature: GYAE6OF01BI8P5.49.11.A11.1.454.CMB.1.raw
  modified_base (249)..(257): a, c, t, g, unknown or other
  misc_feature (249)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccgcctctctctctcgactctgagcgggctggcaaggcgcatagnnnnnnnnn

SEQ ID NO: 135184 - DNA, 265 bp, Homo sapiens
  misc_feature: GYAE6OF01EBKHO.49.11.A11.1.454.CMB.1.raw
  modified_base (252)..(265): a, c, t, g, unknown or other
  misc_feature (252)..(265): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnn

SEQ ID NO: 135185 - DNA, 571 bp, Homo sapiens
  misc_feature: GYAE6OF01BKSHE.49.11.A11.1.454.CMB.1.raw
  modified_base (465)..(465): a, c, t, g, unknown or other
  misc_feature (465)..(465): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacattggaagtaagactgtgcactggtaccagcagaagccaggccaggcccctgtgctggtcgtctatggtgagtggcgaccggccctcgaggggactccctgagcgattctctggctccaactcgtgggaaccccggccacccgtgacccatccgaggcccggggtcgaaagggacggggatggagggcccgatattacgtgtcgagggtgtgggatggtgggtagtggtgtcgttcgttcgggngtcgtgggaccgaggggtccaccggtccgtaggtccgacgcccgaacggccccaaccccgagtccgtcactctccgttccccaccctccctctcctctccgctccg

SEQ ID NO: 135186 - DNA, 257 bp, Homo sapiens
  misc_feature: GYAE6OF01BZH6D.49.11.A11.1.454.CMB.1.raw
  modified_base (251)..(257): a, c, t, g, unknown or other
  misc_feature (251)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcggctggcaaggcgcatagnnnnnnn

SEQ ID NO: 135187 - DNA, 656 bp, Homo sapiens
  misc_feature: GYAE6OF01DRDLQ.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcagcctcctctctcactgcacagactctgtgacctctatgtgctgactcagccaccctcggtgtcagtcggccctggacagacggccaggattaccgtggtaggggggaaaccactaagttagggaaaagttaaagaccttggtggaccaacgtgggtaccagacaggaaaacgcccgaagggcccaacgggccccttggtcgcgtggtcgtctaagtggtgagtcggccgacccgggccctgagggactcccgtgagcgtattctcgtggcctaccaacgtcgtacgggaaccccgcacccgtgaccagtcgacggccgggtagaaaggacggggatcggacggaccgtacttaacttacgtggtacgtagggtggtagggagttaggttagggtaggttggtcgtcggttcgttcgggaggtcggtacgggaccgtagggtaccacccggttccgtaggtccgaacggacccgaacggtacccaaccccgtatcggtactacctcttcccggtacccctacccttaccctcttcctcgtcgtaccg

SEQ ID NO: 135188 - DNA, 260 bp, Homo sapiens
  misc_feature: GYAE6OF01BAADW.49.11.A11.1.454.CMB.1.raw
  modified_base (250)..(260): a, c, t, g, unknown or other
  misc_feature (250)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccactgtcactctgttcccgcctcctctctctcgactctgagcgggctggcaaggcgcatagnnnnnnnnnnn

SEQ ID NO: 135189 - DNA, 667 bp, Homo sapiens
  misc_feature: GYAE6OF01E3TYA.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtcggcccctggacagacggccaggattaccgtggtagggggaaacacattggaagtagactgtgcactggtaccagcagaagccaggccaggcccctgtgttggtcgtctagtggtgagtggccgaccggccctcgaggggactcccgtggacgcgatttctcgtcggcctccaactccgtacgggaaccccgccaccctgaccatcgacggccgggtacgaacggacggggatcggacggccgacttacgttacgtggtacgtagggtggtgggaacgttgggtgggtaggttggtcggttccggttcgttcgggagtcggtacgggaccgacgggtcctacccggttccgtaacgggtccaccggaccccgaaacgggcccctaaaacccccgcttaccggtaccctaccttcccggttcccggtttccccccgccccttccccgttcccttcccgttcccgtccgttaccgttccgttaaccggggg

SEQ ID NO: 135190 - DNA, 257 bp, Homo sapiens
  misc_feature: GYAE6OF01EG6F9.49.11.A11.1.454.CMB.1.raw
  modified_base (250)..(257): a, c, t, g, unknown or other
  misc_feature (250)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctctctctctcgactctgagcgggctggcaaggcgcatagnnnnnnnn

SEQ ID NO: 135191 - DNA, 716 bp, Homo sapiens
  misc_feature: GYAE6OF01BQBPS.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtggcccctggacagacggccaggattacctggtagggggaaacgacattggaaagtaagactagtgcacgtggtaccagcagaacgccaggccaggcccctgtcgctggtcgtctatggtgagtggccgaccggccctgacgggactccgtgacgcgtattccgtcgtcggcctaccaaccttcggtaccggggaaccccggccctacccgtgacccagtccgacggtccggggtacgaacgggacggggactagggacggtacccgtacttaacgttacgtcggtacgtagggttcggtaggggtattagggttgggttaaggtcggggttcggttccggttcggttcgggacggtcgtaggggacccgtaggggtcccgacccggttccgtacgggtaccaaccggccccgaaacgggcccctaaaacccccgtcgttaccggtaccctaaccggtttcccgttaccccgggtttccccccgacccctttaccccgttcgttacccccgttccgttacccggtcccgtttacccggg

SEQ ID NO: 135192 - DNA, 269 bp, Homo sapiens
  misc_feature: GYAE6OF01EV7YG.49.11.A11.1.454.CMB.1.raw
  modified_base (253)..(269): a, c, t, g, unknown or other
  misc_feature (253)..(269): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaaggccaaaccccatgtcactctgttcccaccctcctctctctcgactctgagcgggctggacaaggcgcatagnnnnnnnnnnnnnnnnn

SEQ ID NO: 135193 - DNA, 258 bp, Homo sapiens; identical to SEQ ID NO: 134826
  misc_feature: GYAE6OF01CI0RY.49.11.A11.1.454.CMB.1.raw
  modified_base (252)..(258): a, c, t, g, unknown or other
  misc_feature (252)..(258): n is a, c, g, or t

SEQ ID NO: 135194 - DNA, 255 bp, Homo sapiens; identical to SEQ ID NO: 134817
  misc_feature: GYAE6OF01BC74J.49.11.A11.1.454.CMB.1.raw
  modified_base (252)..(255): a, c, t, g, unknown or other
  misc_feature (252)..(255): n is a, c, g, or t

SEQ ID NO: 135195 - DNA, 610 bp, Homo sapiens
  misc_feature: GYAE6OF01EME61.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggccctggacagacggccaggattacctggtagggggaaacacagttggaagtaagactgtgcactggtaccagcagaagccaggccaggcccctgtgctggtcgtctagtggtgagtggccgaccggccctcgagggactcccgtgacgcgattctcgtggcctaccaactcgtacgggaacccggccacccgtgaccatccgacggccgggtacgaaacggacggggatcgggacggcccgaacttagttacgtgtcgagggtggtagggataggtggtagtggtgtcgtcgttcgggagtcgtacggggaccgtaggggtccaccggttccgtagggtccaacggccccgaacggccccaaccccgtacgtcgtaccaccttccttccggttcccccaccccgttcctacttccctcctccgtacttccg

SEQ ID NO: 135196 - DNA, 643 bp, Homo sapiens
  misc_feature: GYAE6OF01A3ELB.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctggtgtcagtggcccctggacaggacggccaggattaccgtggtagggggaaacacagttggaagtaagactgtgcactggaccagcagagccaggccacggccctgtcgcgtggtcgtctagtggtgagtcggcgaccggccctcgagggtactcccgtgacgcgtacttcgtctcggcctaccgaacgtcgtacggggaccccgccacccgtcgaccatccgacggtccgggtacgaaagggaccggggatcgggaacggacccgtaacgttacgttacgtggtacgtagggttggttacggggaagttagggtgggttaggtgggttcggtcggtttcgttcgggagtccggtacggggaccgtacggggtccctacccggttccgtagggtccaacggccccgaaggccccaaaccccgtcgtcgtccacttccgttccgttccccacccttcctacttcctctccgtactcg

SEQ ID NO: 135197 - DNA, 253 bp, Homo sapiens; identical to SEQ ID NO: 134759
  misc_feature: GYAE6OF01E41SJ.49.11.A11.1.454.CMB.1.raw
  modified_base (252)..(253): a, c, t, g, unknown or other
  misc_feature (252)..(253): n is a, c, g, or t

SEQ ID NO: 135198 - DNA, 577 bp, Homo sapiens
  misc_feature: GYAE6OF01DSXND.49.11.A11.1.454.CMB.1.raw
  modified_base (258)..(258): a, c, t, g, unknown or other
  misc_feature (258)..(258): n is a, c, g, or t
  modified_base (523)..(523): a, c, t, g, unknown or other
  misc_feature (523)..(523): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggacaggacggccaggattaccgtggtaggggggaaaacacagttagggaaagtaagactgtgcactggtaccngcagaagccaggccaggcccctgtgctggtcgtctatgggtgatgggcgaccggccctcgaggggactccctgagcgattctctggctccaactcgtacggggacccgccaccctgacccagtcaggccgggtgaaaggaccggggatggacggccgaattatacgtgtcgaggtgagggtataggtggtagtggtcgtcgttcgttcgggagtcgtggggacctggggtccaccgtcctaaggtcacgcccaggcccaaccccngtcgtacactctcgttcccccgcccttccgttcttccctacgccttcgtacggg

SEQ ID NO: 135199 - DNA, 258 bp, Homo sapiens
  misc_feature: GYAE6OF01CYJQO.49.11.A11.1.454.CMB.1.raw
  modified_base (253)..(258): a, c, t, g, unknown or other
  misc_feature (253)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaaggccaaccccactgtcactctgttcccgccctcctctctctcgactctgagcgggctggcaaggcgcatagnnnnnn

SEQ ID NO: 135200 - DNA, 752 bp, Homo sapiens
  misc_feature: GYAE6OF01B5QUR.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctctatgtgctgactcagccaccctcggtgtcagtggcccctggacagacggccaggtattacctggtagggggaaacgacatttggaagtaagactgtgcactggtaccagcagaagccaggccacggcccctgcgcgtggtcgtcgtatggtgagtggccgaccgcccgtgacgggactcccgtgacgcgtattcctcgtcggcctaccaaccgtcgtacggggtaccccggcctaccccgtcgaaccctacgtacgacggccgggtacggaacgggaacggggagtacgggacggtacccgtaacttaacgttaccgtaggtacgtaggggttacggtaggggtaagttaagggttggggttaagggttgggtttacggttccggttccggttttaccgggacgggtccgttacggggggaacccgtagggggttccccgtaacccggttccggtaacgggttcccgaaccgggacccccgaaaacgggtacccccaaaacccccgtacgtaccggttacccgtacccgtttcccggttcccgtttacccccccggcccctttaccccgttcccttcccgtttacccgttcccgtccgtttacccggg

SEQ ID NO: 135201 - DNA, 743 bp, Homo sapiens
  misc_feature: GYAE6OF01BE47K.49.11.A11.1.454.CMB.1.raw
tcagagtcgagagacacgaccggtgctcgatttagctacgactgcgaggggggggcctaaggaagcagcactggtggtgcctcagccatggcctggaccgtttctcctcctcggcctcctctctcactgcacagactctgtgacctcctatgtgctgactcagcctaccttcggtgtcaggtcggcccctggacacggaccggccgaaggtacttaccgtgggtaggggggaaaacacagttagggaaagtaagacgttggtacgctacgtcggtaaccagacaggaacgccgaggacccacggcccctgtcgctggtcgtctagtgggtgagtcggccggacccggtcccgtcgacggggaccttcccgtggacggtcgtactttccgtcgtacgggtcctaccaacgtccggtaccggggaaccccgccctaccctacgaacccacgtcgacgggccgggtaacggaaacggggacggggagtacgggacggacccgtacttaagtttcgtggtacggtagggttcggtagggtacgttagggttgggttaggttcgggttgttccggttcggtagggtacggcgggtacgggaccgtaggggtcccgtaccggttacgtagggtccaacggaccccgaaacgggtaccccaaaccccggtgttaccgtactcccgttccgttacccgttcccccctaacccgttccctcccttcccgttaccgtccgtaccgttcccggg

SEQ ID NO: 135202 - DNA, 263 bp, Homo sapiens
  misc_feature: GYAE6OF01AOZLN.49.11.A11.1.454.CMB.1.raw
  modified_base (251)..(263): a, c, t, g, unknown or other
  misc_feature (251)..(263): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccgccctcctctctctcgactctgagcgggctggcaaggcgcatagnnnnnnnnnnnnn

SEQ ID NO: 135203 - DNA, 256 bp, Homo sapiens
  misc_feature: GYAE6OF01EBMFO.49.11.A11.1.454.CMB.1.raw
  modified_base (253)..(256): a, c, t, g, unknown or other
  misc_feature (253)..(256): n is a, c, g, or t
tcagagtcgagagacacgaccggtgctcgatttagctacgactgcagggaaccctgccaccctgaccatcagccgggtcgaagacggggatgaggccgactattactgtcaggtgtgggatagtggtagtggtgtcgtcttcggagctgggaccagggtcaccgtcctaggtcagcccaaggccaaaccccactgtcactctgttcccgccctcctctctctcgactctgagcgggctggcaaggcgcatagnnnn

SEQ ID NO: 135204 - DNA, 273 bp, Homo sapiens
  misc_feature: GYAE6OF01DNQH2.49.11.A11.1.454.CMB.1.raw
  modified_base (233)..(233): a, c, t, g, unknown or other
  misc_feature (233)..(233): n is a, c, g, or t
  modified_base (252)..(273): a, c, t, g, unknown or other
  misc_feature (252)..(273): n is a, c, g, or t
tcagagtcgagagacacgaccggtgctcgatttagctacgactgcagggaacccggccaccctgaccatcagccgggtcgaagacggggatgaggccgatattactgtcaggtgtgggatagtggtagtggtgtcgtcttcggagctggaccagggtcaccgtcctaggtcagcccaaggccaacccatgtcactctcgttcccacctcctctctctcgactctgaggcgggntcggacaaggcgacatagnnnnnnnnnnnnnnnnnnnnnn

SEQ ID NO: 135205 - DNA, 336 bp, Homo sapiens
  misc_feature: GYAE6OF01CFZR6.49.11.A11.1.454.CMB.1.raw
  modified_base (109)..(109): a, c, t, g, unknown or other
  misc_feature (109)..(109): n is a, c, g, or t
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (260)..(267): a, c, t, g, unknown or other
  misc_feature (260)..(267): n is a, c, g, or t
  modified_base (270)..(271): a, c, t, g, unknown or other
  misc_feature (270)..(271): n is a, c, g, or t
  modified_base (273)..(273): a, c, t, g, unknown or other
  misc_feature (273)..(273): n is a, c, g, or t
  modified_base (275)..(278): a, c, t, g, unknown or other
  misc_feature (275)..(278): n is a, c, g, or t
  modified_base (281)..(336): a, c, t, g, unknown or other
  misc_feature (281)..(336): n is a, c, g, or t
tcagagtcgagagacacgaccggtgctcgatttagctacgactgcagggaacccggccgaccctgaccatcagccgggtcgaagacgggggatgaggccgactattacngtcaggtgtgggatagtggtagtggtgtcgtcttcggagctgggaccagggtcaccgtcctaggtcagccaaggccaaaccccntgcactctcgttcccacctctctctcncgactctgacgcgggctcggcgaaggcgtcactaggnagnnnnnnnntcnncntnnnnttnnnnnnnnnnnnnnnnnnnnnnnnnnnnnnnnnnnnnnnnnnnnnnnnnnnnnnnn

SEQ ID NO: 135206 - DNA, 264 bp, Homo sapiens
  misc_feature: GYAE6OF01A8S72.49.11.A11.1.454.CMB.1.raw
  modified_base (253)..(264): a, c, t, g, unknown or other
  misc_feature (253)..(264): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcgtgggaccagggtcaccgtcctaggtcagcccaaggccaaccccatgtcactctcgttcccaccctcctctctctcgactctgagcgggctggcaaggcgcatagnnnnnnnnnnnn

SEQ ID NO: 135207 - DNA, 259 bp, Homo sapiens
  misc_feature: GYAE6OF01D40PQ.49.11.A11.1.454.CMB.1.raw
  modified_base (252)..(259): a, c, t, g, unknown or other
  misc_feature (252)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccatgtcactctcgttcccgccctcctctctctcgactcgtgagcgggctggcaaggcacatagnnnnnnnn

SEQ ID NO: 135208 - DNA, 250 bp, Homo sapiens
  misc_feature: GYAE6OF01CUPFC.49.11.A11.1.454.CMB.1.raw
  modified_base (244)..(244): a, c, t, g, unknown or other
  misc_feature (244)..(244): n is a, c, g, or t
  modified_base (248)..(250): a, c, t, g, unknown or other
  misc_feature (248)..(250): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaggcnatgnnn

SEQ ID NO: 135209 - DNA, 573 bp, Homo sapiens
  misc_feature: GYAE6OF01CP46U.49.11.A11.1.454.CMB.1.raw
  modified_base (564)..(564): a, c, t, g, unknown or other
  misc_feature (564)..(564): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctgggacagacggccagggattaccgtggtagggggaaaacacagtttgggaaagtaagactgtgcactggtaccagcagaagccaggccacggccctgtgctggtcgtctatggtgagtggcgaccggccctcgagggtactcccgtgacgcgtattctcgtggcctccgaggtcgagggacaacggtcactagttcggccagtcgagtggacgtccgaggcaggacggacgaggctagacttattatgtacaatcaacagacactattcggtacttagtgttcgttacggaactcggaccgacgtacgggtccacccggttcgtaggtaccgacgacccgaacggcccaaccccgactcgtaccacctctcccgtccccncccgttccc

SEQ ID NO: 135210 - DNA, 705 bp, Homo sapiens
  misc_feature: GYAE6OF01CAN69.49.11.A11.1.454.CMB.1.raw
  modified_base (286)..(286): a, c, t, g, unknown or other
  misc_feature (286)..(286): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggattaccgtggtacgggggaaaacacagtttgggaaagtaagactggtgcacgtggtaccagcagaacgccaggccacggcccctgngctggtcgtctagtggtgagtcgggccgaccggccctcgagggactcccgtgacgcgtattctcgtcggtctacctaacgtcggtaccggggaaccccgccaaccccgtcgaacccgtacgtccgaacgggtcccggggtacggaaacgggacggggtacgtacgggacggacccgtaacttacgttacgtggtacgtagggttcggtagggtatagggttggtacggtgggttgttcgttcggttacgggacggtcggtacgggacccggtaggggttaccctacccgggtaccgttagggtacccaaccggtaccccgaaacgggacccccaaaccccgtacgtcgtaccctaccgttccgttacccgttccccctaccccgttcccttccttaccgtcccgtccgtccgttaccgg

SEQ ID NO: 135211 - DNA, 259 bp, Homo sapiens
  misc_feature: GYAE6OF01DU3QF.49.11.A11.1.454.CMB.1.raw
  modified_base (253)..(259): a, c, t, g, unknown or other
  misc_feature (253)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctcgttcccaccctcctctctctcgactctgagcgggctggcaaggcgacatagnnnnnnn

SEQ ID NO: 135212 - DNA, 785 bp, Homo sapiens
  misc_feature: GYAE6OF01EK6VW.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtcggcccctggacaggacggccaggattaccgtggtagggggaaaacacagttgggaaagtaagactgtgcacgtggtaccagcagaacgccgaggccacggcccctgtcgcgtggtcgtctagtggtgagtcggccgacccggccctcgagggtactcccgtagacgcgtacttccgtcgtcggccttaccaacgtccgtacggggaaccccgccaccctacgacccactccgacgggtcccggggtacggaaacgggacgggggatacgggaacgggtacccgtaacgttaacgtttaaccgtcggtaccggtaaggggttgggttaggggtaacgttagggttggggttaacggttggggtttcggttaccgggtttacgtttacggggacgtccgggttacggggaacccggtagggggttcccgtaaccccggtttcccgtaacgggtacccgaaccggaaccccggtaaaccgggtaccccctaaaacccccgtacgttaccggttaccctaaccgtttcccggtttaccccggtttaccccccgttccccgttttccccttccgtttaccctttacccgttcccggtacccgttacccggg

SEQ ID NO: 135213 - DNA, 254 bp, Homo sapiens
  misc_feature: GYAE6OF01DF0L2.49.11.A11.1.454.CMB.1.raw
  modified_base (251)..(254): a, c, t, g, unknown or other
  misc_feature (251)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaaggcgcatagnnnn

SEQ ID NO: 135214 - DNA, 863 bp, Homo sapiens
  misc_feature: GYAE6OF01C7976.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtcgacctcctatgtgctgactcacgcccacccgtcggtgtcacggtcggccctggacaggaccggccaggtacttaccgtgggtagggggaaacactagttaggaagtaagacttggtcgacctacgtcggtaaccaggacgaacggaacggccccggggaccgacggtccccgttggttcgggtttagggttacggaagttaggtaaacgtaaaacggtaccgtaacgttacgggaacgggtaccgggtaccccgtacggaacggggtacctacccggtaggacggtacgttaacgttccgttcggtccgggtaccttaccggtaacggtaccggaaacggggtaacccgtaaccgggtactaacgttacgttaccggacctacgtacggtaaggtacggtacggtaccggaagggacggtaaggaacggggacggtacggtacgtacggttaaactttacgtttacgttacgtaactaaactaccgaaacgtacgtaacctaacgttaaggtttacgttaacgtttagttacggttaccgtttaaccggtaacgtccggaaccgttaaacccggtacggttcccgtaaccggttccggttaccgggggtaccaacccgggtaacccgaaacccggaaccccgtaaaccccgttacggttaccgttaaccccgttacccgttcccgtttaccccgtttacccccctcccgtttccccgttacccg

SEQ ID NO: 135215 - DNA, 260 bp, Homo sapiens
  misc_feature: GYAE6OF01DT4PR.49.11.A11.1.454.CMB.1.raw
  modified_base (251)..(260): a, c, t, g, unknown or other
  misc_feature (251)..(260): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaaggcgcatagnnnnnnnnnn

SEQ ID NO: 135216 - DNA, 267 bp, Homo sapiens
  misc_feature: GYAE6OF01CISWN.49.11.A11.1.454.CMB.1.raw
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (260)..(267): a, c, t, g, unknown or other
  misc_feature (260)..(267): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcacgcccaaggcccaaccccatgtcactctcgttcccagtcccctcctctctctcgactctgacgcgggntggacaagggcncaatgnnnnnnnn

SEQ ID NO: 135217 - DNA, 257 bp, Homo sapiens; identical to SEQ ID NO: 134882
  misc_feature: GYAE6OF01C89K7.49.11.A11.1.454.CMB.1.raw
  modified_base (252)..(257): a, c, t, g, unknown or other
  misc_feature (252)..(257): n is a, c, g, or t

SEQ ID NO: 135218 - DNA, 775 bp, Homo sapiens
  misc_feature: GYAE6OF01B1P3S.49.11.A11.1.454.CMB.1.raw
  modified_base (308)..(308): a, c, t, g, unknown or other
  misc_feature (308)..(308): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtcgacctctatgtgctgactcacgcccaccctcggtgtcaggtcggccctggacagacggccaaggtacttaccgtgggtaggggaaacacagttaggaaagtaagactgtgcacgtggtacagacagaagccgaggccgacggccctggtcgcgtggtcgtctatgggtnagtcggccggaccggccctacggagggtactcccgtgacgtcgtattcgtcgtcggcctaccgaacgtccggtaccggggaaccccgcccacccgtacgacctacgtaccgacgggacccggggtaacggaaacgggtacgggggtacgtacgggaaccggtacccggtaactttaacgttaacgttcggtaacggtaggggttagggtacggggtaagttagggttacggggttagggtttcggggttcggttccggtttacgggtttcgggaacggttcgggtacgggggaacccggttacgggggttacccgtaacccgggttccggttaacgggtacccgtaacccggacccccgaaacgggtaccccaaaccccgtcggttacgtaccctaccgttcccggttccgttcccccccgttaccccgttcccttccttcccgttcccgttacccgtcccttcggg

SEQ ID NO: 135219 - DNA, 746 bp, Homo sapiens
  misc_feature: GYAE6OF01DXO3X.49.11.A11.1.454.CMB.1.raw
  modified_base (238)..(238): a, c, t, g, unknown or other
  misc_feature (238)..(238): n is a, c, g, or t
tcagagtcgagagacacgaccggtgctcgatttagctacgactgcagggggggacctaaggaagcagcactggtggtgcctcagccagtgggccttggaccgttctcctcctcggcctcctctctcactgcacagactctgtcgaccttcgtattgtgctgactcacgcccaccctggtgtcaggtcggccctgggacaggaccggccgaggtacttaccgtgggtacggggaaaacnctaggttagggaaacgttaacgacttggtcgacctaacgttcggtaaccagacgaacgaacgaccgacggcccgacggtcccgttaggtcgtcgtcggtacgtacgtagttcggtacgtacgtccgggtaccggtaccggtccggtacggacggtaccgtaccgtacggacggtacgtacgttcgtcgtcggtacctaccgtaacgtacggtaaccgggtacccgtcctaaccgtacgaccgtacgtaccggtaccggtaccgggtaacgaacgggtacgggtacgtacggaccggtacctaacgttacgtacgtgtacgaggttaggtaggtagtaggtcggtagtcggtcgttacgtcggtacgacgtcgtacgggacgtacgggtaccgtaccggtacgtacggtaccgaccggtacccgaacgtacccctaacgtcgtaccgtacctaccgttcccgtacccgttaccccacccgttcctacgttccgtccgtcgttacgtccg

SEQ ID NO: 135220 - DNA, 259 bp, Homo sapiens
  misc_feature: GYAE6OF01CVSXT.49.11.A11.1.454.CMB.1.raw
  modified_base (252)..(259): a, c, t, g, unknown or other
  misc_feature (252)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccacctcctctctctcgactctgacgcgggctggacaaggcgcatagnnnnnnnn

SEQ ID NO: 135221 - DNA, 263 bp, Homo sapiens
  misc_feature: GYAE6OF01BUDQ7.49.11.A11.1.454.CMB.1.raw
  modified_base (252)..(263): a, c, t, g, unknown or other
  misc_feature (252)..(263): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccatgtcactctgtttccaccctcctctctctcgactctgagcgggctcggcgaaggcgcatagnnnnnnnnnnnn

SEQ ID NO: 135222 - DNA, 255 bp, Homo sapiens; identical to SEQ ID NO: 135114
  misc_feature: GYAE6OF01BHYRI.49.11.A11.1.454.CMB.1.raw
  modified_base (251)..(255): a, c, t, g, unknown or other
  misc_feature (251)..(255): n is a, c, g, or t

SEQ ID NO: 135223 - DNA, 254 bp, Homo sapiens
  misc_feature: GYAE6OF01CAU6G.49.11.A11.1.454.CMB.1.raw
  modified_base (250)..(254): a, c, t, g, unknown or other
  misc_feature (250)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccatgtcactctgttcccaccctcctctctctcgactctgagcgggctggcaaggcgcatagnnnnn

SEQ ID NO: 135224 - DNA, 256 bp, Homo sapiens; identical to SEQ ID NO: 134845
  misc_feature: GYAE6OF01EX26B.49.11.A11.1.454.CMB.1.raw
  modified_base (252)..(256): a, c, t, g, unknown or other
  misc_feature (252)..(256): n is a, c, g, or t

SEQ ID NO: 135225 - DNA, 265 bp, Homo sapiens
  misc_feature: GYAE6OF01ERD41.49.11.A11.1.454.CMB.1.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
  modified_base (253)..(265): a, c, t, g, unknown or other
  misc_feature (253)..(265): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaacccntgtcactctcgttcccaccctctctctctcgactcngacgcggctggacaaggcgcagtagnnnnnnnnnnnnn

SEQ ID NO: 135226 - DNA, 259 bp, Homo sapiens
  misc_feature: GYAE6OF01COS3A.49.11.A11.1.454.CMB.1.raw
  modified_base (251)..(259): a, c, t, g, unknown or other
  misc_feature (251)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctcctcgactctgagcgggctggcaaggcgcatagnnnnnnnnn

SEQ ID NO: 135227 - DNA, 255 bp, Homo sapiens
  misc_feature: GYAE6OF01DM3EV.49.11.A11.1.454.CMB.1.raw
  modified_base (189)..(189): a, c, t, g, unknown or other
  misc_feature (189)..(189): n is a, c, g, or t
  modified_base (242)..(242): a, c, t, g, unknown or other
  misc_feature (242)..(242): n is a, c, g, or t
  modified_base (246)..(255): a, c, t, g, unknown or other
  misc_feature (246)..(255): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttggagctgggaccagggtcaccgtcctaggtcagcccaagcccaacccntgtcactctcgtcccacctcctctctctcgactctgagcggctggacaaggcnatgnnnnnnnnnn

SEQ ID NO: 135228 - DNA, 277 bp, Homo sapiens
  misc_feature: GYAE6OF01EG4IH.49.11.A11.1.454.CMB.1.raw
  modified_base (190)..(190): a, c, t, g, unknown or other
  misc_feature (190)..(190): n is a, c, g, or t
  modified_base (244)..(244): a, c, t, g, unknown or other
  misc_feature (244)..(244): n is a, c, g, or t
  modified_base (250)..(251): a, c, t, g, unknown or other
  misc_feature (250)..(251): n is a, c, g, or t
  modified_base (253)..(253): a, c, t, g, unknown or other
  misc_feature (253)..(253): n is a, c, g, or t
  modified_base (256)..(257): a, c, t, g, unknown or other
  misc_feature (256)..(257): n is a, c, g, or t
  modified_base (259)..(265): a, c, t, g, unknown or other
  misc_feature (259)..(265): n is a, c, g, or t
  modified_base (267)..(277): a, c, t, g, unknown or other
  misc_feature (267)..(277): n is a, c, g, or t
tcagagtcgagagacacgaccggtgctcgatttagctacgactgcaggggaacccggccaccctgaccatcagccgggtcgaagacggggatgaggccgactattactgtcaggtgtgggatagtggtagtggtgtcgtcttcggagctgggaccagggtcaccgtctaggtcagcccaagcccaacccntgtcactctcgttcccacctctctctctcactcgtgagcggtctggacaaggcnaatagnncnatnncnnnnnnnannnnnnnnnnn

SEQ ID NO: 135229 - DNA, 735 bp, Homo sapiens
  misc_feature: GYAE6OF01A6GGF.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcacgccaccctcggtgtcaggtcggccctggacaggacggccaggtacttaccgtgggtaggggggaaacacgtagttagggaaagtaagactggtgcacgtcggtaccaggcaagaacgccgacggccaccggtccctggtcgcgttggtcgtctagtgggtgaggtcgggcccggtaccggtcccgtacggacgggtactccccggtagacggtcgtactttccgtcgtccggcctacccgaaccgttccggtacccggggaaccccgccctacccgtacgaccacgtaccgacgggacccggggtaacgaacggggtacggggactacgggaaccggtaccgtaacgttacgtttaacggtcgtacggtaggggttggtagggtaattacggggttgggtaggttcgggttaggttccggttcggtcgggacggtcggttacggggacccggtggggtacccctaccgggttccgacggtacgaccgacccgaacgacccctaacccgtcgtccgtactacccgttcgttccccttacccctcccctcttacccgtacctcttcccgcgttccgg

SEQ ID NO: 135230 - DNA, 255 bp, Homo sapiens
  misc_feature: GYAE6OF01E2JWV.49.11.A11.1.454.CMB.1.raw
  modified_base (250)..(255): a, c, t, g, unknown or other
  misc_feature (250)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctcctctcttcgactctgagcgggctggcaaggcgcatagnnnnnn

SEQ ID NO: 135231 - DNA, 261 bp, Homo sapiens
  misc_feature: GYAE6OF01D9NXN.49.11.A11.1.454.CMB.1.raw
  modified_base (191)..(191): a, c, t, g, unknown or other
  misc_feature (191)..(191): n is a, c, g, or t
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
  modified_base (252)..(261): a, c, t, g, unknown or other
  misc_feature (252)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccntgtcactctcgttcccnccctcctctctctcgactctgagcgggctggcaaggcncatagnnnnnnnnnn

SEQ ID NO: 135232 - DNA, 273 bp, Homo sapiens
  misc_feature: GYAE6OF01C8DSM.49.11.A11.1.454.CMB.1.raw
  modified_base (251)..(257): a, c, t, g, unknown or other
  misc_feature (251)..(257): n is a, c, g, or t
  modified_base (259)..(273): a, c, t, g, unknown or other
  misc_feature (259)..(273): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcactctgagcgggctggccaaggcgcatagnnnnnnntnnnnnnnnnnnnnnn

SEQ ID NO: 135233 - DNA, 255 bp, Homo sapiens
  misc_feature: GYAE6OF01CIBKX.49.11.A11.1.454.CMB.1.raw
  modified_base (244)..(244): a, c, t, g, unknown or other
  misc_feature (244)..(244): n is a, c, g, or t
  modified_base (250)..(255): a, c, t, g, unknown or other
  misc_feature (250)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcggctggcaaggcncatagnnnnnn

SEQ ID NO: 135234 - DNA, 265 bp, Homo sapiens; identical to SEQ ID NO: 135184
  misc_feature: GYAE6OF01CSB6P.49.11.A11.1.454.CMB.1.raw
  modified_base (252)..(265): a, c, t, g, unknown or other
  misc_feature (252)..(265): n is a, c, g, or t

SEQ ID NO: 135235 - DNA, 660 bp, Homo sapiens
  misc_feature: GYAE6OF01B6CPI.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctctatgtgctgactcagcccaccctcggtgtcaggtcggcccctggacaggacggccaaggtacttaccgtgggtagggggaaaacacgtagttaggaaagttaacgactggtcgactacgtggtaccagcaaggaacgccgaggccaggcccctgtcgcgtggtcgtctagtggtgagtcggccgaccggccctacggagggtactcccgtgacgcgtatcgtcgtcggctccgaacgtcgtaccgggacccgcctacccgtgaaccagtccgacgggccggtacgaacgggacggggatcggaggaccgtacttagtacgtgtacgtgggtggtaggtagtagggtggtaggttggtgtcgttgttacggcgtcgtacgggaccgtacgggtccgacccgttacgtacggtccaaccggacccgtaaacggcccaaacccgtcgttccgtaccgaccttccgttacccgttcccccacccgttccttacccgttcccttccgacccgtcttccggg

SEQ ID NO: 135236 - DNA, 829 bp, Homo sapiens
  misc_feature: GYAE6OF01EK8TR.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtcgacctcctatgtgctcgactcagccacccgtcggtgtcaggtcggccctggacacggacggccgaaggtacttaaccgtgggtacggggggaaaactacgtaaggttagggaaagttaaacggaccgtggtacgaccacgttcgggtaaccaggaccaaggaaccgccgacggcccgaccgggtcccctggtcgccgttgggtccgttacgtaggttcgggtagtaacggtcgggacccggacccggtcccgtaccggacggggtaccctcccggtaggacgtaccggttacttccgtccgtcgggtacccttaccggtaaaccggttccggtaacccggggaaaccccgtcccgaaccccgtagaaccgtacgtaccggacgggtcccggggtaacggaacgggacgggtgtacgggacgtacccgttaactacgtttacggtcgtacggtagggttcggtacggtaagttacggggttggtacgggttggtcgtttcgggttaccggttcggggaacgtccggggttacggaaccggggcggttaccccggtaccggttacggtacgggtaccctacgggaacccgaccggtaacccccgaaaccgttcgtccggaaccttaccccggttccttcccgggttaccccctccccgttactcccctttagtcccgtcccgtcgttacggg

SEQ ID NO: 135237 - DNA, 295 bp, Homo sapiens
  misc_feature: GYAE6OF01EIW7F.49.11.A11.1.454.CMB.1.raw
  modified_base (192)..(192): a, c, t, g, unknown or other
  misc_feature (192)..(192): n is a, c, g, or t
  modified_base (252)..(295): a, c, t, g, unknown or other
  misc_feature (252)..(295): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctggggaccagggtcaccgtcctaggtcagcccaaggccaaccccntgtcactctgttcccaccctcctctctctcgactctgagcgggctggcaaggcacatagnnnnnnnnnnnnnnnnnnnnnnnnnnnnnnnnnnnnnnnnnnnn

SEQ ID NO: 135238 - DNA, 263 bp, Homo sapiens
  misc_feature: GYAE6OF01EYYB3.49.11.A11.1.454.CMB.1.raw
  modified_base (253)..(263): a, c, t, g, unknown or other
  misc_feature (253)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccatgtcactctcgttcccaccctctctctctcgactctgacgcggctggcaaggcgacatagnnnnnnnnnnn

SEQ ID NO: 135239 - DNA, 263 bp, Homo sapiens
  misc_feature: GYAE6OF01C0QA0.49.11.A11.1.454.CMB.1.raw
  modified_base (253)..(263): a, c, t, g, unknown or other
  misc_feature (253)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaaggccaaccccactgtcactctgttccccaccctcctctctctcgactctgagcgggctggcaaggcgcatagnnnnnnnnnnn

SEQ ID NO: 135240 - DNA, 284 bp, Homo sapiens
  misc_feature: GYAE6OF01CK4P4.49.11.A11.1.454.CMB.1.raw
  modified_base (140)..(140): a, c, t, g, unknown or other
  misc_feature (140)..(140): n is a, c, g, or t
  modified_base (251)..(252): a, c, t, g, unknown or other
  misc_feature (251)..(252): n is a, c, g, or t
  modified_base (254)..(284): a, c, t, g, unknown or other
  misc_feature (254)..(284): n is a, c, g, or t
tcagagtcgagagacacgaccggtgctcgatttagctacgactgcaggggaacccggccaccctgaccatcagccgggtcgaagacggggatgaggccgactattactgtcaggtgtgggatagtggtagtggtgtcgtnttcggagctgggaccagggtcaccgtctaggtcagcccaaggccaaccccatgtcactctcgttcccgcctctctctctcgactctgagcgggctggcaaggcgacatagnngnnnnnnnnnnnnnnnnnnnnnnnnnnnnnnn

SEQ ID NO: 135241 - DNA, 547 bp, Homo sapiens
  misc_feature: GYAE6OF01EQTL7.49.11.A11.1.454.CMB.1.raw
  modified_base (465)..(465): a, c, t, g, unknown or other
  misc_feature (465)..(465): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggccctggacagacggccaggattacctggtgggggaaacacattggaagtaagactgtgcactggtaccagcagaagccaggccaggcccctgtgctggtcgtctatggtgagtggcgaccggccctcgaggggactccctgagcgattctctggctaccaactcgtcgggaacccggccaccctcgaccatcgacggccgggtacgaaggacggggataggaggcccgatattacgtgtcaggtgtggatagtggtagtggtgtcgtcgttcggagcgtgggaccngggtcaccgtcgtaggtcacgcccgaaggcccaaccccgatcgtcacgttctcgttccccgcccttcctctctcctcgctcg

SEQ ID NO: 135242 - DNA, 622 bp, Homo sapiens
  misc_feature: GYAE6OF01ADBBS.49.11.A11.1.454.CMB.1.raw
tcagagtcgagagacacgaccggtgctcgatttagctacgactgcagggcacgaccggtgctcgatttagtcacgcgagaaagggaaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaacatatgcttactcgtaccagcagacggccaggcccacggccccctagtccgtttggtagtatttaagtaaacgtacttttggaggtacggtcccctcgaacgggtaccccctgacgcgtattcctacgtcggcctccgagctacgacgggaacaaccgtagtcctaaccgtcgaacctagtacgacggtcggtacgtcccggaccgaaggaacggaccggaggtccgttacggtaacttaactttacgtaccgtacgtacggtcccgacgaacggaccgaggtaccagggtcggacgtaaggtttacgtcggttacggttaggtccggggtacgggtagggtaacccg

SEQ ID NO: 135243 - DNA, 269 bp, Homo sapiens
  misc_feature: GYAE6OF01EXE7I.49.11.A11.1.454.CMB.1.raw
  modified_base (189)..(189): a, c, t, g, unknown or other
  misc_feature (189)..(189): n is a, c, g, or t
  modified_base (243)..(243): a, c, t, g, unknown or other
  misc_feature (243)..(243): n is a, c, g, or t
  modified_base (249)..(269): a, c, t, g, unknown or other
  misc_feature (249)..(269): n is a, c, g, or t
tcagagtcgagagacacgaccggtgctcgatttagctacgactgcaggggaacccggccaccctgaccatcagccggtcgaagacgggatgaggccgactattactgtcaggtgtggatagtggtagtggtgtcgtcttcggagctgggaccagggtcaccgtcctaggtcagcccaaggccaaccccnctgtcactctgttcccacctctctctctcgactctgagcgggctggacaaggcncatagnnnnnnnnnnnnnnnnnnnnn

SEQ ID NO: 135244 - DNA, 782 bp, Homo sapiens
  misc_feature: GYAE6OF01BPKJR.49.11.A11.1.454.CMB.1.raw
  modified_base (740)..(740): a, c, t, g, unknown or other
  misc_feature (740)..(740): n is a, c, g, or t
tcagagtcgagagacacgaccggtgctcgatttagctacgactgcgagggggggcctaaggaagcagcactggtggtgcctcagccatggcctggaccgttctccctcctcggcctcctctctcactgcacagactctgtgacctcctatgtgctgactcacgccaccctcggtgtcaggtcggcccctggacagaccggccaggactttaccgtgggtagggggaaaacacgtagttagggaaagttaagacgtgtagacacgtacggtaccagacgaaggaacgccgaaggcccaacggtcccctggtcgcgtcggtcgtcgtaggtggtagacgtcggaccggacccggcccgtacgaacgggtcctcccgtaggacggtacggtacttccgtcgtacggtaccttaccgaaccgtcggtacccggggaaccccgacctacccgtacgaccacgtacgaccgggtaccgggtaacgaagggtaccgggagtacggaccgggtaccgtaacgttaacgtttaccggttgtaccggtaagggttaggtagggtaagttacgggttaggggtagtttgggttcggttccggtttacggtacgggtacgacgggttaccggggaacccggttacgggtacccgtaccgggttaccgttaacgggtaccgaaccgtacccgaaaccggccctaaaccccgtagtccggtacctacccgttaccccgttcccgttaacccccncccctttaccgtcccgttacccgtccttcggtccttaccggg

SEQ ID NO: 135245 - DNA, 631 bp, Homo sapiens
  misc_feature: GYAE6OF01AN43Z.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctggtgggggaaacgacagttggaaagtaagactggtgcacgtggtaccagcagaacgccaggccacggcccctgtcgcgtggtcgtctagtggtgagtggccgaccggccctcgaggggactccccgtggacgcgtattccgtcgtcggcctccgaactcgtacggggaaccccgccacccgtgaccatccgagtccgaggtcgaaggacggggatggacggccgagtacttacgtgtcgaggtggtagggattaggtggtagtgggttgtcggttcgtttcgggagtcggttacgggaccgtaggggtcctacccggtccgtacgggtccaacggccccaaacgggcccccaaaccccgcttcggtcctaacccgtccgttccgttacccccaaccccttcccttcctccttccgtaccgtacccg

SEQ ID NO: 135246 - DNA, 256 bp, Homo sapiens; identical to SEQ ID NO: 134845
  misc_feature: GYAE6OF01DCBLD.49.11.A11.1.454.CMB.1.raw
  modified_base (252)..(256): a, c, t, g, unknown or other
  misc_feature (252)..(256): n is a, c, g, or t

SEQ ID NO: 135247 - DNA, 256 bp, Homo sapiens
  misc_feature: GYAE6OF01C548C.49.11.A11.1.454.CMB.1.raw
  modified_base (252)..(256): a, c, t, g, unknown or other
  misc_feature (252)..(256): n is a, c, g, or t
tcagagtcgagagacacgaccggtgctcgatttagctacgactgcagggaacccggccaccctgaccatcagctgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnn

SEQ ID NO: 135248 - DNA, 261 bp, Homo sapiens
  misc_feature: GYAE6OF01ACXQ5.49.11.A11.1.454.CMB.1.raw
  modified_base (252)..(261): a, c, t, g, unknown or other
  misc_feature (252)..(261): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagccccaaggccaaccccactgtcactctgttccccaccctctctctctcgactctgagcggctggcaaggcgcatagnnnnnnnnnn

SEQ ID NO: 135249 - DNA, 269 bp, Homo sapiens
  misc_feature: GYAE6OF01C2HIM.49.11.A11.1.454.CMB.1.raw
  modified_base (253)..(253): a, c, t, g, unknown or other
  misc_feature (253)..(253): n is a, c, g, or t
  modified_base (256)..(269): a, c, t, g, unknown or other
  misc_feature (256)..(269): n is a, c, g, or t
tcagagtcgagagacacgaccggtgctcgatttagctacgactgcagggaacccggccaccctgaccatcagccgggtcgaagacggggatgaggccgactattactgtcaggtgtgggataggtggtagtggtgtcgtcttcggagcgtgggaccagggtcaccgtctaggtcagcccaaggcccaacccatgtcacttctcgttccccaccttccctctctacgactctgagcggcgtggcaacggcgcanagnnnnnnnnnnnnnn

SEQ ID NO: 135250 - DNA, 257 bp, Homo sapiens
  misc_feature: GYAE6OF01AWYJG.49.11.A11.1.454.CMB.1.raw
  modified_base (250)..(257): a, c, t, g, unknown or other
  misc_feature (250)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaagccaacccactgtcactctcgttcccaccctcctctctctcgactctgagcgggctggcaaggcgcatagnnnnnnnn

SEQ ID NO: 135251 - DNA, 258 bp, Homo sapiens
  misc_feature: GYAE6OF01AWXJT.49.11.A11.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctcgttcccaccctcctctctctcgactctgagcgggctggcaaggcgcatagnnnnnnn

SEQ ID NO: 135252 - DNA, 254 bp, Homo sapiens
  misc_feature: GYAE6OF01B1747.49.11.A11.1.454.CMB.1.raw
  modified_base (250)..(254): a, c, t, g, unknown or other
  misc_feature (250)..(254): n is a, c, g, or t
tcagagtcgagagacacgaccggtgctcgatttagctacgactgcggggaacccgccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttccccaccctcctctctctcgactctgagcggctggacaaggcgcatgnnnnn

SEQ ID NO: 135253 - DNA, 255 bp, Homo sapiens
  misc_feature: GYAE6OF01B9AKT.49.11.A11.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnnnn

SEQ ID NO: 135254 - DNA, 776 bp, Homo sapiens
  misc_feature: GYAE6OF01C0QAW.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggccctggacagacggccaggattaccgtggtagggggaaacacagttaggaaagtaagactgtgcagtggtaccagcagaagccgaggccgacggccctgcgcgtcggtcgtcgtagtggtagagtggccgaccggccctacgacgggtactcccgtagacgtcgtacgttccgtcgtcggtaccttaccgtaaaccgttccgggttaacgggggaaaccctacccgggacccccgtaaccccgttacggaacccggttacgaacgggaccggtaacgggggttaccggaaacggggtcccgggggtaattacgggaaccgggtacccgtaacgttaacgttacgttcgttagggtacgaggggttagggtaggggtaattaaggttaggttaggtcggtaccgttccgggtttccggggggttgtccgggggaccgggtaacggggtacgtaaggttcgggtaaccggttcgggttacggtaccgaccggacccggtaacgggtccgtaccccggtcccccgttacggtaccgtacccgttccgttaccccgtttacccctacccccgtttcccttacctcccgttccgtacccgg

SEQ ID NO: 135255 - DNA, 734 bp, Homo sapiens
  misc_feature: GYAE6OF01BVSN0.49.11.A11.1.454.CMB.1.raw
  modified_base (178)..(178): a, c, t, g, unknown or other
  misc_feature (178)..(178): n is a, c, g, or t
  modified_base (236)..(236): a, c, t, g, unknown or other
  misc_feature (236)..(236): n is a, c, g, or t
  modified_base (429)..(429): a, c, t, g, unknown or other
  misc_feature (429)..(429): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtcgacctcctatgtcgcttagactcacgccacccgtcggtntcaggtcggccccgtggacaggaccggccgaggtacttaccgtgggtacggggaaacngagttaggaaataacgactgtgctaacgtggaccagcgaaggaacgccgaaggccacgggtccctggtcgtccgtggtccgtacgtagtcgggtagtacggtcgggaccgaccggtcccgtacggagggtcctcccggagacgtcgttaccttcgacgtcggacctacgtaaccgcggtacccggggaacccnccacccggtgacctacgtccggaacggccgggtaagaacggggacgggtacgtacggcggtaccgtacgttacgttacgtcggtacgtagggttcggtaggtagttacggggttaggttaggttcgggtacgttcggttacggtaggtacggtaccgggttacgggaccggttacgggtacccgtaccgggttacgttaccgggacgtacccgaccgtaacgggcccctaaacccgtcgtaccgacgttaccgttcccgtacccgttccctacccgtccttacctccgttcccgtcgacgtccgg

SEQ ID NO: 135256 - DNA, 262 bp, Homo sapiens
  misc_feature: GYAE6OF01EC45G.49.11.A11.1.454.CMB.1.raw
  modified_base (245)..(245): a, c, t, g, unknown or other
  misc_feature (245)..(245): n is a, c, g, or t
  modified_base (251)..(262): a, c, t, g, unknown or other
  misc_feature (251)..(262): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcggctggcaaggcncatagnnnnnnnnnnnn

SEQ ID NO: 135257 - DNA, 254 bp, Homo sapiens
  misc_feature: GYAE6OF01CVMY4.49.11.A11.1.454.CMB.1.raw
  modified_base (251)..(254): a, c, t, g, unknown or other
  misc_feature (251)..(254): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctcgttcccaccctcctctctctcgactctgagcgggctggcaaggcgcatgnnnn

SEQ ID NO: 135258 - DNA, 861 bp, Homo sapiens
  misc_feature: GYAE6OF01ERBPV.49.11.A11.1.454.CMB.1.raw
  modified_base (101)..(101): a, c, t, g, unknown or other
  misc_feature (101)..(101): n is a, c, g, or t
tcagagtcgagagacacgaccggtgctcgatttagctacgactgcgaggggggcctaaggaagcagcactggtggtgcctcagccatggcctggaccgttntcctcctcggcctcctctctcactgcacagactctgtcgacctctatgtcgtctgactcacgccgaccgtggtgtcagtcggccctggacgacggaccggcgaggtacttaccgtagggtacgggggaaacacgttacggttaagggaacgttaacggacgttcggtacgacgtacggttacggtaacccaaggtacgaacggtaaccgccggtaacggcccgtaaccggtccccgtaggttcggtcgttggtaccgttacttaggtcggtaggtacggtcgggccggacccggtcgtacgggacggtaccgtccgtaggcgtacgttcgttccgtcgccggtaccttaaccgaaccgttccgggaacccggggtaccctcccgtaaccgttacgaccgactaccggggtacggccggggtaagaaccggggtcgggtacggtacggtacccggtaaccttacgtttaacgttcggtacgtacgggttacgggtaggttaacgggtacgtttacgggttacgggttacggttcgggtttacgggttaccggtttccgggtcgggtacgggttacccgggttaacgggggtacccgtcggggttaacccggttaccgggtaccggtacggttaccggaacccggttacccgttaaacccggaccccgtaaccggttcgtacccgttccgtaccgttacccggggtttccctaccccgtcccgttaccttaccgtaccgtttccggtccggttcgtaccggg

SEQ ID NO: 135259 - DNA, 163 bp, Homo sapiens; identical to SEQ ID NO: 134891
  misc_feature: GYAE6OF01CQTO6.49.11.A11.1.454.CMB.1.raw
  modified_base (161)..(163): a, c, t, g, unknown or other
  misc_feature (161)..(163): n is a, c, g, or t

SEQ ID NO: 135260 - DNA, 265 bp, Homo sapiens
  misc_feature: GYAE6OF01AVCPI.49.11.A11.1.454.CMB.1.raw
  modified_base (250)..(265): a, c, t, g, unknown or other
  misc_feature (250)..(265): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggcccaaccccatgtcactctgttcccaccctcctctctctcactctgagcgggctggcaaggcgcatagnnnnnnnnnnnnnnnn

SEQ ID NO: 135261 - DNA, 943 bp, Homo sapiens
  misc_feature: GYAE6OF01D55NL.49.11.A11.1.454.CMB.1.raw
tcagagtcgagagacacgaccggtgctcgatttagctacgactgcaggggggcctaaggaagcagcactggtggtgcctcagccatggcctggaccgttctcctccgtcggcctcctctctcactgcacagactctgtcgacctcgtatgtcgctgacctcacgccctaccgtggtcgtacgacggtccggccctaggaccgacggaccggaccgagggtaacttaccgtggggtaaacgggggaaaccagttaggttagggaaacgttaacgacgttggcgtaccgtacgttagggtaacccagaccgaacggaacgcccggacggacccgtaccggcccccttgggtccgtaccggtttcgggttaccttacgttaaggttgggtacgtacggtccgggacccggtaaccccggtccgtacgggacggtacctcccggtagaccggtacgttacgttccgttacgccggtaccctaccgtaaccggttccgggtaaacccgggaaccccgtacccctacccggtacgaacccgtacggtacccgggaccggtaaccggggttaaccgaaaggggtaccggggtacgtaccggggaaccgggttacccgtaaagtttacggttaccgttacggtacggtacggggttagggtacggtaaggtttacgggttacgggtttaaggtttccgggttaccggttaccggtttaccgtttacggggggactttacccgggggtaacccggaaccggttacccggggttcccgttaaccccgggtttaacggtaccggttaccccgacccgggaaaccccggtaacccggtacccccgaaacccgtttcggttacccgttaccgttaccccggtttcccgttccccggttaacccctcccccgtttaccggtccctttacgttaccccgtcgttacccggttaccggg

SEQ ID NO: 135262 - DNA, 263 bp, Homo sapiens
  misc_feature: GYAE6OF01AZB4Z.49.11.A11.1.454.CMB.1.raw
  modified_base (251)..(263): a, c, t, g, unknown or other
  misc_feature (251)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccatgtcactctgttcccaccctcctctctctcgactctgacgcgggctggcaaggcgcatagnnnnnnnnnnnnn

SEQ ID NO: 135263 - DNA, 785 bp, Homo sapiens
  misc_feature: GYAE6OF01ELS4W.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcacgcccaccctcggtgtcagtcggccctggacaggacggcaggacttaccgtggtacgggggaaacactagttagggaaagtaagacgtggtcgacacgtggaaccagacaagaacgccgaggcccgacggccccgtgtcgcgtggtcgtctagtggtgacgtcgggaccgacccgggtccgtcgaggggtactcccgtggacgtcgtatttccgtcgtcggcctaccgtaactcggtaccgggacccgcctaacccgtcgaccacgtcgacggtccggtacggaaacggacgggtagtacggaacgggtccgtaacgttacttacgtacggtacggtacgggtgggttacgggtaagttaggggttgggtttaacggttgggggtttaccggttaccggtttccggtcggggtaccgtcgggttaccgggggaaaccccggtgggggttaccccgttacccgggttcccgggttacggtacccgaaccggaccccggaaacggacccccccgtaaaaccccgtcgttaccggttaccccgtaaaccgttccccgttacccggtttaccccccccaaccccgttccctttacccgtaccctttacccgtccgtaaccggtttcccgg

SEQ ID NO: 135264 - DNA, 266 bp, Homo sapiens
  misc_feature: GYAE6OF01EDUI5.49.11.A11.1.454.CMB.1.raw
  modified_base (251)..(266): a, c, t, g, unknown or other
  misc_feature (251)..(266): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaaggccaaccccatgtcactctgttcccacctcctctctctcgactctgagcggctggacaaggcacatagnnnnnnnnnnnnnnnn

SEQ ID NO: 135265 - DNA, 254 bp, Homo sapiens; identical to SEQ ID NO: 134822
  misc_feature: GYAE6OF01DLZCP.49.11.A11.1.454.CMB.1.raw
  modified_base (251)..(254): a, c, t, g, unknown or other
  misc_feature (251)..(254): n is a, c, g, or t

SEQ ID NO: 135266 - DNA, 261 bp, Homo sapiens
  misc_feature: GYAE6OF01D3OKF.49.11.A11.1.454.CMB.1.raw
  modified_base (252)..(261): a, c, t, g, unknown or other
  misc_feature (252)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcgtgggaccagggtcaccgtcctaggtcagcccaaggccaacccatgtcactctcgttcccacctcctctctctcgactctgagcgggctggacaaggcacatagnnnnnnnnnn

SEQ ID NO: 135267 - DNA, 275 bp, Homo sapiens
  misc_feature: GYAE6OF01AN0FE.49.11.A11.1.454.CMB.1.raw
  modified_base (251)..(261): a, c, t, g, unknown or other
  misc_feature (251)..(261): n is a, c, g, or t
  modified_base (263)..(275): a, c, t, g, unknown or other
  misc_feature (263)..(275): n is a, c, g, or t
tcagagtcgagagacacgaccggtgctcgatttagctacgactgcagggaacccggccaccctgaccatcagccgggtcgaagacgggggatgaggccgactattactgtcaggtgtgggatagtggtagtggtgtcgtcttcggagctgggaccagggtcaccgtcctaggtcagcccaaggccaaccccatgtcactctgttcccaccctctctctctcgactctgagcgggctggcaaggcgcatagnnnnnnnnnnncnnnnnnnnnnnnn

SEQ ID NO: 135268 - DNA, 166 bp, Homo sapiens
  misc_feature: GYAE6OF01ARRSN.49.11.A11.1.454.CMB.1.raw
  modified_base (161)..(166): a, c, t, g, unknown or other
  misc_feature (161)..(166): n is a, c, g, or t
tcagagtcgagagacacgaccggtgctcgatttagctacgactgcagggagcttactgactaggccggccttaattaaggtcagcctaaggctgccccagcgtcactctgttcccaccctcctctctctcgactctgagcgggctggcaagggcgcatagnnnnnn

SEQ ID NO: 135269 - DNA, 644 bp, Homo sapiens
  misc_feature: GYAE6OF01BRYDN.49.11.A11.1.454.CMB.1.raw
  modified_base (586)..(586): a, c, t, g, unknown or other
  misc_feature (586)..(586): n is a, c, g, or t
  modified_base (615)..(615): a, c, t, g, unknown or other
  misc_feature (615)..(615): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccacccgtggtgtcaggtcggcccctggacacgaccggccaggtacttaccgtgggtacgggggaaacactagttaggaagtaagactgtgcacgtcggtaccagacaagaacgccaacggccgacggtccctggtcgtcgtggtcgtctagtgggtagagtcgggccgacccggcctcgaggactccgtgacgcgtattcgtcgtcgcctaccacgtcgtaccgggacccgcctaccgtagaccacgtccgacgggcggtacgaaagggcgggatcggacggtccgtaacttacgttacgtgtacgtaggtggtaggtagtaggttggtaggttggtcgtccgttcgtacgggagtcggtacgggaccgtacgggtccctaccggttcgtacggtacaccggacccgaacgacccctaacccgngtccgtacctcttccgtccgttacccccnccttccctctaccttcacgtcccgtacgg

SEQ ID NO: 135270 - DNA, 253 bp, Homo sapiens
  misc_feature: GYAE6OF01BOFY3.49.11.A11.1.454.CMB.1.raw
  modified_base (251)..(253): a, c, t, g, unknown or other
  misc_feature (251)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccgccctcctctctctcgactctgacgcgggctggcaaggcgcatgnnn

SEQ ID NO: 135271 - DNA, 256 bp, Homo sapiens; identical to SEQ ID NO: 134845
  misc_feature: GYAE6OF01A1TGA.49.11.A11.1.454.CMB.1.raw
  modified_base (252)..(256): a, c, t, g, unknown or other
  misc_feature (252)..(256): n is a, c, g, or t

SEQ ID NO: 135272 - DNA, 261 bp, Homo sapiens
  misc_feature: GYAE6OF01BKZZS.49.11.A11.1.454.CMB.1.raw
  modified_base (252)..(261): a, c, t, g, unknown or other
  misc_feature (252)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctcgttcccgcctcctctctctcgactctgagcgggctggcaaggcgcatagnnnnnnnnnn

SEQ ID NO: 135273 - DNA, 262 bp, Homo sapiens
  misc_feature: GYAE6OF01BH1BB.49.11.A11.1.454.CMB.1.raw
  modified_base (240)..(240): a, c, t, g, unknown or other
  misc_feature (240)..(240): n is a, c, g, or t
  modified_base (247)..(262): a, c, t, g, unknown or other
  misc_feature (247)..(262): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcgtgggaccagggtcaccgtctaggtcagcccaagccaacccatgcactctgttcccaccctctctctctcgactctgagcggctggcaaggcncagtagnnnnnnnnnnnnnnnn

SEQ ID NO: 135274 - DNA, 256 bp, Homo sapiens; identical to SEQ ID NO: 135005
  misc_feature: GYAE6OF01CTEF1.49.11.A11.1.454.CMB.1.raw
  modified_base (251)..(256): a, c, t, g, unknown or other
  misc_feature (251)..(256): n is a, c, g, or t

SEQ ID NO: 135275 - DNA, 256 bp, Homo sapiens; identical to SEQ ID NO: 134845
  misc_feature: GYAE6OF01BWLTE.49.11.A11.1.454.CMB.1.raw
  modified_base (252)..(256): a, c, t, g, unknown or other
  misc_feature (252)..(256): n is a, c, g, or t

SEQ ID NO: 135276 - DNA, 258 bp, Homo sapiens; identical to SEQ ID NO: 134826
  misc_feature: GYAE6OF01BYAKF.49.11.A11.1.454.CMB.1.raw
  modified_base (252)..(258): a, c, t, g, unknown or other
  misc_feature (252)..(258): n is a, c, g, or t

SEQ ID NO: 135277 - DNA, 262 bp, Homo sapiens
  misc_feature: GYAE6OF01EC49F.49.11.A11.1.454.CMB.1.raw
  modified_base (253)..(262): a, c, t, g, unknown or other
  misc_feature (253)..(262): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctcgttcccgccctcctctctctcgactctgagcgggctggacaaggcgcatagnnnnnnnnnn

SEQ ID NO: 135278 - DNA, 777 bp, Homo sapiens
  misc_feature: GYAE6OF01BPVWB.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcagcccaccctcggtgtcagtcggcccctggacaggacggccaggtacttaccgtggtaggggggaaaacacgtagttagggaaagtaagactggtgacacgtggtaccagacaagaacgccgacggccacggcccctggtcgcgtggtcgtctagtggtgagtcgggccggacccggccctggacgggtacctcccgtgacgtcgtacttctcgtcggcctaccaaccgtcggtaccggggaccccgaccctaccccgtcgacctacgtaccgacgggtcccggggtaacggaaacggggacggggtacgtcgggaacggtacccgtaacgttaacgttaccgtcggtacggtagggttgggtaggggtaagttagggttgggttaggttgggttcggttcgttcgggttcgggacgtcggtacggggtaccgtacggggttacccgtacccggttccggtacgggtaccgaaccgggaccccgtaaccgggacccccctaaaaccccgtcgttaccggtaccccgttaaccgttccccggtttaccccggttcccccccgtccccctttccccgttaccccgtttcccgttcccgttccccggtaacccgttccggg

SEQ ID NO: 135279 - DNA, 268 bp, Homo sapiens
  misc_feature: GYAE6OF01EJB6C.49.11.A11.1.454.CMB.1.raw
  modified_base (258)..(268): a, c, t, g, unknown or other
  misc_feature (258)..(268): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccactgtcactctcgtcccacctcctctctctcgactcgtagcggcggcgtcggacgaggccgacatgnnnnnnnnnnn

SEQ ID NO: 135280 - DNA, 988 bp, Homo sapiens
  misc_feature: GYAE6OF01DK0T4.49.11.A11.1.454.CMB.1.raw
tcagagtcgagagacacgaccggtgctcgatttagctacgactgcgagggggggcctaaaggaagcagcactggtggtgcctcagccatggcctggaccgttctcctcctcggcctcctctctcactgcacagactctgtcgacctctatgtgctgactcacgcccacccgtcggtcgtacaggtccggccccgtggaccgaggaccggccaaggtactttaccgtgggtacgggggaaacacgtagttaggaaagtaagtactgtgctacgtacggtaccagcaaggaacgcccgacgggcccaccgggtccccctggtcggtcgtcgggttcctcgttaggtgggtacgacgttcgggcccggacccggcccgttacggacgggtacctccccggtagacggtcgtacttccgtcgtcggtcctacccgaacgtccgggtaaccggggaaccccgtccctaaccgtcgaaccgtacgaccggtaccggggtacccggggtaacggaaacggggtaccgggggtaagtaccggggaccgggtaacccgtaaccggttttaaacgttaccgggttaccgggttaacggggttaacggggtttacgggggttaacggggttaacggtttaagggggtttacgggggtttaacgggttcgggggtttacgttttcccggggtttaccgggtttacggggggtacgggtttacccggggttacggggggtaaccccggttaccggggggttaccccctaacccgggggttttcccggttaaacgggtacccggtaaaccccggggtaaccccccgtaaaaccggggtaccccccccgttaaaacccccgggttaccgtttacccgggtacccccggtttaaccccgtttcccccggggttacccccggttttccccccccgtaccccgttttaacccccgtacccgtttaccccgtttccccggttaacccggtacccgttaccccggggg

SEQ ID NO: 135281 - DNA, 261 bp, Homo sapiens
  misc_feature: GYAE6OF01BHSCE.49.11.A11.1.454.CMB.1.raw
  modified_base (253)..(261): a, c, t, g, unknown or other
  misc_feature (253)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccactgtcactctgttcccaccctcctctctctcgactctgagcgggctggcaaggcgcatagnnnnnnnnn

SEQ ID NO: 135282 - DNA, 864 bp, Homo sapiens
  misc_feature: GYAE6OF01AXKGD.49.11.A11.1.454.CMB.1.raw
  modified_base (130)..(130): a, c, t, g, unknown or other
  misc_feature (130)..(130): n is a, c, g, or t
  modified_base (175)..(175): a, c, t, g, unknown or other
  misc_feature (175)..(175): n is a, c, g, or t
tcagagtcgagagacacgaccggtgctcgatttagctacgactgcagggggggccgtaaggaagcagcactggtggtgcctcagccatggcctggaccgttctcctcctcggcctcctctctcactgcanacgactctgtgacctcctatgtgctagactcagccaccctcggtntcagttcggcccctggacagaccggccagggacttacccgtgggtaggggggaaaaccactagtttagggaaagtaaacggaccgttggttaggacctacgttacggaacccaaggccaaaggaacggccaacgggcccaacgggcccccttagggtcgcgttcggggttccgttactacggttgggtaggacggtcgggtacccggaccccggtaccctggaaagggtacctcccgtagacgtcgtattccgtcgtacggcctaccaacgtcggtacggggaaccccgtccaacccgtgaccctagtccggaacgggtcccgggtaacgtacggggaacgggtacgtcgggaacggacccgtaacgttaacgtttaccgtaggtaaccggtagggtacgggttacggggtaatttacgggttagggttaggtcgggtttggttaccgggtttcgggtaccgggtacggtccgggttaaccgggggaacccgtaggggtttacccgtacccggtttcgaaccggggttcgaaaccccgggtccccgggtaaaccggggtacccccctaaaacccccggtcggtttaccggaccccgtttacccttacccgggtttcccccgttaccccggtccccccctttccgttaccccgtttaccttaccccggtttaccccggtacgtccccggg

SEQ ID NO: 135283 - DNA, 258 bp, Homo sapiens
  misc_feature: GYAE6OF01AGYL0.49.11.A11.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctctctctctcgactctgacgcgggctggcaaggcgcatagnnnnnnn

SEQ ID NO: 135284 - DNA, 264 bp, Homo sapiens
  misc_feature: GYAE6OF01D5486.49.11.A11.1.454.CMB.1.raw
  modified_base (147)..(147): a, c, t, g, unknown or other
  misc_feature (147)..(147): n is a, c, g, or t
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (256)..(264): a, c, t, g, unknown or other
  misc_feature (256)..(264): n is a, c, g, or t
tcagagtcgagagacacgaccggtgctcgatttagctacgactgcgggaacccggccaccctgaccatcagccgggtcgaagacggggatgaggccgactattactgtcaggtggtgggatagtggtagtggtgtcgtcttcgggancgtgggacagggtccaccgtctaggtcagcccaaggccaacccntgtcactctcgtcccacctctctcgtcncgactcgngacggcggtctggacaagggctacagtgnnnnnnnnn

SEQ ID NO: 135285 - DNA, 265 bp, Homo sapiens
  misc_feature: GYAE6OF01A9DXI.49.11.A11.1.454.CMB.1.raw
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (257)..(265): a, c, t, g, unknown or other
  misc_feature (257)..(265): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcccctctctctctcnctcngcggcggcgtcggacgacggcgactagagnnnnnnnnn

SEQ ID NO: 135286 - DNA, 697 bp, Homo sapiens
  misc_feature: GYAE6OF01BZRT1.49.11.A11.1.454.CMB.1.raw
tcagagtcgagagacacgaccggtgctcgatttagctacgactgcgagggggggcctaaggaagcagcactggtggtgcctcagccatggcctggaccgttctcctcctcggcctcctctctcactgcacagactctgtgacctctatgtgctgactcagcccaccctggtgtcagtcggccctggacaggaccggccaggtacttaccgtgggtagggggaaacactagttagggaaagtaagactgtgctacgtcggtaccagcaagaacgccgaggccacggcccctggtcgcgtggtcgtctagtggtagagtcgggaccgacccggtcctacggacgggtacctcccgtggacgcgtacttccgtcgtcggcctaccgtaaccgtcggtaacccggggaaccccgcctaacccgtcgaaccctagtccggaacggggtcccggggtaacggaaacggggaccggggtagtacgggaccggtaccgtaacttacgttacgtcggtacggtagggtcggtaggtagttagggtggtaggtggtcgttcgtcggtggacgtcggtacgggaccgtacgggtaccgtaccggttacgtaggaccgaccggacccggtaaccggccccaaaccccgtgtaccgtacctaccgttccgtcccgtccccgtcccttccgtctcctccgtcgtccttcgg

SEQ ID NO: 135287 - DNA, 266 bp, Homo sapiens
  misc_feature: GYAE6OF01BRAJL.49.11.A11.1.454.CMB.1.raw
  modified_base (252)..(266): a, c, t, g, unknown or other
  misc_feature (252)..(266): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaagccaaccccatgtcactctcgttcccaccctcctctctctcgactctgagcgggctggcaaggcgcagtagnnnnnnnnnnnnnnn

SEQ ID NO: 135288 - DNA, 274 bp, Homo sapiens
  misc_feature: GYAE6OF01BQWCI.49.11.A11.1.454.CMB.1.raw
  modified_base (250)..(250): a, c, t, g, unknown or other
  misc_feature (250)..(250): n is a, c, g, or t
  modified_base (255)..(274): a, c, t, g, unknown or other
  misc_feature (255)..(274): n is a, c, g, or t
tcagagtcgagagacacgaccggtgctcgatttagctacgactgcaggggaacccggccaccctgaccatcagccgggtcgaagacgggatgagccgactattactgtcaggtgtgggatagtggtagtcggtgtcggtcgttcggagctgggaccagggtcaccgtcctaggtcagcccaaggccaaaccccactgtcactctcgttcccgccctccgtctctctcgactctgagcggctggcaaggcncatgnnnnnnnnnnnnnnnnnnnn

SEQ ID NO: 135289 - DNA, 308 bp, Homo sapiens
  misc_feature: GYAE6OF01ELJ6T.49.11.A11.1.454.CMB.1.raw
  modified_base (257)..(259): a, c, t, g, unknown or other
  misc_feature (257)..(259): n is a, c, g, or t
  modified_base (262)..(308): a, c, t, g, unknown or other
  misc_feature (262)..(308): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccatgtcactctcgttcccaccctcctctctctcactctgagccgggctggacaaggcgccaagtagnnnctnnnnnnnnnnnnnnnnnnnnnnnnnnnnnnnnnnnnnnnnnnnnnnn

SEQ ID NO: 135290 - DNA, 256 bp, Homo sapiens; identical to SEQ ID NO: 134845
  misc_feature: GYAE6OF01D7H9H.49.11.A11.1.454.CMB.1.raw
  modified_base (252)..(256): a, c, t, g, unknown or other
  misc_feature (252)..(256): n is a, c, g, or t

SEQ ID NO: 135291 - DNA, 266 bp, Homo sapiens
  misc_feature: GYAE6OF01BWAKL.49.11.A11.1.454.CMB.1.raw
  modified_base (249)..(266): a, c, t, g, unknown or other
  misc_feature (249)..(266): n is a, c, g, or t
tcagagtcgagagacacgaccggtgctcgatttagctacgactgcaggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccatgtcactctgttcccacctcctctctctcactctgagcgggctggacaggcgcatagnnnnnnnnnnnnnnnnnn

SEQ ID NO: 135292 - DNA, 716 bp, Homo sapiens
  misc_feature: GYAE6OF01EJSKZ.49.11.A11.1.454.CMB.1.raw
  modified_base (172)..(172): a, c, t, g, unknown or other
  misc_feature (172)..(172): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccacccgtggtntcaggtcggcccctggacaggaccggccaggtacttaccgtgggtacgggggaaaacactagttaggaaagtaaacgactggtgcacgtgggtaaccagacgagaacgccgacggccacggccccctgtcgcgtggtcgtctagtggtgagtcggccggaccggtccgtcgacgggcctccgtagacgcgtacttccgtcgtcggtcctaccgaacgtccggtacggggaacccccgtcccaccccgtacgaacccgtacgtacccggacgggacccggggtaacgaaacgggaccgggggtagtagggtaaccgggtacccgtaacgtttaacgtttaccgtggttaccggtagggttggtaggggtacgttagggttagggtagggttgggttaccgttcggttccggttacggggacgtcggtaggggacccggtagggtcccgaccggttcgtacgtacgaccgtaccgacggacccaaccctacgtctacgtactccgtaccgttcccccaccgttccctactccttccgtcgcctcgg

SEQ ID NO: 135293 - DNA, 258 bp, Homo sapiens
  misc_feature: GYAE6OF01BT47S.49.11.A11.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctcgttcccaccctctctctctcgactctgagcgggctggcaaggcgacatagnnnnnnn

SEQ ID NO: 135294 - DNA, 257 bp, Homo sapiens
  misc_feature: GYAE6OF01C4ZPR.49.11.A11.1.454.CMB.1.raw
  modified_base (253)..(257): a, c, t, g, unknown or other
  misc_feature (253)..(257): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggcccaacccatgtcactctcgttcccgccctcctctctctcgactctgagcgggctggacaaggcgcatagnnnnn

SEQ ID NO: 135295 - DNA, 730 bp, Homo sapiens
  misc_feature: GYAE6OF01BTOPS.49.11.A11.1.454.CMB.1.raw
  modified_base (368)..(368): a, c, t, g, unknown or other
  misc_feature (368)..(368): n is a, c, g, or t
tcagagtcgagagacacgaccggtgctcgatttagctacgactgcgagggggggcctaaggaagcagcactggtggtgcctcagccatggcctggaccgttctcctccgtcggcctcctctctcactgcacagactctgtcgacctcctatgtgctgactcacgccacccgtcggtgtcaggtcggcccctaggacacggaccggccgaggtacttaccgtgggtacgggggaaacacagttaggaaagtaacgactggtagacacgtaggaaccagacaaggaacgccgacggccgacggcccctggtcgtcgtggtcgtctagtggtgagtcggccgaccggtcctggaggtacctcccgtagganccgtattccgcgtacggcctacaacgtcggacggaacccgcctaccacgacacgtcgacggaccggtagaagggacgggatcggacgaccgtactacgttactggtacgtagggtagggtagggtaactagggttagggttagggttaggtcggttacggttcggttacgggacgtccgggtacggggtaaccgtacggggttaccctaacccgggtttcgtaaacgggtccgtaaccgaaccccgggaaacccgtacccccgtaaaccccgtcgttaccgtcccgttaaccgtttcccggtccccgtttacccccgaccccttcccttccgtaacccttcggtacccgtaccggttccggg

SEQ ID NO: 135296 - DNA, 266 bp, Homo sapiens
  misc_feature: GYAE6OF01CAKFV.49.11.A11.1.454.CMB.1.raw
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (255)..(266): a, c, t, g, unknown or other
  misc_feature (255)..(266): n is a, c, g, or t
tcagagtcgagagacacgaccggtgctcgatttagctacgactgcagggaacccggccaccctgaccatcagccgggtcgaagacggggatgaggccgactattactgtcaggtgtggatagtggtagtggtgtcgtcttcggagcgtgggaccagggtccaccgtcctaggtcagcccaaaggccaaccccactgtcactcctgttcccaccctcctctctctcgactctgagcgggcnggcaaggcncatagnnnnnnnnnnnn

SEQ ID NO: 135297 - DNA, 804 bp, Homo sapiens
  misc_feature: GYAE6OF01C5JUB.49.11.A11.1.454.CMB.1.raw
  modified_base (172)..(172): a, c, t, g, unknown or other
  misc_feature (172)..(172): n is a, c, g, or t
  modified_base (176)..(176): a, c, t, g, unknown or other
  misc_feature (176)..(176): n is a, c, g, or t
  modified_base (744)..(744): a, c, t, g, unknown or other
  misc_feature (744)..(744): n is a, c, g, or t
tcagagtcgagagacacgaccggtgctcgatttagctacgactgcgagggggggcctaaggaagcagcactggtggtgcctcagccatggcctggaccgttctcctcctcggcctcctctctcactgcacagactctgtcacctctatgtgctgactcagtccacccgtggntacngtcggccctaggacacggacggcctaaggtactttaccgtaggggtaacgggggaaaaccacgttaaggtttagggaaaagtttaaacggccgtttggcggaccttaacggtcggggtaaacccagacgaaggaaacggccgaacgggtcccgaaccggggcccccttaggttaccggtcggtttacgggttccggttcttaacggttcgggttaggaacgtttcggggacccggaaccccggtcccgttacggaacggggtccttccccgtggaaaccgtccggtaactttccggtcgttacgggaccctttaccaaaccggtcgggttaaacccggggaacccggtccctaacccgtcggaaccagtaccgacgggtccgggtaacgaaaggggtcggagtacgggacggtacctaacgttaacgttcgttaggtacgaggtttagggaggttagttagggttcggtaggtggtcggttcgttacggtcgggaagtcggtacgggacccggtagtccgttaccggcgttaacggtcgaaccggtaccgaaccggaccccaaccgtntccggtacctacggttccaacccggttcccacctttccgccgttacctctctaccggtcg

SEQ ID NO: 135298 - DNA, 256 bp, Homo sapiens
  misc_feature: GYAE6OF01D44RM.49.11.A11.1.454.CMB.1.raw
  modified_base (251)..(256): a, c, t, g, unknown or other
  misc_feature (251)..(256): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccgccctcctctctctcgactctgagcgggctggcaaggcgcatagnnnnnn

SEQ ID NO: 135299 - DNA, 304 bp, Homo sapiens
  misc_feature: GYAE6OF01CN6VK.49.11.A11.1.454.CMB.1.raw
  modified_base (254)..(254): a, c, t, g, unknown or other
  misc_feature (254)..(254): n is a, c, g, or t
  modified_base (259)..(260): a, c, t, g, unknown or other
  misc_feature (259)..(260): n is a, c, g, or t
  modified_base (262)..(304): a, c, t, g, unknown or other
  misc_feature (262)..(304): n is a, c, g, or t
tcagagtcgagagacacgaccggtgctcgatttagctacgactgcagggaacccggccaacccgtgaccatcagccgggtccgaagacgggggatgaggccgactatttactgtcaggtgtgggatagtggtagtggtgtctcgttcggagctgggaccagggttcaccgtcctaggtcagtcccaaggcctaacccatgtcactctggttcccgccctcctctctcgtcggactctgagcggctggcaaggcnatagnntnnnnnnnnnnnnnnnnnnnnnnnnnnnnnnnnnnnnnnnnnnn

SEQ ID NO: 135300 - DNA, 253 bp, Homo sapiens
  misc_feature: GYAE6OF01BCY2Y.49.11.A11.1.454.CMB.1.raw
  modified_base (250)..(253): a, c, t, g, unknown or other
  misc_feature (250)..(253): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccgcctcctctctctcgactctgagcgggctggcaaggcgcatagnnnn

SEQ ID NO: 135301 - DNA, 906 bp, Homo sapiens
  misc_feature: GYAE6OF01C9C1G.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctggtgtcagtcggcccctggacacggacggccagggacttaccgtggtacgggggaaaacactagtttagggaaagttaagacgtggtcgctacgtggtaccaggacaaggaacgacccgaagggcccaacgggtcccccttaggtcggtccgttggggttaccgttacgttaagttcggggtaggtaacggttcggggacccggtaacccgggtccccttacggaacgggggtaacttccccggttaaggacggtaccggtactttccgttaccgtcgggaccttacccgaaaccgtttccggttaacccgggggaaacccccggccctaaccccggttcggaaccctacgttaccggacgggtccccgggggttaacggaaacggggtacgggggaagttaccggggaaccgggtacccggtaacgtttaacgtttaacggtcggttaccggtaaggggttacgggtagggggtaagttagggttacggggttaagttcggggttacggttaccgggtttcggtttacggggaggttccgggttacggggtaaccggtacggggttacccgaccggtttacccggttacgggtaccgtaaccgggaacccccgtaaacgggacccccctaaaccccgtacgttccgggttaaccctaccggttcccgtttacccggtttacccccctaaccccgttcccttacccgtttccgttacccgtccgtaacccgttcccggg

SEQ ID NO: 135302 - DNA, 286 bp, Homo sapiens
  misc_feature: GYAE6OF01C7RZ9.49.11.A11.1.454.CMB.1.raw
  modified_base (257)..(286): a, c, t, g, unknown or other
  misc_feature (257)..(286): n is a, c, g, or t
tcagagtcgagagacacgaccggtgctcgatttagctacgactgcagggaacccggccaccctgaccatcagccggggtcgaaggacggggatgaggccgactattactgtcaggtgtgggataggtggtagtggtgtcgtcttcggagcgtgggaccagggtcaccgtcctaggtcagcccaagcccaaccccatgtcactctgttccccaccctcctctctctcgactctgagcgggctggacaagcgacatagnnnnnnnnnnnnnnnnnnnnnnnnnnnnnn

SEQ ID NO: 135303 - DNA, 841 bp, Homo sapiens
  misc_feature: GYAE6OF01BUP7Z.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctctatgtgctgactcacgcccacccgtcggtgtcaggtcggccctggacagaccggccaggattaccgtggtagggggaaacgacagttagggaaagtaagacgtgtcgccacgttcggtaccagcaaggaacgccagggcccacggtcccctggtgcgtcggttcgtctagtgggtagacgtcgggaccggacccggtcccgtacggacggggtactcccgtagacggtcgtactttcgtcgtcggtacctaccaacgtccggtacccggggaaccccgccctacccgtcgacctacgtacccggacgggtacccggggtaacggtaaacggggaccggggtatacgggacgggtaccccgtaaagtttacgtttacccgttaggtaccggtaggggtttagggtcggggtttaagttaggggttacgggtttacggggtttcggggtttacccgggtttcggtttcccgggttaccggggttacggtccgggttaccgggggaaacccgggtaccggggttacccgtaaccccgggttcccggggtttaacgggacccggaccccggtaaacccggaaccccggtaccccaaaccccgttcggttacccgttacccgttacttaccccgtttcccgttaacccccccacccccgtttccgttccccttcccgtacccgttaccggtacccgttcggg

SEQ ID NO: 135304 - DNA, 273 bp, Homo sapiens
  misc_feature: GYAE6OF01C4E7S.49.11.A11.1.454.CMB.1.raw
  modified_base (243)..(243): a, c, t, g, unknown or other
  misc_feature (243)..(243): n is a, c, g, or t
  modified_base (250)..(273): a, c, t, g, unknown or other
  misc_feature (250)..(273): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccacctctctctctcgactctgagcggctggcaaggcncaatgcnnnnnnnnnnnnnnnnnnnnnnnn

SEQ ID NO: 135305 - DNA, 789 bp, Homo sapiens
  misc_feature: GYAE6OF01B37QQ.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctctatgtgctgactcacgccctacccgtcggtgtcgaggtccggcccctggaccacggaccggccagggtacttaccgtgggtagggggaaacacagttagggaaagtaacgtactggtgcctacgtcgggtaccagcaaggaacgccgacggcccgaccggccccgttgtcggtcgttgggtcgttcgttagtgggtagacggttcgggccgaccccgggtcctacggacgggtacctcccgtaggacgcgttacttcctcgtcggcctaccgaacgttccggacgggaacccccgccacccgtcgaaccgtagtccgacgggtcccggggtaacgaacgggtacgggacgtacggacggtacccgtaacttacgttacggttcggtacggtaggggttggtacggggtagttagggttggggtagttgggttcggttcggttccggttcgggtagtcgggtacggggtaccggtaccggggttcccgtacccgggttccggtacgggtaccgaacccggtaaccccggaccgggaacccccaaaccccggttacggtcccgttaccgtaccgttcccgttccccgggtttaccccctcccccgtttcccttacccgttccctttccgttacccggttctaccggg

SEQ ID NO: 135306 - DNA, 259 bp, Homo sapiens
  misc_feature: GYAE6OF01BC3HP.49.11.A11.1.454.CMB.1.raw
  modified_base (252)..(259): a, c, t, g, unknown or other
  misc_feature (252)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaaggccaaccccatgtcactctgttcccgccctcctctctctcgactctgagcgggctggcaaggcgcatagnnnnnnnn

SEQ ID NO: 135307 - DNA, 306 bp, Homo sapiens
  misc_feature: GYAE6OF01CGWLR.49.11.A11.1.454.CMB.1.raw
  modified_base (136)..(136): a, c, t, g, unknown or other
  misc_feature (136)..(136): n is a, c, g, or t
  modified_base (141)..(141): a, c, t, g, unknown or other
  misc_feature (141)..(141): n is a, c, g, or t
  modified_base (193)..(193): a, c, t, g, unknown or other
  misc_feature (193)..(193): n is a, c, g, or t
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (260)..(261): a, c, t, g, unknown or other
  misc_feature (260)..(261): n is a, c, g, or t
  modified_base (263)..(306): a, c, t, g, unknown or other
  misc_feature (263)..(306): n is a, c, g, or t
tcagagtcgagagacacgaccggtgctcgatttagctacgactgcgaggggaacccggccaccctgaccatcagccgggtcgaagacggggatgaggccgactattactgtcaggtgtgggatagtggtagtggtntcgtnttcggagcgtgggaccagggttcaccgtctaggtcagcccaagcccaacccntgtaccactctgttccccncctctctctctcactcnggacggccggacnggcgaaggtcactagtgnngnnnnnnnnnnnnnnnnnnnnnnnnnnnnnnnnnnnnnnnnnnnn

SEQ ID NO: 135308 - DNA, 279 bp, Homo sapiens
  misc_feature: GYAE6OF01DVO55.49.11.A11.1.454.CMB.1.raw
  modified_base (188)..(188): a, c, t, g, unknown or other
  misc_feature (188)..(188): n is a, c, g, or t
  modified_base (254)..(255): a, c, t, g, unknown or other
  misc_feature (254)..(255): n is a, c, g, or t
  modified_base (257)..(279): a, c, t, g, unknown or other
  misc_feature (257)..(279): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagccaaggccaacccntgcactctcgttcccacctctctctcgtcgctcgtgacgcgggtctggacaaggccgtacagtagnnannnnnnnnnnnnnnnnnnnnnnn

SEQ ID NO: 135309 - DNA, 263 bp, Homo sapiens
  misc_feature: GYAE6OF01EOMDB.49.11.A11.1.454.CMB.1.raw
  modified_base (139)..(139): a, c, t, g, unknown or other
  misc_feature (139)..(139): n is a, c, g, or t
  modified_base (253)..(263): a, c, t, g, unknown or other
  misc_feature (253)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtnttcggagctgggaccagggtcaccgtcctaggtcagcccaaggccaaccccatgtcacctctgttcccaccctcctctctctcgactctgagcgggctggcaaggcgcagtagnnnnnnnnnnn

SEQ ID NO: 135310 - DNA, 546 bp, Homo sapiens
  misc_feature: GYAE6OF01E3LRN.49.11.A11.1.454.CMB.1.raw
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
  modified_base (543)..(543): a, c, t, g, unknown or other
  misc_feature (543)..(543): n is a, c, g, or t
tcagagtcgagagacacgaccggtgctcgatttagctacgactgctagggtaacccgggccaccctgaccgatccagccgggttcgaagtacggggatgaaggccgagtattacctggtctaggtgtgggactaggtggtagtggtgtcgtcttcggaggcctgggaccagggtcgaccggtccttaggtcagcccaaggcccaaccccactcgtcactctcgttcccgccctcctctctctcgacctctcgagcgggctggcaaggcgtacaacgtagcngangntcgnanagtctngatgntgnagcctncggtnacgctcgngctatntagtcgttgaccgtngtacgnagtanctgcacgngtgngcgnancgtntgtactcatacgtagtactacgagtagaggtagngtggtagtagtgtagtagtatacgtanacgtagatacgtatactacgtacgtcgtcgtcgtacgtacgtacgtacggtacgtacgagtacgtactatacgtacgtacgtgcgtacgacgtacactacgtntcg

SEQ ID NO: 135311 - DNA, 263 bp, Homo sapiens
  misc_feature: GYAE6OF01AVT45.49.11.A11.1.454.CMB.1.raw
  modified_base (247)..(247): a, c, t, g, unknown or other
  misc_feature (247)..(247): n is a, c, g, or t
  modified_base (253)..(263): a, c, t, g, unknown or other
  misc_feature (253)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcgtgggaccagggtcaccgtctaggtcacgcccaaggcccaaccccatgtcactctcgttcccgcctcctctctctcgactctgagcgggctggacaggcncatagnnnnnnnnnnn

SEQ ID NO: 135312 - DNA, 772 bp, Homo sapiens
  misc_feature: GYAE6OF01BVEK5.49.11.A11.1.454.CMB.1.raw
tcagagtcgagagacacgaccggtgctcgatttagctacgactgcgagggggggcctaaaggaagcagcactggtggtgcctcagccatggcctggaccgttctcctcctcggcctcctctctcactgcacagactctgtgaccttcctatgtgctgactcacgccctacccgtcggtgtcaggtcggcccctggacacggaccggccaaggtactttaccgtgggtacgggggaaacacgtaagttagggaaagttaagacttggtcgactaccgtaggtaccaggacaaggaacgccgaacggcccacggccctggtcgcgtggtcgtctagtggtgagtcggaccggacccggtcctcggaacgggtcctcccggtaggacgcgttacttccgtacggtcggtcctaccgtaaccgttccggtacccggggaaccccgccctaaccccgtcgacctaacgtccggacgggtacccgggtacggaaacgggtacggggtatacgggaccgtaccgtaacgtttaagtttaccggtggttacggagggttcggtagggtaagttagggttggttaggttcgggttcgttcggtttcgtcgggacggtcggtacgggtaaccgtcggggtaccctaaccggttccggtaaggtacccaaccggaccccggaacggtaccccccaacccgtcgtaccgttccctacgtttccccggttccccgttcccccgtaccccttcccttccgttaccctccttcccggtactccgggg

SEQ ID NO: 135313 - DNA, 486 bp, Homo sapiens
  misc_feature: GYAE6OF01EMG6I.49.11.A11.1.454.CMB.1.raw
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (289)..(290): a, c, t, g, unknown or other
  misc_feature (289)..(290): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (300)..(301): a, c, t, g, unknown or other
  misc_feature (300)..(301): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
tcagagtcgagagacacgaccggtgctcgattttagctacgactgcgaggggaacccggccaccctgaccatcaggccgggtcgaaggacggggatggacggccgactattactgtcaggtgtgggatagtggtagtggtgtcgtgttcggagcgtgggaccagggtccaccgtctaggcacgccaaggcccaacccntgcnctctccgtccacctctctctcncagtcgaggacggcggctgacgaacggtcactaagtgcagncagatcanttcgcngacgaccgtnnacngacntgnntcgngttngtngcngagttncagcgngtttanagttccngnaccgntttcncggtacnggacagacnaacnctnatcagctagctancgtanagacgtangtantgcagtnaccngatcagtacgtnacganacgacngagagttcacgcttgtacgtgacttagngtaccganctagcgtcgcc

SEQ ID NO: 135314 - DNA, 302 bp, Homo sapiens
  misc_feature: GYAE6OF01D012B.49.11.A11.1.454.CMB.1.raw
  modified_base (195)..(195): a, c, t, g, unknown or other
  misc_feature (195)..(195): n is a, c, g, or t
  modified_base (262)..(262): a, c, t, g, unknown or other
  misc_feature (262)..(262): n is a, c, g, or t
  modified_base (264)..(265): a, c, t, g, unknown or other
  misc_feature (264)..(265): n is a, c, g, or t
  modified_base (269)..(302): a, c, t, g, unknown or other
  misc_feature (269)..(302): n is a, c, g, or t
tcagagtcgagagacacgaccggtgctcgatttagctacgactgcaggggaacccggccaccctgaccatcagccgggtcgaagacggggatgaggccgactattactgtcaggtgtgggatagtggtagtggtgtcgtcgtcggagcgtgggaccagggtcaccgtcctaggtcacgcccgaaggccaaccccntgtcactctcgttcccgcctcctctctctacgactctggagcgggctggacaaggtccactagtgcnannagcnnnnnnnnnnnnnnnnnnnnnnnnnnnnnnnnnn

SEQ ID NO: 135315 - DNA, 250 bp, Homo sapiens
  misc_feature: GYAE6OF01CZI6W.49.11.A11.1.454.CMB.1.raw
  modified_base (240)..(240): a, c, t, g, unknown or other
  misc_feature (240)..(240): n is a, c, g, or t
  modified_base (246)..(250): a, c, t, g, unknown or other
  misc_feature (246)..(250): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctggaccagggtcaccgtcctaggtcagcccaaggccaaccccatgtcactctgttcccaccctctctctctcgactcgagcggctggcaggcncatagnnnnn

SEQ ID NO: 135316 - DNA, 833 bp, Homo sapiens
  misc_feature: GYAE6OF01EXGG1.49.11.A11.1.454.CMB.1.raw
  modified_base (768)..(768): a, c, t, g, unknown or other
  misc_feature (768)..(768): n is a, c, g, or t
tcagagtcgagagacacgaccggtgctcgatttagctacgactgcgagggggggcctaaggaagcagcacgtggtggtgcctcagccagtggcctggaccgttctcctccgtcggcctcctctctcactgcacgagactcgtgtcgacctcgtagtgtcgctgactcgacgccctacccgttggtagtacgacggtccggtcccgtaggacgacggtaccggacgaaggttacttaccggtaggggtaacgggggaaaacctacgtaagggttaacgggaaagtaacggtactggtacgacgtacggtacggtaaccaaggacgaagaaccgccgacggtaccgaccggtccctagtccggtcgttacgggtctacgttaacggtgggtacgtaacgggtcccgggtaacccggttccccggtaccgttacgggaacggttacccgtacccggtagggaccgttacgttaaccgtttaccggtccgtacccggttacctaacccggttaccgttacccgggtaccccgggtaccccaacccgtaccgttaacggacccgtacgtacccgggtaccgggtaccgggtaaggaaccgggtacgggtacgtacgtacccggtacgttaactacggttaacgtcggtacgtaggtggtacggtagttcggtaggttcggaggttcgtcgttaccgggtgaacgtcgggtaccggtacggaccgttccgtaccggtcgacgaccggaccgaaccggcccggaacccctacggnttcccggtactcccgttccggttcccctccccgaccttccgttacgaccgtcgtccgactcgggg

SEQ ID NO: 135317 - DNA, 270 bp, Homo sapiens
  misc_feature: GYAE6OF01AS3KD.49.11.A11.1.454.CMB.1.raw
  modified_base (139)..(139): a, c, t, g, unknown or other
  misc_feature (139)..(139): n is a, c, g, or t
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (249)..(270): a, c, t, g, unknown or other
  misc_feature (249)..(270): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtnttcggagctgggaccagggtcaccgtctaggtcagcccaagccaaccccatgtcactctcgttcccaccctcctctctctcgactcngagcggntggcaaggcncatagnnnnnnnnnnnnnnnnnnnnnn

SEQ ID NO: 135318 - DNA, 694 bp, Homo sapiens
  misc_feature: GYAE6OF01D9MRY.49.11.A11.1.454.CMB.1.raw
  modified_base (231)..(231): a, c, t, g, unknown or other
  misc_feature (231)..(231): n is a, c, g, or t
  modified_base (345)..(345): a, c, t, g, unknown or other
  misc_feature (345)..(345): n is a, c, g, or t
  modified_base (369)..(369): a, c, t, g, unknown or other
  misc_feature (369)..(369): n is a, c, g, or t
tcagagtcgagagacacgaccggtgctcgatttagctacgactgcgaggggggggcctaaggaagcagcactggtggtgcctcagccatggcctggacccgttctcctcctcggcctcctctctcactgcacagactctgtgacctctatgtgctgactcacgcctacccgtcggtgtcaggtcgccctggacagacggccaggtacttaccgtgggtagggggaaactanagttaggaaagtaagacctggtgcctagtcggtaaccagacaaggaacgccgacggccgaccggccctgtcgcgtggtctcgtagttggagtagtcgggaccggccccggtccncggtacgggtacctccggtggacncggttacttccttgtaccggtcctacccgtaacgtccgggtacccggaacccgccaaccgtcgacctacgtaccgacgggtaccgggaacgggaacggacgggtacgtacgggacggtaccgtacttacgttacgtcgtagggtacgggttggtagggtagttacgggtggggttacgttcgggtaggttcggtttcggtagggacggtcggtacggggaccggtgggtcccgtacgtcggtacggaccaaccggaccaacggccccaaacgtcgtcacctcgttcccgtcctacccctccctcgtcctccttcgcgtctacggg

SEQ ID NO: 135319 - DNA, 255 bp, Homo sapiens
  misc_feature: GYAE6OF01EAN8Z.49.11.A11.1.454.CMB.1.raw
  modified_base (245)..(245): a, c, t, g, unknown or other
  misc_feature (245)..(245): n is a, c, g, or t
  modified_base (251)..(255): a, c, t, g, unknown or other
  misc_feature (251)..(255): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctgttcccaccctcctctctctcgactctgagcgggctggcaaggcncatagnnnnn

SEQ ID NO: 135320 - DNA, 259 bp, Homo sapiens
  misc_feature: GYAE6OF01CC6I8.49.11.A11.1.454.CMB.1.raw
  modified_base (252)..(259): a, c, t, g, unknown or other
  misc_feature (252)..(259): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctcgttcccgcctcctctctctcgactctgagcgggctggcaaggcgcatagnnnnnnnn

SEQ ID NO: 135321 - DNA, 719 bp, Homo sapiens
  misc_feature: GYAE6OF01EE5OR.49.11.A11.1.454.CMB.1.raw
  modified_base (225)..(225): a, c, t, g, unknown or other
  misc_feature (225)..(225): n is a, c, g, or t
  modified_base (355)..(355): a, c, t, g, unknown or other
  misc_feature (355)..(355): n is a, c, g, or t
  modified_base (549)..(549): a, c, t, g, unknown or other
  misc_feature (549)..(549): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagcccaccctcggtgtcagtcggccctggacagaccggccaggattaccgtgggtacgggggaaacncagttagggaagtaagactgtgcacgtggtaccagcagaacgccaggccacggccctgcgcgtggtcgtctagtggtgagtcgggaccgaccggccctgacgggtcctcccgtgacgcgtattccgtcgnggtcctaccgaacgtccggtaccgggaaccccgtcccaacccgtacgaccagtccgacgggaccggggtacgaaacggggacgggtagtacgggaacggtacccgtaacgttacgttaacgttggtacggtacgggttgggtacgggtagttaggggttggtagggttgggttcggttcgttcggtttacgggnggtccggttacggggaccgtacggggtaccgtaccgttacggtacggtaccgtaaccggacccgtaaccggaccccctaaaccccgtgttaccgttcccgtaaccgttcccgttacccgttacccccgtaccccttcccgtcgttaccctcgttacccgtacgttccggg

SEQ ID NO: 135322 - DNA, 258 bp, Homo sapiens
  misc_feature: GYAE6OF01EEM7V.49.11.A11.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
  modified_base (247)..(258): a, c, t, g, unknown or other
  misc_feature (247)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccatgtcactctgttcccgcctctctctctcgactcngagcggctggcaaggcncatagnnnnnnnnnnnn

SEQ ID NO: 135323 - DNA, 753 bp, Homo sapiens
  misc_feature: GYAE6OF01ACY5R.49.11.A11.1.454.CMB.1.raw
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
tcagagtcgagagacacgaccggtgctcgatttagctacgactgcagggggggctaaggaagcagcactggtggtgcctcagccatggcctggaccgttctccctcctcggcctcctctcctcgactgcacagactctgtcgacctctatgtgctgactcacgccacccgtcggtgtcagtcggcccctggacaggacggccaggtacttaccgngggtagggggaaacnctagttggaaataagctgtgactacgtggtaccagcgaagaacgccgacggccacggtcccctggtcgcgtcggtcgtacgtagtgggtagacgtcgggccgacccggcccgtacggacgggtactcccgtagacgtcgtacttcctcgtcgcctaccgtactcggtaccgggaaccccgtccgaacccgtcgacctacgtccgacgggtcccggggtacgaacggggacgggagtaccggacggtaccgtacgttacgttaccgtggtaccggtagggttcggtacgggtagttacgggttggtaaggttcgttcggttacggttcgttacgggtaggttccggtaccggggaccggtaccgggtaccgtacccggttaccggtaaccggtaccgaacccggtacccggaaccggtaccccctaacccggtaccgttaccggtaccctaaccggtttcccgtaccccggtttccccgaccccgttccttccgtacccttcccggtaccgtcccgttaccggg

SEQ ID NO: 135324 - DNA, 332 bp, Homo sapiens
  misc_feature: GYAE6OF01E5W4P.49.11.A11.1.454.CMB.1.raw
  modified_base (122)..(122): a, c, t, g, unknown or other
  misc_feature (122)..(122): n is a, c, g, or t
  modified_base (149)..(149): a, c, t, g, unknown or other
  misc_feature (149)..(149): n is a, c, g, or t
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (263)..(265): a, c, t, g, unknown or other
  misc_feature (263)..(265): n is a, c, g, or t
  modified_base (267)..(269): a, c, t, g, unknown or other
  misc_feature (267)..(269): n is a, c, g, or t
  modified_base (271)..(271): a, c, t, g, unknown or other
  misc_feature (271)..(271): n is a, c, g, or t
  modified_base (273)..(332): a, c, t, g, unknown or other
  misc_feature (273)..(332): n is a, c, g, or t
tcagagtcgagagacacgaccggtgctcgatttagctacgactgcagggaacccggccaccctgaccatcagccgggtcgaagacggggatgaggccgactattactgtcacgtgtgggacngtagtagtgatcatgtgggtgttcggnggaggaccaagctgaccgtcctaggtcagcccaaggcctcgcccccttggcactctcgttcccnccctctctctctacgactctggcggcggtcnggcgaacggcacatgnagnnngnnngntnnnnnnnnnnnnnnnnnnnnnnnnnnnnnnnnnnnnnnnnnnnnnnnnnnnnnnnnnnnn

SEQ ID NO: 135325 - DNA, 276 bp, Homo sapiens
  misc_feature: GYAE6OF01BCC31.49.11.A11.1.454.CMB.1.raw
  modified_base (190)..(190): a, c, t, g, unknown or other
  misc_feature (190)..(190): n is a, c, g, or t
  modified_base (250)..(251): a, c, t, g, unknown or other
  misc_feature (250)..(251): n is a, c, g, or t
  modified_base (253)..(276): a, c, t, g, unknown or other
  misc_feature (253)..(276): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccaggtcaccgtctaggtcagcccaaggccaaaccccntgtcactctgttcccaccctcctctctctcgactctgagcgggctggcaaggcgcatagnntnnnnnnnnnnnnnnnnnnnnnnnn

SEQ ID NO: 135326 - DNA, 263 bp, Homo sapiens
  misc_feature: GYAE6OF01B36CE.49.11.A11.1.454.CMB.1.raw
  modified_base (254)..(263): a, c, t, g, unknown or other
  misc_feature (254)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctcgttcccaccctcctctctctcgactctgagcgggctggcgaaggcgcatagnnnnnnnnnn

SEQ ID NO: 135327 - DNA, 592 bp, Homo sapiens
  misc_feature: GYAE6OF01DEVHS.49.11.A11.1.454.CMB.1.raw
  modified_base (330)..(330): a, c, t, g, unknown or other
  misc_feature (330)..(330): n is a, c, g, or t
tcagagtcgagagacacgaccggtgctcgatttagctacgactgcagggggggccgtaaggaagcagcactggtggtgcctcagccatggcctggaccgttctcctcctcggcctcctctctcactgcacagactctgtgacctcctatgtgctgactcagccaccctcggtgtcagtggccctggacagacggccaggattacctggtggggaaacgacattggaagtaagactgtgcactggtaccagcagaagccaggccaggcccctgtgctggtctctatggtgatggccgaccggccctgagggtactccctgacgcgattccnctggctccgaactcgtacgggaacccgccaacccgtgacccatccaggcccgggtacgaaggacggggatggaggccgactattacgtgtcagggtgtgggtataggttgggtagtggttgttcggtcgttacgggagtcgttaggggacctaggggtccaccggtccttagggtcaccggcccgaacggccccaaccccgacgttcggacctaccttcgttaccgttcccccgcccttccgtcctcctcttcccgacttcg

SEQ ID NO: 135328 - DNA, 258 bp, Homo sapiens
  misc_feature: GYAE6OF01EPTFF.49.11.A11.1.454.CMB.1.raw
  modified_base (246)..(246): a, c, t, g, unknown or other
  misc_feature (246)..(246): n is a, c, g, or t
  modified_base (252)..(258): a, c, t, g, unknown or other
  misc_feature (252)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccactgtcactctcgttcccaccctctctctctcgactctgagcgggctggacaaggcncatagnnnnnnn

SEQ ID NO: 135329 - DNA, 862 bp, Homo sapiens
  misc_feature: GYAE6OF01BIM83.49.11.A11.1.454.CMB.1.raw
  modified_base (176)..(176): a, c, t, g, unknown or other
  misc_feature (176)..(176): n is a, c, g, or t
  modified_base (497)..(497): a, c, t, g, unknown or other
  misc_feature (497)..(497): n is a, c, g, or t
tcagagtcgagagacacgaccggtgctcgatttagctacgactgcgagggggggcctaaggaagcagcactggtggtgcctcagccatggcctggaccgttctcctcctcggcctcctctctcactgcacagactctgtcgacctctatgtgctgactcacgccctaccgtcggtntcacggtcggccctaggacgacggaccggacaaggtaacttaccggtggggtaaggggaaaactcgtaagttaaggaagtaacgacgttagtcgacacgtcggtaacagacaacgacgaccgtacggccgacggtcccttggcgtcgttcgggtccttacgttaggtcgggtacgagtccgggacccggacccgggtccctacgggtaacgggtccctacccggtaggacgttaccggttactttcgtaccgggtcgacccttaccgtaacggttccgggtaacccgggaccccgtacccgacccgttacggaccgttacnccgggtaacgggtacccggggtaacgaaggggtaccgggtaacgtcgggaaccggtaccttaacgtttaaacgtcggttacggtagggtaacgggtcggggttaaggtacggttacgggtttgggttacggtttcggggtccggtttacggttccggtaacggggccgttacgggaccgggtaaacccggtcggggttaaccccgtaccgggttaaccggttaccggaccgaccgtaaccccggaaacccggtaccccaacccgttgggtacctacccggttacctttccccggttacccccgttacccccgtttccccctacctttaccccggttccttacccgttaaccggtacccggtcggg

SEQ ID NO: 135330 - DNA, 252 bp, Homo sapiens
  misc_feature: GYAE6OF01BF02O.49.11.A11.1.454.CMB.1.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (249)..(252): a, c, t, g, unknown or other
  misc_feature (249)..(252): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtccaccgtcctaggtcacgcccaaggccaaccccatgtcactctcgttcccacctctctctctcgactcngagcggctggcaggcncatgnnnn

SEQ ID NO: 135331 - DNA, 983 bp, Homo sapiens
  misc_feature: GYAE6OF01ATEKZ.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccacccgtcggtgtcagtcggcccctggacagacggcctaggattacctggtacgggggaaacctacgagtttagggaaacgttaagaccttgtaggacacgttagggtaacccagccgaagaacggcccgaacgggacccgtaacgggtccccccttaggtacggtccgttcggggttaccgttacgttaaggtttacggggtacggtaccggtttacggggaccccggtaaaccccggggtccccctttacgggaaaccgggggtaaccgttcccccggttaggaccgggttaccggtaaccttttcccggtaccggttacggggtacccttaacccccggtaaaccgtccgttacccgggggaaaccccccggtccctaacccccggtataacccggtacggttacccgaacggggttaccccgggggtaaacgtaaacggggtaaccggggtacgttaacgggaaccgggtacccgtaaccgtttaacgtttaaaccggtcggttaacggtacgggtccggggttaaggggttacgtttaaccgggttagggtttaccggttaacggggttcggttttacccggtttaccgggtttaaccgggtaacggttacggttacccgggggtaacccggttacggggtacccgtaacccgggttttacccgttaacgggacccgtacccggtaacccccggtaacggtacccccctaaaccccgtacgtaccgttacccgtaacccttccggtttaccccgtaccccccgtacccttccccggttacttacccccgttaacgttcccgtaacgtttcccccggg

SEQ ID NO: 135332 - DNA, 807 bp, Homo sapiens
  misc_feature: GYAE6OF01C8HR2.49.11.A11.1.454.CMB.1.raw
  modified_base (228)..(228): a, c, t, g, unknown or other
  misc_feature (228)..(228): n is a, c, g, or t
  modified_base (260)..(260): a, c, t, g, unknown or other
  misc_feature (260)..(260): n is a, c, g, or t
tcagagtcgagagacacgaccggtgctcgatttagctacgactgcagggggggcctaaggaagcagcactggtggtgcctcagccatggcctggaccgttctcctcctcggcctcctctactcactgcacagactctgtcgacctcctatgtgctgactcagcctacccgtcggtgtcagtcggcccctggacagacggcctaaggacttaccgtggtaggggaaacncagttagggaataagactgtgcacgtggtacngcagacgcaggccacgccctgtcgatcggtcgtctagtgggtgtacgtcgggtccgacccggccctacgacggggtactcccgtaggacgtcgtattccgtaccgtggacctaccgtaacgtccggtacggggacccccgtaccaccctgaccgtaactccggaacggtacccgggaaggaacgggaccgggtagtacggacggtacccggaactttaggtaaccgtggtacgtacggggtaggtacgggggtaattagggttcgggtaacggttcggggttacccgtttaccgggttacggtttacccggggaggtaacccgggttaccggggaaccccgggttaacgggttccgttaacccccggggttaccggttaaccgggtcccgaaacccgggttcccccgggtaaaaaacgacccccccggtaaacccccgttacgggttacccgtaacccttaaccccgttccggttaccccgtttaccccccgtaccccgtttcccctaccgggttccccttaacggttccccgtacggttaccccgg

SEQ ID NO: 135333 - DNA, 318 bp, Homo sapiens
  misc_feature: GYAE6OF01DO5GB.49.11.A11.1.454.CMB.1.raw
  modified_base (139)..(139): a, c, t, g, unknown or other
  misc_feature (139)..(139): n is a, c, g, or t
  modified_base (198)..(198): a, c, t, g, unknown or other
  misc_feature (198)..(198): n is a, c, g, or t
  modified_base (253)..(253): a, c, t, g, unknown or other
  misc_feature (253)..(253): n is a, c, g, or t
  modified_base (272)..(272): a, c, t, g, unknown or other
  misc_feature (272)..(272): n is a, c, g, or t
  modified_base (274)..(318): a, c, t, g, unknown or other
  misc_feature (274)..(318): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtnttcggagcgtgggaccagggtcaccgtccgtaggtcacgacccgaacggcccaaccctntgtcactctccgtcccctaccctcctctctcgtccactcgtggacggcgggtcgnggacgaacggcactagtancnnnnnnnnnnnnnnnnnnnnnnnnnnnnnnnnnnnnnnnnnnnnn

SEQ ID NO: 135334 - DNA, 272 bp, Homo sapiens
  misc_feature: GYAE6OF01EBF1X.49.11.A11.1.454.CMB.1.raw
  modified_base (257)..(272): a, c, t, g, unknown or other
  misc_feature (257)..(272): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcgttcggagctgggaccagggtcaccgtcctaggtcagcccaaggccaaccccatgtcactctcgttcccaccctcctctctctcgactctgacgcgggctggacaaggcgacagtagnnnnnnnnnnnnnnnn

SEQ ID NO: 135335 - DNA, 799 bp, Homo sapiens
  misc_feature: GYAE6OF01EGVOB.49.11.A11.1.454.CMB.1.raw
tcagagtcgagagacacgaccggtgctcgatttagctacgactgcagggggggcctaaggaagcagcactggtggtgcctcagccatggccctggaccgttctccctcctcggcctcctctctcactgcacagactctgtcgacctctatgtgctgactcacgccctacccgtcggtgtcagtcggccctggacagcgcagattaccgtggtaggggaaacatagttaggaagtaacgctgtcgactacgtacggtaccagacgaaggaacgccgacggcccgacggcccccttaggtcgcgttcgggttccgttacgttaaggttcggggtacggtaaggttccggggacccgggtaacccccgggtcccgtaccggggtaaccggggtaccttccccggttaggacggtaccgttacgtttcccgtacggtcgtacccgttaaccctaaccgttaccgggtacccggggaacccccgaccctaacccgtaccgaaccctacgtacccggaccgggtccgggtaacgggaaacgggacggggtacgtacggacccgggtaccgtaactttaacgttacggtggtacgtacggggtggtacgggttagtaaggggttggttaggttgggtcgttccggttacggtgggacggtcggtacgggaaccggtcgggtaccgtacccgtcggttacggaccgtaccggacccgaacccggaccctaacccgtcgtaccgtacgtcctcccggttccccgttaccccctcccttacccttccttccctcgtccctccggtacgg

SEQ ID NO: 135336 - DNA, 890 bp, Homo sapiens
  misc_feature: GYAE6OF01BLY34.49.11.A11.1.454.CMB.1.raw
tcagagtcgagagacacgaccggtgctcgatttagctacgactgcagggggggcctaaggaagcagcactggtggtgcctcagccatggcctggaccgttctccctcctcggcctcctctctcactgcacagactctgtgacctcctatgtgctgactcacgcccacccgtcggtgtcagtcggcccctggaccaggaccggtccaaggtacttaccgtgggtacggggaaacactagttaggaaagtaagacgtgtcgactacgtggtaccagacaaggaacgccgtaggcccgacggtcccctggtcgtcgttcgggtcgtctaggttcggagacgtccggggacccgtacccggtcccgtacggaacgggtccttacccggtggtacggtacgttactttccgttcggtccggtaccttacccgtaaaccgttccggtaaccccgggggaaccccctaccccgtacccgtacgaacccgtacggtaccgaaccggggtccccggggaaacgtaacgggggaacggggtacgtacgggaccggtacccgttaacgttaagtttaccgtacgggttacgggacgggtttagggtaacgggttaagttaggggtttacgggttaagggtttcggttacggggttccgttttaaccggggttacgggacggttcccgggttacgggggtaacccggttacggggttaccccgtacccgggtttaaccgtacggggtaacccgacccgggaacccccgtaaacggaccccccccgtaaacccgtaacggttcccgtaacccgtacccgtttccccgttaaccgttccccccccccgtaacctttccccggttcccttaccccgttactccccgggttaaccgttacccgggg

SEQ ID NO: 135337 - DNA, 737 bp, Homo sapiens
  misc_feature: GYAE6OF01BC45U.49.11.A11.1.454.CMB.1.raw
tcagagtcgagagacacgaccggtgctcgatttagctacgactgcagggggggcctaaaggaagcagcactggtggtgcctcagccatggcctggaccgttctcctcctcggcctcctctctcactgcacagactctgtgacctcctatgtgctgactcagccacccgtcggtgtcagtcggcccctggacagacggccaggtattaccgtggtaggggaaacactagttaggaaagtaagactgtcgactacgtggtaccagacagaacgccgaggccgacggcccctgtcgtcgtggtcgtcgtagtggtgtagtcgggccgacccggtcccgtgacggctcccgtagacgtcgtacttcctcgtcggacctaccgaacgttccggacccgggaaccccgccctaccccgtacgtaacccacgtaccgaacgggtccgggtaacggaacgggacggggacgtcgggaacggtacccgtaacttaacgtttacgtaggttacggtaagggttcgggtagggtattagggttacgggttggtttcgggtagttaccggttcggttacgggacggttagggtaccggggtaacccggtacgggtacccgtaccggttaccgttaggtaccgtaccgaccccgtaaccggaccccaaccccgtcgtccgtacctaccgttccgttcccgttacccccctacccgttccccttaccttccgttaccctcgtcccgttcgg

SEQ ID NO: 135338 - DNA, 697 bp, Homo sapiens
  misc_feature: GYAE6OF01DSK8W.49.11.A11.1.454.CMB.1.raw
tcagagtcgagagacacgaccggtgctcgatttagctacgactgcaggggggggcctaaggaagcagcactggtggtgcctcagccatggcctggaccgttctcctcctcggcctcctctctcactgcacagactctgtgacctcctatgtgctgactcacgcccaccctcggtgtcagtcggccctggacaggacggccaggattaccgtggtagggggaaacacagttgggaaagtaagactgtgcactggtaccagacaaggaacgccacggcccacggcccctaggtcgctcggtcgtctagtggtgtagtcgggaccggacccggtccctacggacgggactcccgtaggacgtcgtacttctcgtcggtctaccgacgtaccggtaccgggaaccccggtccacccgtgaccctacgtcgaccgggtccggggtaacggaacgggacggggtacgtacgggaacggccgtaacgttaccttaacgtcggtacggtaggtgggttagggtagttacgggtgggttaggtgggttcggttcggttcggttcgggcgtacggtccgggacgtacggggtcctaccggtaccgtaggtccgaccggtaccccgaacggaccccaacccgcgtccgtacctccttccgtacccgttcccccacccgttcctcccttccgtcccgtcgtccgttcgg

SEQ ID NO: 135339 - DNA, 274 bp, Homo sapiens
  misc_feature: GYAE6OF01AB6X8.49.11.A11.1.454.CMB.1.raw
  modified_base (192)..(192): a, c, t, g, unknown or other
  misc_feature (192)..(192): n is a, c, g, or t
  modified_base (238)..(238): a, c, t, g, unknown or other
  misc_feature (238)..(238): n is a, c, g, or t
  modified_base (260)..(274): a, c, t, g, unknown or other
  misc_feature (260)..(274): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggacccagggtcaccgtcctaggtcagcccaaggccaaccccntgtccactctcgttcccacctctctctcgtcgactctggagccggngtaggccaagggtcacatggcnnnnnnnnnnnnnnn

SEQ ID NO: 135340 - DNA, 774 bp, Homo sapiens
  misc_feature: GYAE6OF01C6MN4.49.11.A11.1.454.CMB.1.raw
tcagagtcgagagacacgaccggtgctcgatttagctacgactgcagggggggcctaaaggaagcagcactggtggtgcctcagccatggcctggaccgttctcctcctcggcctcctctctcactgcacagactctgtgacctctatgtgctgactcagccaccctggtgtcagtcgccctggacagacgccaggtactaccgtggtaggggaaacactagttagggaaagtaagacgtggtcgactacgtcgggtaaccaggacgaacgaacgccgaacgggccgaccggtccccgtggtacgtcgttcgggtccgtcgttagtgggtaggtacgtcggggacccggacccggtccccgtaggaacggggtcctcccggtaggaacggtacgtacgttccgtccgtacggtacccttaccgtaaaccggttcccgggtaaacccggggaacccccggtcccctaaaccccgtcgaacccgtaacgtccggacgggtcccgggtaaagggaaccgggaacgggtctacgggacggtacccgtaattaacgttcgtcggtacggtagggttggtagggtagtttagggtaggttgggtcggttcggttcgttcgggtacgaggtcggtacggggaccgtacgggtcctaccggttcggtacgcgaaccggaccctaaaccgggaccccctaaccggtacttcggtaccctaccgttcccgttcccgttaccccctccccgtttacctcccgttcttacccgccgttcgtccggg

SEQ ID NO: 135341 - DNA, 917 bp, Homo sapiens
  misc_feature: GYAE6OF01A5H1D.49.11.A11.1.454.CMB.1.raw
tcagagtcgagagacacgaccggtgctcgatttagctacgactgcgagggggggcctaaggaagcagcactggtggtgcctcagccatcggcctggaccttctcctcctcggcctcctctctcactgcacagactctgtgacctcctatgtgctgactcacgcccaccctcggtcgtcaggtcggcccctggaccaggaccggccgaggtacttacccgtgggtacgggggaaaactacgtagtttagggaaacgttaagacgttaggtacgcctacgttacggtaaccaggtaccgaaggtaacgccgaacgggcccgaacgggtccccccttaggtacggtaccgttcggggttccgtttacgtaacggttcggggttaggtaggttaccggggacccggtaaccccgggtccccgttacgggtacgggggaaccttccccggtagggaccgggtaccgttaaccgtttcctaccgggttacgggtcccgttaacccgtaaccgttccgggtaacccggggtaacccccgacccgtaccccgtacggaccctacgtaccgacgggtcccgggtaacggaacgggacgggactacgggacggtacccgtaacgttacgttacgtggtacggtacgggttagggttacgggtaagtttcggggttagggttacggttacgggttcggttacggtttaccggttaggggtaacggttccgggttaaccgggggtacccggttaccgggggttacccgtacccgggtttacggtaccgggtaccgaacccggtacccggtaaccgggacccccttaaccccggtacgttccggttacccgttacccggtttcccttacccgggttaccccctacccggttcccttacccctacggttccttacccgtcggttaccccgg

SEQ ID NO: 135342 - DNA, 830 bp, Homo sapiens
  misc_feature: GYAE6OF01BUZ4V.49.11.A11.1.454.CMB.1.raw
  modified_base (383)..(383): a, c, t, g, unknown or other
  misc_feature (383)..(383): n is a, c, g, or t
tcagagtcgagagacacgaccggtgctcgatttagctacgactgcgagggggggcctaaggaagcagcactggtggtgcctcagccatggcctggacccgttctccctccgtcggcctcctctctcactgcacagactctgtcgacctcctatggtgctgacctcacgccctacccgtggtgtcaggtccggccccgtaggaccacggaccggccgaggtacttaccggtggggtaacggggaaaacacgtaaggtttagggaaaagttaagtccgtaggtacgaccgtaacggttacggtaaccaagggaccaaaggaaccgaccgagggtacccgacggtccccgttaggcgtcgttaggttccgttagtaggtcgggtanacggttccgggaaccccggcccgccgttagggacggtacctcccgttaggcgtaccgttacttccgtacgggtcgtaccctaccgtaacggttacccgggacccggggaaacccctacccctacggttacccgaacgtaccggtaccggaaccggggtaccgggtaaacggaacggggtacggggtataccgggaaccgaccgttaagttacgttacggtacgttacgggagggtcggttagggtaacgtaggttgggtagtgggttcggtacgtttcggtacggcggtcgggtaccgggaccgtacgggtccgttacccggtgtaacggccgtaaccgaccggtaaccccgacccgtaacccgtcctaggttcccctaccgttccgttaccccccttacccgacccctttccgtacttacccggtccgtacccgttaacgttccgg

SEQ ID NO: 135343 - DNA, 269 bp, Homo sapiens
  misc_feature: GYAE6OF01AVSB2.49.11.A11.1.454.CMB.1.raw
  modified_base (193)..(193): a, c, t, g, unknown or other
  misc_feature (193)..(193): n is a, c, g, or t
  modified_base (252)..(269): a, c, t, g, unknown or other
  misc_feature (252)..(269): n is a, c, g, or t
tcagagtcgagagacacgaccggtgctcgatttagctacgactgcagggaacccggccaccctgaccatcagccgggtcgaagaccggggatgaggccgactattactgtcaggtgtgggatagtggtagtggtgtcgtcttcggagctgggaccagggtcaccgtcctaggtcagcccaaggcccaaccccntgtcactctgttcccgcctcctctctctcgactctgagcgggctggcaaggcgcatagnnnnnnnnnnnnnnnnnn

SEQ ID NO: 135344 - DNA, 266 bp, Homo sapiens
  misc_feature: GYAE6OF01DDWNU.49.11.A11.1.454.CMB.1.raw
  modified_base (253)..(266): a, c, t, g, unknown or other
  misc_feature (253)..(266): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctcgttcccaccctcctctctctcgactctgagcgggctggacaaggcacatagnnnnnnnnnnnnnn

SEQ ID NO: 135345 - DNA, 310 bp, Homo sapiens
  misc_feature: GYAE6OF01ECSVZ.49.11.A11.1.454.CMB.1.raw
  modified_base (268)..(310): a, c, t, g, unknown or other
  misc_feature (268)..(310): n is a, c, g, or t
tcagagtcgagagacacgaccggtgctcgatttagctacgactgcagggaacccggccaacccgtgaaccatccagccggggtcgaaagaccggggatgaggccgactattactgtcaggtggtgggatagtggtagtggtgttcgttcttcggagctgggaccagggtcaccgtcctaggtcagcccgaaggcccaaacccccgactgtcacctctcgttcccgccctcctctctctcgactctgagcgggctggcaggcgcatagnnnnnnnnnnnnnnnnnnnnnnnnnnnnnnnnnnnnnnnnnnn

SEQ ID NO: 135346 - DNA, 271 bp, Homo sapiens
  misc_feature: GYAE6OF01C5ENZ.49.11.A11.1.454.CMB.1.raw
  modified_base (253)..(271): a, c, t, g, unknown or other
  misc_feature (253)..(271): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcgtgggaccagggtcaccgtcctaggcagcccaaggcccaacccatgtcactctcgttcccaccctcctctctctcgactctgagcgggctggacaaggcgcaatgnnnnnnnnnnnnnnnnnnn

SEQ ID NO: 135347 - DNA, 661 bp, Homo sapiens
  misc_feature: GYAE6OF01DIMQZ.49.11.A11.1.454.CMB.1.raw
  modified_base (250)..(250): a, c, t, g, unknown or other
  misc_feature (250)..(250): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtggcccctggaccagacggccagggattacctgtggggaaacgacattggaagtaagactgtgcactggtaccngcagaagccaggccaggcccctgtgctggtcgtctatcggtgagtggtcgaccggccctcgaggggactcccgtgacgcgattctccgtggcctccgaactccgtcggggaaccccggccaacccgtcggaacctacgtcaacggccggggtaccgaaaggacgggggatggaacgggtcccgagttaacttacgtagtaccgtaagggttcgtgggagtaggttggaggtttgggtaggtcggtatttccggggaaggcgttcggggacctgggggtaccaccggtccgttaagggtccgacgccccgtaaggccccgaaacccccgtaccgtacgtccgtaacccttcccgtttaccgttcccccgtaacccttccccttaccgtcccttacccttccggacccttcgg

SEQ ID NO: 135348 - DNA, 845 bp, Homo sapiens
  misc_feature: GYAE6OF01BD4BX.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacacggaccggccagggtacttaccgtggtacgggggaaacacgtagttgggaaagttaagactggtacgctaacgttgggtaaccagacaaggaacgaccgaggcccacgggcccctggtcgccgtgggtccgtctagtggtaggacgtcgggccgaccgggccctaggacggggtaacctcccgtggacggtccgtacgtttcgtcgtcggtcctacccgtaaccgttccggtacccggggaaccccgtcccgaccccgttacggaacccgtacgtacccgaacgggtcccggggtaaccgggaaaccggggtaccgggggtacgttaccgggaaccggggtacccggttaaccgttaacgttaacggttcggtacgtacggggttcgggtaaggggtacgttacggggttagggttagggtttacggggttcggtttacccgggtttccggttttcgggggaacggtcccggggttacgggggtaacccggtacgggggtttaccccgaacccggggtttccgacgggttacccgaaccggtaccccgaaaccgggtcccccaaacccggttcgtaccggttaccctaccggttcccgtacccgttacccctaccccgttcctcccgttacccttcccgttccgtcccgttccgg

SEQ ID NO: 135349 - DNA, 819 bp, Homo sapiens
  misc_feature: GYAE6OF01DZHF5.49.11.A11.1.454.CMB.1.raw
tcagagtcgagagacacgaccggtgctcgatttagctacgactgcgagggggggcctaaggaggcagcactggtggtgcctcagccatggcctggaccgttctcctcctcggcctcctctctcactgcacagactctgtcgacctcctatgtcgctgacctcacgcccacccgtcggtgtccacggtccggccccgtaggacacggaccggccgaggtacttaccgtgggtacggggaaacacgtagttaggaaaggtaacgacgtggtacgaccgtacgttacggtaaccacggacgaacggaacgcccggaacggcccgtaccgggtccccttgggtcgccggtttacgggtccttacgtaggttgggtacgacggtcgggacccgtaacccgggccctacggacgggtacctccgtaggacgtcgttacttccgtcgtcgcccttaccgtaaccgttccggtaacccgggggacccctacgtaccccgtaacgaaccgtacgtcccggaacgggtcccggggtaaacggaaacggggacggaacgttacgggaacccggtaaccgtttacgttaacgttaccggttacggtaacgggtgggtaacgggttacggggtaatttaggggtttgggtaacgggtttcggtttaccggtttcgggtttcggttaccgggtacggtccggtacgggtaaccgtccggtaccgtacccggttagttacccggcgaaccgtacccgaaccgaccccgtacctcggtcgtaccctccttcggccccttcccctccctccttcccgtactcccgtcgtcgtacgg

SEQ ID NO: 135350 - DNA, 632 bp, Homo sapiens
  misc_feature: GYAE6OF01ARO43.49.11.A11.1.454.CMB.1.raw
  modified_base (281)..(281): a, c, t, g, unknown or other
  misc_feature (281)..(281): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
  modified_base (582)..(582): a, c, t, g, unknown or other
  misc_feature (582)..(582): n is a, c, g, or t
  modified_base (601)..(601): a, c, t, g, unknown or other
  misc_feature (601)..(601): n is a, c, g, or t
  modified_base (613)..(613): a, c, t, g, unknown or other
  misc_feature (613)..(613): n is a, c, g, or t
  modified_base (623)..(623): a, c, t, g, unknown or other
  misc_feature (623)..(623): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtcgacctctagtgtgctgactcgacgcccacccgtcggtgtcgtacggtcggcccctggacgacggaccggaccgaaggtacttaccgtgggtaacgggggaaactacgtagttaggaagtaagacgtgacacacgtcggtacngacagacgccacggccacggccctggtcgcgttggctacgtagtggaggtagccggacggcccgcctaggacggacctccgtagcgcgtattccgcgcgtccaccgtacgccgtaccgggacccgcgtaccgacgactactaccggacgggtccggaacggaacgggcggtacgtacggaccgtacgtatacgtacgtggtacgngggtagtggtagtgtggttacgngttcgtacgtcgtaggcgtacggtcggacgtcgggtctaccggtcgaagtcgaccgacctaacggccctaacngtcgcctactccgttcccnccgtacccttcncctagtcccngttcgacgg

SEQ ID NO: 135351 - DNA, 261 bp, Homo sapiens
  misc_feature: GYAE6OF01D9V22.49.11.A11.1.454.CMB.1.raw
  modified_base (253)..(261): a, c, t, g, unknown or other
  misc_feature (253)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggacaaggcgcatagnnnnnnnnn

SEQ ID NO: 135352 - DNA, 288 bp, Homo sapiens
  misc_feature: GYAE6OF01DPXKN.49.11.A11.1.454.CMB.1.raw
  modified_base (261)..(263): a, c, t, g, unknown or other
  misc_feature (261)..(263): n is a, c, g, or t
  modified_base (265)..(288): a, c, t, g, unknown or other
  misc_feature (265)..(288): n is a, c, g, or t
tcagagtcgagagacacgaccggtgctcgatttagctacgactgcagggaacccggccaccctgaccatcagccgggtcgaagacggggatgaggccgactattactgtcaggtggtgggatagtggtagtggtgtcgtcttcggacgcgtgggaccagggtcaccgtcctaggtcacgcccaaggggcccaacccactgtcactctcgttcccaccctcctctctctcgactctgacgcggctcggacaggcgacatagnnncnnnnnnnnnnnnnnnnnnnnnnnn

SEQ ID NO: 135353 - DNA, 847 bp, Homo sapiens
  misc_feature: GYAE6OF01D0P1Z.49.11.A11.1.454.CMB.1.raw
  modified_base (129)..(129): a, c, t, g, unknown or other
  misc_feature (129)..(129): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcanagactctgtcacctctatgtgctcgactcagccaccgtggtgtcagtccggcccctaggaactaggaccggtccgaaggtacttacccgttggggtaacggggggaaaacctacgtaaggtttaggggaaaagttaaacgtccgtttggacgacctaggttaggtaacccgaggacaacggaaacgccgaacggacccaccgggtcccctaggtcggtacgtcgggttcttaccgtaagtttcgggtacgtagtcggggtacccggtaaccccggcccgttacgggacgggtacctaccggtaggtaacgacgttacgttcctacggttcggaacccttaaccgtaaccgtaccgggtacggggtaaacccccgaccctacccgttacgaacctaacgccgtaaccgggccgggtaaggaaacgggaccgggagtaccgggaacggtacccgttaacgttaagtttaccgtacggttagtagggtggttaagggtagttagggttacggttagggtggtttcggtaacgtttcggtacgggtacgtcggtaaccggggtaacccggacgggtttaccctaacccgggtcgtaccgggtaccgaacgtaccccggaaacgcccccgtaaaacccgtcgtaccttaccgaaccctttccgggtcccccttaaccccgtcccctaccggttccttaaccgtccgtcgtaacccggttacgg

SEQ ID NO: 135354 - DNA, 769 bp, Homo sapiens
  misc_feature: GYAE6OF01A31WA.49.11.A11.1.454.CMB.1.raw
  modified_base (133)..(133): a, c, t, g, unknown or other
  misc_feature (133)..(133): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (345)..(345): a, c, t, g, unknown or other
  misc_feature (345)..(345): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (489)..(489): a, c, t, g, unknown or other
  misc_feature (489)..(489): n is a, c, g, or t
tcagagtcgagagacacgaccggtgctcgatttagctacgactgcgaggggggcctaaggaagcagcactggtggtgcctcagccagtggcctggaccgttctcctccgtcggcctcctctctcactgcacgngtactctgcgtaccctcctagtgtcgcctagacctcgaccgccctacccgtggttcgtacgcgttccggaccccgtggaaccaggtaccggccgtaggtacttaccggtgggtacgggaaacntaggtaggaagtancgtgngccagtcggacagcgaacgacnccgacggccgaccggcccgtgacggtcgtgtcgtactaggtggtacgnggtccgccggacccggtcgtacgacgggttactcccgngaccgtacggttntccgtcgtcggaccctccgaacgttccggacgggaacccccgtccgaccctacgcgaaccgtcgacgggtccggagaaacgggtcggggaacncgggacgtaccgtacgttacgttacggtcgtacgggtacggtaggttcgggtagttcggttagggtcggtcgggtttcgttcggttcgggtttaccgagggttccgtaacggggtacccgtacggggtacccgtaccggtttaccggaggttaccccgaccgtaaccccggtaaccggttaccccaaacccgtttaccgcccggttaacctcccgttacccggtcccccgttaccgttcccccgttcctcccggttaacctccgttccgccgttaccggg

SEQ ID NO: 135355 - DNA, 731 bp, Homo sapiens
  misc_feature: GYAE6OF01ERIOQ.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtcgacctctatgtgctgactcacgccctacccgtcggtgtcaggtcggccccgtaggacacggacggccgaaggtacttaccgtggggtacggggggaaaacctacgtaagttagggaaagttaaacggacttggtcgacctacggttacgggtaccagacgaacgaacgccgacgggacccgaccgggtccccctggtcgacgttcgggtccttcgtagtgggtgacggtcgggcccggtacccgggtcccgtcggacgggtcctcccgtggacgtcgtactttcgcgtcgcctacgtaccgtcgaccgggaccccgccacccgtcgaccgtactccggaccggtaccgggggtaacgaacgggtacgggagtacgggacgtacgtactttacgttcgtcggtacggtggtgggttacggtagttaggggttgggttaggttcggttcgttcggttgtcgggacgtcggtacgggaccgtgggtccgtaccggtcgtacgtacgaccgaccggaccgcccaacccgtcgtccgtacgcctttcccgtcccgttaccccttcccttcgttcctccgtttccctagccttacggg

SEQ ID NO: 135356 - DNA, 711 bp, Homo sapiens
  misc_feature: GYAE6OF01ADB73.49.11.A11.1.454.CMB.1.raw
  modified_base (324)..(324): a, c, t, g, unknown or other
  misc_feature (324)..(324): n is a, c, g, or t
  modified_base (650)..(650): a, c, t, g, unknown or other
  misc_feature (650)..(650): n is a, c, g, or t
  modified_base (698)..(698): a, c, t, g, unknown or other
  misc_feature (698)..(698): n is a, c, g, or t
tcagagtcgagagacacgaccggtgctcgatttagctacgactgcgagggggggcctaaggaagcagcactggtggtgcctcagccatggcctggaccgttctcctcctcggcctcctctctcactgcacagactctgtcgacctctatgtgctgactcacgcccacccgtcggtgtcgaggtccggcccctggacaggaccggccaggtacttaccgtgggtacggggggaaacacgtagttaggaagtaagacgtgtcgactacgtacggtaccagcgaagaacgccgacggccacggccctgtgcgtggtcgtctagtggngagtcggaccgaccggcctggacgggtctcccgtagacgtcgtatttccgcgtacggtcctacccgaaacgtccggtacccggggaaacccccgcctaaccccgtacgacctaacgtaccggaccgggtaccggggtaacgaaacggggtacggggtagtaccgggaccggaccgttaaccgttagtttaaccgtcggtacggtagggttaggtacggggtattcgggtagggttacggttggtcggttccgtcggtgggacgtccggtacgggaccggtacggtccgtaccgtcgtacggcgaccgacccgacggtccccaaccngttccgaccttcgtcgttacccccggttcccgccttccctcgttaccncgtcgaccgtcgg

SEQ ID NO: 135357 - DNA, 266 bp, Homo sapiens
  misc_feature: GYAE6OF01AGTVM.49.11.A11.1.454.CMB.1.raw
  modified_base (252)..(266): a, c, t, g, unknown or other
  misc_feature (252)..(266): n is a, c, g, or t
tcagagtcgagagacacgaccggtgctcgatttagctacgactgcggggaacccggccaccctgaccatcagccgggtcgaagacggggatgaggccgactattactgtcaggtgtgggatagtggtagtggtgtcgtcttcggagctgggaccagggtcaccgtcctaggtcacgcccaaggccaaccccactgtcactctgttcccaccctcctctctctcgactctgagcgggctggcaggcgcatagnnnnnnnnnnnnnnn

SEQ ID NO: 135358 - DNA, 874 bp, Homo sapiens
  misc_feature: GYAE6OF01CEXGP.49.11.A11.1.454.CMB.1.raw
  modified_base (130)..(130): a, c, t, g, unknown or other
  misc_feature (130)..(130): n is a, c, g, or t
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (370)..(370): a, c, t, g, unknown or other
  misc_feature (370)..(370): n is a, c, g, or t
tcagagtcgagagacacgaccggtgctcgatttagctacgactgcgagggggggcctaaggaagcagcactggtggtgcctcagccatggcctggaccgttctcctcctcggcctcctctctcactgcanagactctgtcgacctcctatgtgctgactcacgccaccctggtgtcaggtcggccctggacgaggacggccaggacttaccgngggtaggggaaacncagttaggaaagtaagacgtgtcgactacgtcggtaaccagacagaacgcgaacggcctaaggcccctggcgtcgttgggtctactagtggtgacgtggcccgaccgcctgagggtacctccgtagacgcgttacttcgtcgngggtacctaccgtaaacgtccgggtaaccggggaaaccccgtccctaacccgtccggaaactaccggtaccggaacggggtaccccgggggtaaacgaaacggggggaccggggtaattacggggaaccgggtacccgttaaacggtttaaaccgtttaacggggttaagggtttaaaccggggtgggttaaaggggtacggtttaacggggtttaacggggttaagggttcgggtttaggttaccccggtttcgggtttaacggggaaaccgggttcggggttaaaccgggggtaaccgggttacggggttaccccggtaacccggtttacccgggttaacgggttaacccgaaccggttaacccccggaaacggggtacccccctaaaaaccccggtaggttacccggtaccctaacccgttcccggttaccccggtttaccccccggcccttttaccccgtcctttaccgtacccggttacgacccgtttccggtacgggg

SEQ ID NO: 135359 - DNA, 756 bp, Homo sapiens
  misc_feature: GYAE6OF01AV4K5.49.11.A11.1.454.CMB.1.raw
  modified_base (620)..(620): a, c, t, g, unknown or other
  misc_feature (620)..(620): n is a, c, g, or t
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagcccacccgtcggtcgtcagtcggcccctggacaggacggtccaggtattaccgtggtacgggggaaacacgtatttacgggaaagttaagacttggtagaccaaccgttgggtaacccaaggccaacggaaacggcccgaacgggccccaacgggtccccccgttggtcggtccgttcggggttccggttccgttaagttggggtaggtaacgttcgggacccggaacccggtccccgttacggaagggggtaccttccccgtaggaacgccggtaatttcccgtacgtcggacctacccgaaacgtccggtacggggaaacccccggcccaaccccgtggaacccctagtcccgaacgggtcccgggtacgaacgggacggggtatacgggacggaccggtacttaacgttaccgtacggtaccgtacggtggtacgggacgtaggtagtagtgagtacngtgtggtcggtcggacgggacggtaccgaagcgtcgaccgtccgtacggacgtaccgcccggtaacggtccgtacccgcccccgttcggaccctaccgttccgttcccgttcccaccgttccctcccgttctcccg

SEQ ID NO: 135360 - DNA, 705 bp, Homo sapiens
  misc_feature: GYAE6OF01BRNTC.49.11.A11.1.454.CMB.1.raw
  modified_base (178)..(178): a, c, t, g, unknown or other
  misc_feature (178)..(178): n is a, c, g, or t
  modified_base (594)..(594): a, c, t, g, unknown or other
  misc_feature (594)..(594): n is a, c, g, or t
  modified_base (693)..(693): a, c, t, g, unknown or other
  misc_feature (693)..(693): n is a, c, g, or t
tcagagtcgagagacacgaccggtgctcgatttagctacgactgcagggggggcctaaggaagcagcactggtggtgcctcagccatggcctggacccgttctcctcctcggcctcctctctcactgcacagactctgtcgacctcctatgtgctgactcacgcccacccgtcgggtntcacggtcggcccctggaccagaccggccaggtattacccgtgggtacgggggaaaacgactagttagggaaagttaacgaccgttggtcgacctacgtcgggtaccaaggccaagaacgccgacggcccgacggccccctggtcgtaccgttcggttccggtccttaagtgggtcgtaacggtcggccggaaccccgtcccgtcgaacggggtacctcccgtggaaccgtcggtacttcgtcgtcggtctaccctaacgtcgtacgggaaccccgccctacccgtacgaccacgtccgaacggccccgggtaggaaaccgggtacggggactcggacgtccggtaacttaacgttaccgtggtacgacgggttggtacgggtagtacggtggtagtcggtcgttcgtcgtacggngtcggtggaccggtggtaccgcccggtactccgacgcggtacccgacggtaccccaacctcgtccgatacctcgtcccggtccccgtccctctactccncgtcgtcgtccg

SEQ ID NO: 135361 - DNA, 263 bp, Homo sapiens
  misc_feature: GYAE6OF01C9MCZ.49.11.A11.1.454.CMB.1.raw
  modified_base (193)..(193): a, c, t, g, unknown or other
  misc_feature (193)..(193): n is a, c, g, or t
  modified_base (248)..(248): a, c, t, g, unknown or other
  misc_feature (248)..(248): n is a, c, g, or t
  modified_base (254)..(263): a, c, t, g, unknown or other
  misc_feature (254)..(263): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcgtgggaccagggtccaccgtcctaggtcagcccaaggcccaacccntgtcactctcgttcccaccctcctctctctcgactctgagcggctggacaaggcncatagnnnnnnnnnn

SEQ ID NO: 135362 - DNA, 697 bp, Homo sapiens
  misc_feature: GYAE6OF01CCF1S.49.11.A11.1.454.CMB.1.raw
  modified_base (329)..(329): a, c, t, g, unknown or other
  misc_feature (329)..(329): n is a, c, g, or t
  modified_base (369)..(369): a, c, t, g, unknown or other
  misc_feature (369)..(369): n is a, c, g, or t
  modified_base (418)..(418): a, c, t, g, unknown or other
  misc_feature (418)..(418): n is a, c, g, or t
tcagagtcgagagacacgaccggtgctcgatttagctacgactgcgagggggggcctaaggaagcagcactggtggtgcctcagccatggcctggaccgttctcctcctcggccctcctctctcactgcacagactctgtcgacctcctatgtgctgactcacgcccacccgtcggtgtcaggtccggccctaggacaggaccggccaaggtacttaccgtaggggtacgggggaaaacacgtagttagggaaagtaagacgtgtcggacacgtcggaccagacagacgccgacggccgtttacggcccgtggtcgtcgtaggtccgtntagtggtgcgtcgggccgaccggtccctggacggctccgngacgcgtacttccgcgtcggtcctaccgaacgtccggacccgggacccncccaccgtacgacctacgtacggaccggccggtagaacgggacgggtagacggacgaccgtaacttacgttacgtcgtaggtagggttcggagggtaacgttagggtaggttaggttcggttcgttcggttcggttcggagtcgggtacgggaccggtcggtacgtaccgtcgtacggaccacccggaccgaccgtacccgaacccgtgtaccgtccgttaccctcccgttcccgtaccccgtcccttacccttccttaccgtcccttcgtccggttcg

SEQ ID NO: 135363 - DNA, 260 bp, Homo sapiens
  misc_feature: GYAE6OF01DLH0A.49.11.A11.1.454.CMB.1.raw
  modified_base (251)..(260): a, c, t, g, unknown or other
  misc_feature (251)..(260): n is a, c, g, or t
tcagagtcgagagacacgaccggtgctcgatttagctacgactgcagggaacccggccaccctgaccatcagccgggtcgaaagacggggatgaggccgactattactgtcaggtgtgggatagtggtagtggtgtcgtcttcggagctgggaccagggtcaccgtcctaggtcagcccaaggccaaccccatgtcactctgttcccgcctcctctctctcgactctgagcgggctggcaaggcgcatagnnnnnnnnnn

SEQ ID NO: 135364 - DNA, 273 bp, Homo sapiens
  misc_feature: GYAE6OF01ETREP.49.11.A11.1.454.CMB.1.raw
  modified_base (231)..(231): a, c, t, g, unknown or other
  misc_feature (231)..(231): n is a, c, g, or t
  modified_base (254)..(273): a, c, t, g, unknown or other
  misc_feature (254)..(273): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcgtgggaccagggtcaccgtcctaggtcacgcccaaggccaaccccatgtcactctcgttcccacctcctctctctcgactctgnggcggctggacaggcgacagtgnnnnnnnnnnnnnnnnnnnn

SEQ ID NO: 135365 - DNA, 772 bp, Homo sapiens
  misc_feature: GYAE6OF01ARTIT.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcacgcccacccgttcggtgtcaggtcggcccctgggacaggaccggccagggtacttaccgtgggtaggggggaaaaccactagtttagggaaagtaacgacgtggtgcacgttggaccagcagaacgccgaggcccacggtcccctggtcgcgttggtcgtcgtagtgggtgagtcgggccgacccggccctgacgggactcccgtaggacgtcgtattccgtcgtcggtcctaccgtaaccgtccggtaccggggaaccccggcccacccgtcgacctacgtccgacggtcccggggtacgaacgggacgggtagtcggacggtaccgtaacttacgttacgtgtacggtagggttcgggtagggtacgttagggttagggttacgggttgggttccggttcgggttacggttacgggtacggtcgggtacggggtacccgggtacgggttacccggtacccggttccggtaacgggtccgaacccggtacccggaaacccggtaccccctaaacccccgtacgttccgttaccctaccggttcccgtttcccgtaccccccgttaccccttcccgttacccttcccgttacccgtccgttaacgttcccggg

SEQ ID NO: 135366 - DNA, 773 bp, Homo sapiens
  misc_feature: GYAE6OF01AWW3M.49.11.A11.1.454.CMB.1.raw
  modified_base (756)..(756): a, c, t, g, unknown or other
  misc_feature (756)..(756): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactcctgtcgacctcctatgtgctgactcacgcccacccgtcggtgtcaagtcggcccctaggacaggaccggccgaggtacttaccgtgggtacgggggaaacacgtagttacggaagtaaagtacgtggtcgcgtacgttacggtaccagacagaacgccgaacgggcccacgggtccccgtaggtcgccgtggtccgtacgtacgtgggtgaggttcggaccggtacccggcccgtacggacggggtaccttccccgtaggacgtacgtaacttccgttccgtacgggtcccttaaccgtaaaccgttccggtacccggggaacccccggtaccctaccccgtacgaacccgacggtaccgaccgggtaccgggtaacgaaacggggtacggggacgtcgggaacggtaccgtacttacgtacgttacggacggtaggtaggtacgggagttaggttgggtaagttcgggttcgtcgttcggtcgggaccggtcggtacgggtaccgtacgggttacccgtacccggttcggtaacggtaccgtcccggaaccgtaacccggacccctaaacccgtccgtcgtacccgtccttaccgtcccgttcccctcccgtccttcccnctctcccgtcgtaccgg

SEQ ID NO: 135367 - DNA, 786 bp, Homo sapiens
  misc_feature: GYAE6OF01BGKP8.49.11.A11.1.454.CMB.1.raw
tcagagtcgagagacacgaccggtgctcgatttagctacgactgcagggggggcctaaggaagcagcactggtggtgcctcagccatggccctggaccgttctcctcctcggcctcctctctcactgcacagactctgtgacctctatgtgctgactcacgccctacccgtcggtgtcacggtcggcccctggacacggacggccaggacttaccgtgggtagggggaaacactagttagggaaataagctaggtgactacgtcggtaaccagacaggaacgccgacggaccgaccggccccttaggcgtcgtcgggttccgtataggttgggtagaacgtcgggtacccggacccgggtccctaggaacggggtacctcccgtagacggtcgtacttccgagtcggcctacgtaaccgttcggaccggggaaccccgtaccacccgtacgacctacgtacgacgggtacccgggtaaggaacgggaccgggtataccgggaccggtacccgtaatttaacggtcggttaggacggttaacgggttagggtacgggtaagttggggttaaggggttacgggttgggtccgggtttacgttccgggttaacggggactacgggtttaccgggggaaccgttccggggtaccttacccgggtacgttacgggacctaacccggacccgaacccggtccccaaacccgtggttaccgtacccttaccggttccttccccggttaacccccacccgtttccttaacccttctacccgagtaccgttcggg

SEQ ID NO: 135368 - DNA, 331 bp, Homo sapiens
  misc_feature: GYAE6OF01AP1P7.49.11.A11.1.454.CMB.1.raw
  modified_base (196)..(196): a, c, t, g, unknown or other
  misc_feature (196)..(196): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (257)..(260): a, c, t, g, unknown or other
  misc_feature (257)..(260): n is a, c, g, or t
  modified_base (262)..(262): a, c, t, g, unknown or other
  misc_feature (262)..(262): n is a, c, g, or t
  modified_base (267)..(331): a, c, t, g, unknown or other
  misc_feature (267)..(331): n is a, c, g, or t
tcagagtcgagagacacgaccggtgctcgatttagctacgactgcagggaacccggccaccctgaccatcagccgggtcgaaggacggggatgaggccgactattactgtcaggtgtgggatagtggtagtggtgtcgtcttcggagctgggaccaggtccaccgttcctaggtcagccccaaggcccaacccccntgtccacttctgttcccaccctctctctctcactctgagcgggctggcaggcncatagngnnnngncgagnnnnnnnnnnnnnnnnnnnnnnnnnnnnnnnnnnnnnnnnnnnnnnnnnnnnnnnnnnnnnnnnn

SEQ ID NO: 135369 - DNA, 762 bp, Homo sapiens
  misc_feature: GYAE6OF01CZDB3.49.11.A11.1.454.CMB.1.raw
  modified_base (172)..(172): a, c, t, g, unknown or other
  misc_feature (172)..(172): n is a, c, g, or t
  modified_base (680)..(680): a, c, t, g, unknown or other
  misc_feature (680)..(680): n is a, c, g, or t
  modified_base (719)..(719): a, c, t, g, unknown or other
  misc_feature (719)..(719): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccacccgtggtntcaggtcggcccctggaccaggaccggccagggtacttaccgtgggtaggggggaaaaccactagttagggaaagtacgactgtcgctacgtggtaccagacagaacgccgacggcccacggcccctgtcgcgtggtcgtctagtgggtagacgtcgggaccgacccggccgttacggacgggtactccccgtagacgtccggtattaccgtcgtcggtccctaccgtaaaccgtcggtacccggggaacccccgtccctaaccccgttaccgaaccgtacgtaccgggtacgggtacccgggggtaacgaaacggggacggggtacgtacgggtaaccgggtacccgtaagtttacgttacggtaggtacgtacgggtagtaggggtattaggggtcggttaggtcggttacggtcgttacgtacgggacgtcggtacgggtaccgtaggggttcccacccgttcggtaacggtccgaacgaccccggtaaccgaccctaaccccgngttccgtccttaacccgtccgttccccggtttacccccncccgtttccctcccgttaccttcccgtccggtccgttaccggg

SEQ ID NO: 135370 - DNA, 258 bp, Homo sapiens
  misc_feature: GYAE6OF01DXRI8.49.11.A11.1.454.CMB.1.raw
  modified_base (252)..(258): a, c, t, g, unknown or other
  misc_feature (252)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnnnn

SEQ ID NO: 135371 - DNA, 339 bp, Homo sapiens
  misc_feature: GYAE6OF01DLFN4.49.11.A11.1.454.CMB.1.raw
  modified_base (217)..(217): a, c, t, g, unknown or other
  misc_feature (217)..(217): n is a, c, g, or t
  modified_base (272)..(274): a, c, t, g, unknown or other
  misc_feature (272)..(274): n is a, c, g, or t
  modified_base (276)..(339): a, c, t, g, unknown or other
  misc_feature (276)..(339): n is a, c, g, or t
tcagagtcgagagacacgaccggtgctcgatttagctacgactgcagggaacccggccaccctgaccatcaggccgggtcgaaggacggggatgaggccgactattactgtcaggtggtgggatagtggtagtggtgtcgtcttcggagctggaccagggtcaccgtctagtcacgcccgaagccctaacccacgtcgtcacttcttccggtccccnccttcctctcctcgtcactctaggacggtcggcgtggaacaggcccagagtacgnnnannnnnnnnnnnnnnnnnnnnnnnnnnnnnnnnnnnnnnnnnnnnnnnnnnnnnnnnnnnnnnnn

SEQ ID NO: 135372 - DNA, 867 bp, Homo sapiens
  misc_feature: GYAE6OF01B6X0K.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggccctggacaggacggccaggacttaccgtggtagggggaaacactagttagggaaagtaagactgtgacacgtggtaccagacaagaacgccgacggccacggccctgtgcgtggtcgtctagtgggtcgagtcggaccgacccggtcccgtacgacggggtctacccgtggaaccgtcgtacgttccgtcgtcggtcctacccgaacgttcccgggtaccggggaacccccgtacccctacccgtacggaaccctacgtaccggaacgggacccggggtacggaaagggaccggggtacgtcgggaaccgggtacccggtaacgttaacgtttaaccggtggttacggtaagggttagggttaggggtaacggtttaggggttaggggttacgggtttcggggtttaccgggtttacgggtttaccggtttcgggggaacggttcccgggttaacgggggacccgggttaccgggggtaccccggttaacccgggttaccggttaacccgggtacccgtaaccccggtaaccccggtaaaccccgggtaaccccccgtaaaacccccggttacggttaccccgggtacccttacccggtttccccggtttaccccgtttacccccccttaaccccggtttcccttacccgttccccgtttacccgttaccggtaacccttcccggg

SEQ ID NO: 135373 - DNA, 624 bp, Homo sapiens
  misc_feature: GYAE6OF01B4N3O.49.11.A11.1.454.CMB.1.raw
  modified_base (189)..(189): a, c, t, g, unknown or other
  misc_feature (189)..(189): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
tcagagtcgagagacacgaccggtgctcgatttagctacgactgcaggggaacccggccacctgaccatcagccgggtcgaagacgggatgaggccgactattactgtcaggtgtgggatagtggtagtggtgtcgtcttcggagctgggaccagggtcaccgtctaggtcacgcccaaggccaacccntcgtcactctcgttcccaccgtcctcgtctcctcactcgtagacggtccgggtatgggactaacggcactaagtagcngtcatcaggcgtanacgancgngacgtcgtacgacgngtcgcacgtntacgtacgcgtacgtacgtgtacgtacgtacgactacgtactacgactagtacgtagtacgtacgtacgtacgtacggtacgtacgtacgtacgtacgtactacgtacgacgtacgtacgtacgacgacgtacgtcgtagactacgtagtacgtacgtaacgactacgtacgtacgtagtacgtacgtacgatacgtacgtacgtacgtacgtacgtacggtacggtacgacgtacgtacgtacggtacgacgtacgtacgtacgtacacggtacgacgtacgtacgtacgtacgtactctccgtctacg

SEQ ID NO: 135374 - DNA, 288 bp, Homo sapiens
  misc_feature: GYAE6OF01BCEJ5.49.11.A11.1.454.CMB.1.raw
  modified_base (190)..(190): a, c, t, g, unknown or other
  misc_feature (190)..(190): n is a, c, g, or t
  modified_base (208)..(208): a, c, t, g, unknown or other
  misc_feature (208)..(208): n is a, c, g, or t
  modified_base (256)..(288): a, c, t, g, unknown or other
  misc_feature (256)..(288): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagcgtggaccagggtcaccgtctaggtcacgcccaaggccaacccntgtcactctcgttccccnccctctctctctcgctctgacgcgggctcggacgaaggcgacatagcnnnnnnnnnnnnnnnnnnnnnnnnnnnnnnnnn

SEQ ID NO: 135375 - DNA, 784 bp, Homo sapiens
  misc_feature: GYAE6OF01CD1QI.49.11.A11.1.454.CMB.1.raw
  modified_base (650)..(650): a, c, t, g, unknown or other
  misc_feature (650)..(650): n is a, c, g, or t
tcagagtcgagagacacgaccggtgctcgatttagctacgactgcagggggggcctaaggaagcagcactggtggtgcctcagccatggcctggaccgttctccctcctcggcctcctctctcactgcacagactctgtcgacctctatgtgctgactcgacgcccacccgtggtgtcaggtcggcccctgggaccaggaccggccaggtactttaccgtagggtacgggggaaaactacgtagttagggaaacgttaagcttaggtcgctacgttacgggtaaccaggtccgaaggaaccgccgaacgggcccaccgggtccccctaggttcggaccgttagggtacgtaccgttaggtcgggtagtacggttcggggacccggaccccggtcccgtcggaacgggtacctccccgtaggtaccggtcggtattccgtaccggttcggtacccctacgtaacgttccggtaccccggggtaacccccgtcccgtaacccgtacggtacccgtacgtacccggtacgggtacccgggtaacggaacgggtacggggtagtaccggacgggtaccgtacgtttacgtacgtcggtagtcgggtagtagggttagtaggttcgggttggtcgggttcgtcggttcggtacgngggtaccgtcgggtacccggtacgggaccttccggtaccgtaccggtcgaaccgacccgtaccgaccccgtaccctagtccgtaccaccgttctaccgttcctaccgtcccttccgtctccgtccgtgtacccg

SEQ ID NO: 135376 - DNA, 272 bp, Homo sapiens
  misc_feature: GYAE6OF01AYEBH.49.11.A11.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (251)..(272): a, c, t, g, unknown or other
  misc_feature (251)..(272): n is a, c, g, or t
tcagagtcgagagacacgaccggtgctcgatttagctacgactgcaggggaacccggccaccctgaccatcagccgggtcgaagacgggatgaggccgactattactgtcaggtgtgggatagtggtagtggtgtcgtcttcggagcgtgggaccagggtcaccgtcctaggtcagcccaagcccaaccccntgtcactctcgtcccacctctctctcnccactcgtgacgcggctggacaggcncatagnnnnnnnnnnnnnnnnnnnnnn

SEQ ID NO: 135377 - DNA, 793 bp, Homo sapiens
  misc_feature: GYAE6OF01A2N06.49.11.A11.1.454.CMB.1.raw
  modified_base (173)..(173): a, c, t, g, unknown or other
  misc_feature (173)..(173): n is a, c, g, or t
  modified_base (207)..(207): a, c, t, g, unknown or other
  misc_feature (207)..(207): n is a, c, g, or t
  modified_base (312)..(312): a, c, t, g, unknown or other
  misc_feature (312)..(312): n is a, c, g, or t
tcagagtcgagagacacgaccggtgctcgatttagctacgactgcgagggggggcctaaaggaagcagcactggtggtgcctcagccatggcctggaccgttctcctcctcggcctcctctctcactgcacagactctgtgacctctatgtgctgactcagcccaccctggtntcagtcggccctggacagacgcaggtattaccgnggtaggggaaacatagttaggaagtaacgactggtcgactacgtcgggtaaccagaccgaagacgaccgaggcccgtacggccccctggtcgcgtaggtccgttntagtgggtgagtcggccggaccgcccgtacggacgggtacctcccgtagacggcgtacgttccgtcgtccgtcctaacccgacgttccggtaccggggaacccccgtcccgaaccccgttgaacccgttacgacccggaaccggggtacccgggggtacggaaaccggggaacgggggtataaccggggacggacccgtaagttacgttaacgttggtaacgtaggggttcggtagggtaacgttggggttacggtagggttcgggttcggttaccgggttacgttacgggaggtcccgggttaacggggaccggtacggggtaccctaaccggttcccgtaagggtacccgtaccggacccggtaacgtaaaccccccgtaaccctaacggtccgtccccgtaaccgtttcccgttaccccggtccccccggttccccttaccgttcccgttcccgttccttacccggtaccttccgggg

SEQ ID NO: 135378 - DNA, 780 bp, Homo sapiens
  misc_feature: GYAE6OF01EFLRC.49.11.A11.1.454.CMB.1.raw
  modified_base (139)..(139): a, c, t, g, unknown or other
  misc_feature (139)..(139): n is a, c, g, or t
  modified_base (150)..(150): a, c, t, g, unknown or other
  misc_feature (150)..(150): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtnacctctatgtnctgactcacgcccaccctcggtgtcaggtcggccctaggacacggaccggccagggtacttaccgtagggtacggggggaaaacctcgtaggttagggaaacgttaagacttggtacgctacgttcgggtaaccaggacgaacgaacgaccgacggtcccaccgggtcccccgttggtacggtcgttcgggttacgtacgttaaggttcgggtagacgttcggggacccggacccggtcccgttacggacgggtacctcccgtaggacgtccgtacttccgtcgtcggcctaccgaccgttccggaccgggaccccgacctacccgtcgaccctagtaccgacgggtaccgggtaacggaacgggacgggtagacggaccggtacctaacgttacgttacgtggtaccggtaggttagggtacggtaggttacggtgggttagttggtccgtttcggttccggtacgggtcgtcggtaccgggaacggtcgggtaccgttaccgggttcgacggtaccgaaccggaccccgaacggaccccgtaaccgtgtaccgtacctaccgttccgttaccccggttacccctaccccgttccttcttacccgttcccgttaccgtcgttaaccggg

SEQ ID NO: 135379 - DNA, 292 bp, Homo sapiens
  misc_feature: GYAE6OF01AMZSW.49.11.A11.1.454.CMB.1.raw
  modified_base (243)..(243): a, c, t, g, unknown or other
  misc_feature (243)..(243): n is a, c, g, or t
  modified_base (248)..(292): a, c, t, g, unknown or other
  misc_feature (248)..(292): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaagccaacccatgtcactctgttcccaccctctctctctcgactctgagcgggctggcaaggcgnatagnnnnnnnnnnnnnnnnnnnnnnnnnnnnnnnnnnnnnnnnnnnnn

SEQ ID NO: 135380 - DNA, 749 bp, Homo sapiens
  misc_feature: GYAE6OF01BYLT7.49.11.A11.1.454.CMB.1.raw
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgcctgactcacgcccaccctcggtgtcaggtcggcccctggacacggacggccaggtacttaccgtggtacgggggaaacacgtagttagggaaagtaagtactggtcgcacgtacggtaccagcgaagaacgccgaggcccgacggcccctggtcgcgttggtccgttcgtagtggtgacgtcggaccgcccggccttcggacgggtctcccgnggtacncggtacttcgcgtcggtacctaccgaaccgttccggtaccggggacccctaccaccccgtacggaccctaacgtccgaccgggtaccggggtaacgaaacggggttacggggaacgtcgggtaaccgggaccgtaaccgttaacgtttcgtacggtaaccgttggggttaggtagggtacgttagggttgggtaacggtttgggtacggtttccggttacgggtcgggtacggtcgtaccgggggacgtacggggttacccgtaaccggtcgttacggccgaaccgaccccggaacgtaccccaacccggttactcgtaccctccgttccgtcccgttaccccgtccccttactcgtaccctccgtccgtcgttcggg

SEQ ID NO: 135381 - DNA, 520 bp, Homo sapiens
  misc_feature: GYAE6OF01A6KV3.49.11.A11.1.454.CMB.1.raw
  modified_base (151)..(151): a, c, t, g, unknown or other
  misc_feature (151)..(151): n is a, c, g, or t
  modified_base (264)..(266): a, c, t, g, unknown or other
  misc_feature (264)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (277)..(278): a, c, t, g, unknown or other
  misc_feature (277)..(278): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (284)..(285): a, c, t, g, unknown or other
  misc_feature (284)..(285): n is a, c, g, or t
  modified_base (287)..(288): a, c, t, g, unknown or other
  misc_feature (287)..(288): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (307)..(308): a, c, t, g, unknown or other
  misc_feature (307)..(308): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (328)..(330): a, c, t, g, unknown or other
  misc_feature (328)..(330): n is a, c, g, or t
  modified_base (335)..(335): a, c, t, g, unknown or other
  misc_feature (335)..(335): n is a, c, g, or t
  modified_base (339)..(340): a, c, t, g, unknown or other
  misc_feature (339)..(340): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (394)..(394): a, c, t, g, unknown or other
  misc_feature (394)..(394): n is a, c, g, or t
tcagagtcgagagacacgaccggtgctcgatttagctacgactgcaggggaacccggccaccctgaccatcgagccgggtcgaaagacgggggatgaggccgactattactgtcaggtgtgggatacgtggtagtggtgtcgtcttcgganctgggacctaggtcaccgtctaggtcagcccaaggcccaacccctatgtccactcctggtcccacctctctctctcacgtctgacggcgggatgggacaggtcactagtagcnnntngntacgncnncngngnnannacngncgntcgnacngacnncgncagcnctcngacnagtnnnaacgntcgnnacngagacagntcacgtntcgctacgntagtantacgtnatcctaagcgtaacncgtctacgtcgtacgtactcgtacgtcgtacgtacgtacgtacgtacgacgtacgtacggtaccgtacgtacgtacgtacgacgtacgtcgacgtacgtacgtacgtactacgtcgtacgtcgtcg

SEQ ID NO: 135382 - DNA, 279 bp, Homo sapiens
  misc_feature: GYAE6OF01B10E2.49.11.A11.1.454.CMB.1.raw
  modified_base (250)..(250): a, c, t, g, unknown or other
  misc_feature (250)..(250): n is a, c, g, or t
  modified_base (257)..(279): a, c, t, g, unknown or other
  misc_feature (257)..(279): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaaggccaaccccatgtccactcttgttcccaccctccgtctctctcgactctgagcgggctggacaaggcncaatcgnnnnnnnnnnnnnnnnnnnnnnn

SEQ ID NO: 135383 - DNA, 289 bp, Homo sapiens
  misc_feature: GYAE6OF01AQCHP.49.11.A11.1.454.CMB.1.raw
  modified_base (257)..(289): a, c, t, g, unknown or other
  misc_feature (257)..(289): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctcgttcccaccctcctcttctctcgactctggagcgggctggacgaaggcgcatagnnnnnnnnnnnnnnnnnnnnnnnnnnnnnnnnn

SEQ ID NO: 135384 - DNA, 261 bp, Homo sapiens
  misc_feature: GYAE6OF01CQ9FF.49.11.A11.1.454.CMB.1.raw
  modified_base (252)..(261): a, c, t, g, unknown or other
  misc_feature (252)..(261): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaaggccaaccccatgtcactctgttcccaccctcctctctctcgactctgagcgggctggcaaggcgcatagnnnnnnnnnn

SEQ ID NO: 135385 - DNA, 738 bp, Homo sapiens
  misc_feature: GYAE6OF01CDK2Z.49.11.A11.1.454.CMB.1.raw
  modified_base (221)..(221): a, c, t, g, unknown or other
  misc_feature (221)..(221): n is a, c, g, or t
  modified_base (269)..(269): a, c, t, g, unknown or other
  misc_feature (269)..(269): n is a, c, g, or t
tcagagtcgagagacacgaccggtgctcgatttagctacgactgcgagggggggcctaaggaagcagcactggtggtgctcagccatggcctggaccgttctcctcctcggcctcctctctcactgcacagactctgtcgacctcctatggtcgactgactcacgcccaccgtggtacgtcgacggtcggcccctggacacggacggcaaggtacttccgngggtaacgggggaaaccacgtagttaggaagtaacgtacgttggtacnctacgtcgggtaaccagacgaacggaacgtccgacgggccgacggtcccctggtcgtccgttcggtccgttactaggtggtcgtaacgtccggggaccgtaccggtcccgtaggaacgggtcctaccgtggacgtacgttctcgtcgtactccggtactaccggtcgacccgggaccccgccaacgcgtaaccacgtcgaaccggttcggaacggagggtacggtacggtggaacgggtaccgtacttacgtacgtgtacggtacgggtggtagggtgtacggttgggttacggttcgggtcgtcggttcggtacgggagtcggtacggtacggtaccggtcggtaccgttcggacgtaccgacccggttacccgaaccggaccctaccccgtacgtaccgtacgttacccgtccgttacccggtcccctacccgttccgttaccttccgtacgtcccgtcgttccggg

SEQ ID NO: 135386 - DNA, 262 bp, Homo sapiens
  misc_feature: GYAE6OF01DCYUH.49.11.A11.1.454.CMB.1.raw
  modified_base (254)..(262): a, c, t, g, unknown or other
  misc_feature (254)..(262): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggctcgccccctcggtcactctcgttcccgccctcctctctctcgactctgagcgggctggcaaggcgcatagnnnnnnnnn

SEQ ID NO: 135387 - DNA, 773 bp, Homo sapiens
  misc_feature: GYAE6OF01CCFTC.49.11.A11.1.454.CMB.1.raw
tcagagtcgagagacacgaccggtgctcgatttagctacgactgcgagggggggcctaaggaagcagcactggtggtgcctcagccatggcctggaccgttctcctcctcggcctcctctctcactgcacagactctgtcgacctctatgtgcctgactcagccctacccgtcggtcgtcagtcggcccctggacagacggccaggtacttaccgtgggtaggggaaacagtagttaggaaagtaagactggtcgctacgtacggtaccagacgaaggaacgccgacggcccaccggccccgttggtcgacggttcggttcgtcgtacgtgggtgacgtcgggccggacccggtccccgtaggaccgggtactccgtaggacgtacgtcttacgtcggtcgtcctaccgtaacgttccgggacccgggaaccccggtcccacccgtacgacctacgtccgaccgggtacgggtaacggaacggggtacggtacggtacggaccgggaccgtactttaacggttcgtacggttacggtaggggttggtagggtacgttaggggttcggttaggtcgggttggttccgtcggttcgggagtcccgggttagggaccggtcgggtaccctacccgggtacgtacgggtaccgacccgggacccgaacggaccccccgtaaaccgtcgttacccgtacccgttacccgttcccgttccccgttccccccgttccccttccgttcccttaccggttcccgtaaccgttccgtcccggg

SEQ ID NO: 135388 - DNA, 711 bp, Homo sapiens
  misc_feature: GYAE6OF01CXUBO.49.11.A11.1.454.CMB.1.raw
  modified_base (223)..(223): a, c, t, g, unknown or other
  misc_feature (223)..(223): n is a, c, g, or t
  modified_base (260)..(260): a, c, t, g, unknown or other
  misc_feature (260)..(260): n is a, c, g, or t
  modified_base (687)..(687): a, c, t, g, unknown or other
  misc_feature (687)..(687): n is a, c, g, or t
tcagagtcgagagacacgaccggtgctcgatttagctacgactgcgagggggggcctaaggaagcagcactggtggtgcctcagccatggcctggaccttctcctcctcggcctcctctctcactgcacagactctgtgacctcctagtgtgctgactcacgcccaccctggtgtacagtcgccctggacagacgccaggacttaccgtggtaggggaaaccntagttaggaaagtagacttggtgactacgtaggaccngacagaacgtccacggccacggtcccctagtcggctcggtccgtatagtggtgacgtcggaccgacccggtccctaggaccgggtacttcccgaggaacgtcgtacttcgctggccttacagtcctaacggacggaactaacgcgtacctacgtcaaccgtatacgtaggcggcgtacccggacgagggtacggacgacgggtactcggtaacttaacgttcgtacgtacgtacggtcccgagaacggacgacgtaccggagttacgtaccgttaagtttaccggtcgtttacgggttaacgccggggttagggaacccgggttacctaaaccgggccggttaaccgtaaccccggttccgggtaaccggtccgtaaacccggtcccgaaacggtccccgttaccccggtaccccgttccgtaaccnccccggttttcgttacccccccgg

SEQ ID NO: 135389 - DNA, 996 bp, Homo sapiens
  misc_feature: GYAE6OF01DBP6M.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtcgacctctatgtgctcgacctacgacgcccctaccccgtcgggttcgtaccgtacggtcccgggtccccgtacgggaccgacggaccggtcccgtaagggtaaccttacccggttaggggtaaacggggggaaaaacctaacgtaaggtttaagggaaaagttaaacggtaccgttggtacggacctaacggtacgggtaaccaaggtaccgaaacggaccggacccgaaccggggacccgaaccgggtcccccctttgggtaccgtcggttcgggttacccgttacgttaggttcggggtagtaccggtcggggtaccccggtaacccggcccggtacggacggggttacctcccggtagggacgttaccgtacttaccgtcggtcggtccctaaccgaccgttaccgggaaccccgggaacccctcccgtaacctccgaacctacggtccgaccggggtaccgggaacggaaaggggtcccgggtagtaccgggaccggtaccgttaacggttaccttacggttacggtaccgggtaggggttagggtacgggttaagttaggggttacgggttaaggggtttcggtttacgggtttaccggtttacggtaccgggtacgggtacccgggttacggggaaacccggttacccgggtacccgttaccccgggttaccgttacccgggtaccggtaaccccggtaaccccgggtaaaaccccggaacccccgtaaccccgtccggttaacccgtcccgtttacccggttccccgttacccccggttccccccgttacccccgtttcccttacccccgttcccgtttaaccccggtacccggtaccgtttaacccgggg

SEQ ID NO: 135390 - DNA, 913 bp, Homo sapiens
  misc_feature: GYAE6OF01BLCSG.49.11.A11.1.454.CMB.1.raw
  modified_base (443)..(443): a, c, t, g, unknown or other
  misc_feature (443)..(443): n is a, c, g, or t
tcagagtcgagagacacgaccggtgctcgatttagctacgactgcgagggggggcctaaggaagcagcactggtggtgcctcagccagtggcctggaccgttctcctcctcggcctcctctctcatgcacagctctgtcgacctcctagtgtgctagacctcgacgccctacccgttggtcgtcgacggtccgcccgtggacgacgaccggtcaaggtacttacggtggggtaaaccggggaaactacgtacggttaagggaaacgtaacggtcgttacggtcgacgtacgtacgggaaccaggacgaaggaccggaccgtaccggacccgacggtccccgttggtcggtaccgttcgggtaccgttaggttacggttcgggtacgtacgggtcccgggaacccggtacccggtccccgtaggggtaaccggtccttaccggnggtaccgtacgttaccgttttccgacggtaccgtccctaaccggtaccggtaacccgggtacccggggaaacccctcccttaaacggcccaaacgtcccggttaacgggaccggggtaaccccggggtaaaggaaccggggttaacgggaccggtaccgggtaacgtaccggtaacgttacgtacgtagtacgggtaggtacgggtaggtacggttagggtaggttacgggttcggttcggttcggttcggttaccgggacggtaccgggtaccggtaccgggtaccgggtacccggttaacgggttacccgttacgggacccgtacccggaacccggtaacccgacccggtaaacccggttacgttacccggtcccggttaacccgttcccggtttaccccggttccccggtaccccttacccggttacccttacccggtcccgttaaaccgttcccgggtaacccggg

SEQ ID NO: 135391 - DNA, 284 bp, Homo sapiens
  misc_feature: GYAE6OF01A1B9K.49.11.A11.1.454.CMB.1.raw
  modified_base (258)..(284): a, c, t, g, unknown or other
  misc_feature (258)..(284): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagccaaggccaacccactgtcactctcgttccccaccctcctctctctcgactctgacgcgggtcgtggacaaggcgacagtagnnnnnnnnnnnnnnnnnnnnnnnnnnn

SEQ ID NO: 135392 - DNA, 270 bp, Homo sapiens
  misc_feature: GYAE6OF01DCBXX.49.11.A11.1.454.CMB.1.raw
  modified_base (254)..(270): a, c, t, g, unknown or other
  misc_feature (254)..(270): n is a, c, g, or t
tcagagtcgagagacacgaccggtgctcgatttagctacgactgcagggaacccgccaccctgaccatcagccgggtcgaagacggggatgaggccgactattactgtcaggtgtgggatagtggtagtggtgtcgtcttcggagctgggaccagggtcaccgtcctaggtcagcccaaggcccaaccccatgtccactctcgttccccaccctcctctctctcgactctgagcgggctggcaaggcgcatagnnnnnnnnnnnnnnnnn

SEQ ID NO: 135393 - DNA, 786 bp, Homo sapiens
  misc_feature: GYAE6OF01BWKN0.49.11.A11.1.454.CMB.1.raw
  modified_base (169)..(169): a, c, t, g, unknown or other
  misc_feature (169)..(169): n is a, c, g, or t
  modified_base (488)..(488): a, c, t, g, unknown or other
  misc_feature (488)..(488): n is a, c, g, or t
  modified_base (502)..(502): a, c, t, g, unknown or other
  misc_feature (502)..(502): n is a, c, g, or t
  modified_base (643)..(643): a, c, t, g, unknown or other
  misc_feature (643)..(643): n is a, c, g, or t
tcagagtcgagagacacgaccggtgctcgatttagctacgactgcgagggggggcctaaggaagcagcactgggtggtcgcctcagccatggcctggaccgttctcctcctcggcctcctctctcactgcaacagactctggtagaccctctagtgtagctacgactcncgcccaccgtcggtgtccgagtccggccctggaccaggaccgcgtagtattacccgtagggacggggtaaaccacgtagttagggaaacttacgaccgttgacgtccgtaacgtacgggtaccccaggaaccgaacggtaacggcccgaaggtacccctaccggggttcccctaggtcggtccggttcgggttaccgtagttaacgggtcggtaaggtcccggttagggacccgtacccccggtcgtaacggtagggtcctcccgtaggactcgttacgtcgtacgtcgacctaaccgtacgtcgtaaccgggtacccnctacgcggtaaccncggaacggtcccgggaaggtacggacgggtaaccgggtagtacggtaccggaccttacgttaacgttacgtacgtcggtaacggtggtacggtagttacgggttggttaacgtgttacgtacggtttaccgcgggttaacncggtacggtaccggtaacggtccgacgtcgttacgaccgccgaccgaccgtacccgaccgacgttccgtacccgtacgttcccccgtaccttaccccggtccctttaccgtacccgttaccacccgttccgtacgtaccgggg

SEQ ID NO: 135394 - DNA, 298 bp, Homo sapiens
  misc_feature: GYAE6OF01C7VYN.49.11.A11.1.454.CMB.1.raw
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (259)..(298): a, c, t, g, unknown or other
  misc_feature (259)..(298): n is a, c, g, or t
tcagagtcgagagacacgaccggtgctcgatttagctacgactgcagggaacccggccaccctgaccatcagccgggtcgaagacggggatgagccgactattactgtcaggtgtggatagtggtatggtgtcgtcttcggagctgggaccagggtcaccgtcctaggtcacgcccaagcccaacccctatgccactctgttcccccgcctcctctctctcgactccgtgacgcgggntggaccaaggcacagtagncnnnnnnnnnnnnnnnnnnnnnnnnnnnnnnnnnnnnnnnn

SEQ ID NO: 135395 - DNA, 264 bp, Homo sapiens
  misc_feature: GYAE6OF01E2LL6.49.11.A11.1.454.CMB.1.raw
  modified_base (116)..(116): a, c, t, g, unknown or other
  misc_feature (116)..(116): n is a, c, g, or t
  modified_base (245)..(245): a, c, t, g, unknown or other
  misc_feature (245)..(245): n is a, c, g, or t
  modified_base (251)..(264): a, c, t, g, unknown or other
  misc_feature (251)..(264): n is a, c, g, or t
tcagagtcgagagacacgaccggtgctcgatttagctacgactgcagggaacccggccaccctgaccatcagccgggtcgaagacggggatgaggccgactattactgtcaggtgngggatagtggtagtggtgtcgtcttcggagctgggaccagggtcaccgtcctaggtcagcccaaggccaaccccatgtcactctgttcccaccctcctcgtctctcgactctgagcgggctggcaggcncatagnnnnnnnnnnnnnn

SEQ ID NO: 135396 - DNA, 265 bp, Homo sapiens
  misc_feature: GYAE6OF01ETVVQ.49.11.A11.1.454.CMB.1.raw
  modified_base (256)..(265): a, c, t, g, unknown or other
  misc_feature (256)..(265): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctcgttccccaccctctctctctcgactctggacgcgggtctggcaaggcgacatagnnnnnnnnnn

SEQ ID NO: 135397 - DNA, 268 bp, Homo sapiens
  misc_feature: GYAE6OF01EUBFU.49.11.A11.1.454.CMB.1.raw
  modified_base (255)..(268): a, c, t, g, unknown or other
  misc_feature (255)..(268): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatgtcactctcgttcccgccctcctctctctcgactctgacgcggctggacaaggtcgacaatgnnnnnnnnnnnnnn

SEQ ID NO: 135398 - DNA, 292 bp, Homo sapiens
  misc_feature: GYAE6OF01AZP7K.49.11.A11.1.454.CMB.1.raw
  modified_base (217)..(217): a, c, t, g, unknown or other
  misc_feature (217)..(217): n is a, c, g, or t
  modified_base (257)..(257): a, c, t, g, unknown or other
  misc_feature (257)..(257): n is a, c, g, or t
  modified_base (259)..(292): a, c, t, g, unknown or other
  misc_feature (259)..(292): n is a, c, g, or t
tcagagtcgagagacacgaccggtgctcgatttagctacgactgcagggaacccggccaccctgaccatcagccgggtcgaagacgggggatgaggccgactattactgtcagggtgtgggatagtggtagtggtgtcgtcttcggagctgggaccagggtcaccgtcctaggtcagcccaaggccaacccatgtcactctgttcccgccctcctcnctctcgactctgagcgggctggacgaacggcgctaatagnannnnnnnnnnnnnnnnnnnnnnnnnnnnnnnnnn

SEQ ID NO: 135399 - DNA, 252 bp, Homo sapiens
  misc_feature: GYAE6OF01EZ4SM.49.11.A11.1.454.CMB.1.raw
  modified_base (249)..(252): a, c, t, g, unknown or other
  misc_feature (249)..(252): n is a, c, g, or t
tcagagtcgagagacacgaccggtgctcgatttagctacgactgcgggaacccggccaccctgaccatcagccggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnn

SEQ ID NO: 135400 - DNA, 736 bp, Homo sapiens
  misc_feature: GYAE6OF01AZSD1.49.11.A11.1.454.CMB.1.raw
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcagccaccctcggtgtcagtcggcccctggacagacggccaggattacctggtagggggaaacacattaggaagtaagactgtgcactggtaccagcagaagccaggccaggcccctgtgctggtcgtctagtgggtgagtcgggccgacccggccctcgacggggtactccccgtggacgcgtactttcctcgtcggcctacccgaacgtccgtacggggaaccccgccacccgtcgacccatccgacggcccgggtagaaacgggacggggatcggacggtaccgtaacgttagttacgtggtacggtagggtggtaggggtattagggttgggttaggttggggttacggttccgggtttccgttacggggacggtccggtacgggggtaccccgtagggggttcccaacccgggtttccgtaacgggtcccgaaccggacccccggaaacgggtacccccaaacccccgtacgttccggttacccctaaccggtttccccgttacccggtttaccccccctaaccccgtttccccgttaccctttacccttcccggtcccgtaccgttacccggg

SEQ ID NO: 135401 - DNA, 284 bp, Homo sapiens
  misc_feature: GYAE6OF01EHLVO.49.11.A11.1.454.CMB.1.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (254)..(255): a, c, t, g, unknown or other
  misc_feature (254)..(255): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (261)..(284): a, c, t, g, unknown or other
  misc_feature (261)..(284): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccactgtccactctcgttcccaccctccgtntacncgactctgagcgggctggacaaggcgcatagnntncntnnnnnnnnnnnnnnnnnnnnnnnn

SEQ ID NO: 135402 - DNA, 258 bp, Homo sapiens
  misc_feature: GYAE6OF01BPVEM.49.11.A11.1.454.CMB.1.raw
  modified_base (251)..(258): a, c, t, g, unknown or other
  misc_feature (251)..(258): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccatcgtcactctgttcccgccctcctctctctcgactctgagcggctggcaaggcgcatagnnnnnnnn

SEQ ID NO: 135403 - DNA, 865 bp, Homo sapiens
  misc_feature: GYAE6OF01BE85E.49.11.A11.1.454.CMB.1.raw
  modified_base (224)..(224): a, c, t, g, unknown or other
  misc_feature (224)..(224): n is a, c, g, or t
tcagagtcgagagacacgaccggtgctcgatttagctacgactgcagggggggcctaaggaagcagcactggtggtgcctcagccatggcctggaccgttctcctcctcggcctcctctctcactgcacagactctgtgacctcctatgtgctgactcacgccaccctcggtgtcagtcggcccctggacagacggccaggtattaccgtggtagggggaaacncagttaggaacgtaagactgtgcgactggtaaccagcaagaacgccaacggccaacggtccccgttagtcgtccgttacgggtccgtacgttagtcgggtagaacggttcgggaccggaacccggtacccgttaggaacggggtaaacctttccccgttaggaacggtaccggttaacttttacccgttcccggtacgggtaaccctttacccgaaaccgtttacccgggtaaccgggggaaacccccgggacccctaaacccccgtttaacgaaccccgttaaccgtacggtaaacccgggttacccggggtaaacccgggaaaacgggttaaccggggggaacgttaacgggaaccgggtaccgttaaggtaacccgtttaacgtttaacggttacggttaccggtaagggttacgggtaagggtaaggttaacggtggggtttaacggtggttacggttaccgtcgttacgggtacgtcggtaaccgggaaccggaacggtttaccgaccggttacccgtacggtaaccgacgtaacccgaaacggtaaccctaaccccgacgttattccgaacggtttccctaccggttacccccgtaaccccttaccgttcccgttaacctccggtccttaacccg

SEQ ID NO: 135404 - DNA, 303 bp, Homo sapiens
  misc_feature: GYAE6OF01EYZPM.49.11.A11.1.454.CMB.1.raw
  modified_base (264)..(303): a, c, t, g, unknown or other
  misc_feature (264)..(303): n is a, c, g, or t
tcagagtcgagagacacgaccggtgctcgatttagctacgactgcagggaacccggccaccctgaccatcagccgggtcgaaggacggggatgaggccgactattactgtcaggtgtgggatagtggtagtggtgtcgtcttcggagctgggaccagggtcaccgtcctaggtcacgcccaaggcccaacccatgtcactctcttcccaccctcctctctcgtcgactcgtgacggccgggcgtaggcgaacggcgacaagtgnnnnnnnnnnnnnnnnnnnnnnnnnnnnnnnnnnnnnnnn

SEQ ID NO: 135405 - DNA, 281 bp, Homo sapiens
  misc_feature: GYAE6OF01BNU7N.49.11.A11.1.454.CMB.1.raw
  modified_base (249)..(249): a, c, t, g, unknown or other
  misc_feature (249)..(249): n is a, c, g, or t
  modified_base (255)..(281): a, c, t, g, unknown or other
  misc_feature (255)..(281): n is a, c, g, or t
tcagagtcgagagacacgaccggtgctcgatttagctacgactgcagggaacccggccaccctgaccatcagccgggtcaagacggggatgaggccgactattactgtcaggtgtgggatagtggtagtggtgtcgtcttcggagctgggaccagggtcaccgtcctaggtcagcccaaggcccaaccccgactgtcactctcgttcccgcctctctctctcgactctagagcgggctggacaaggccncaatgnnnnnnnnnnnnnnnnnnnnnnnnnnn

SEQ ID NO: 135406 - DNA, 636 bp, Homo sapiens
  misc_feature: GYAE6OF01EIAOW.49.11.A11.1.454.CMB.1.raw
  modified_base (124)..(124): a, c, t, g, unknown or other
  misc_feature (124)..(124): n is a, c, g, or t
  modified_base (228)..(228): a, c, t, g, unknown or other
  misc_feature (228)..(228): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (326)..(327): a, c, t, g, unknown or other
  misc_feature (326)..(327): n is a, c, g, or t
  modified_base (354)..(354): a, c, t, g, unknown or other
  misc_feature (354)..(354): n is a, c, g, or t
  modified_base (632)..(632): a, c, t, g, unknown or other
  misc_feature (632)..(632): n is a, c, g, or t
tcagagtcgagagacacgaccggtgctcgatttagctacgactgcgaggggggcctaaggaagcagcactggtggtgcctcagccatggcctggaccgttctccctcctcggcctcctctctcnctgcagagacttctcgtacgacccttcctagtgtgcgtcgactcgacgccctaccgtcggtgtcacggtccggcccgtggacaggccgcgtaggtacttacggngggtaacgggaaacagtagttaggaagtacgattagtcgactacgtagtaccngacgagacgccgacgccgccgccctgngtcgtgtcgtntagtggnngcggccgtaccgtccgagcgtcctcgngatgtactcgtcgtcgcctaccgacgttcggacccggacccgtccacgtaccgactacggtccggacggtacggtacggaacggcggatcgggacgacctagtagtcgtagcggtaggtggtacgtagtggttgggtagttggtcggttaccgttgtacggcgttagggaccggtacgtaccgggttctacgtaccggtacgacccgcaacccggacctacccgacgtacgtccgtatcccgttcgaccccctctcccttacgtcctccgtactccgngtcg

SEQ ID NO: 135407 - DNA, 342 bp, Homo sapiens
  misc_feature: GYAE6OF01BVKRI.49.11.A11.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (269)..(271): a, c, t, g, unknown or other
  misc_feature (269)..(271): n is a, c, g, or t
  modified_base (273)..(273): a, c, t, g, unknown or other
  misc_feature (273)..(273): n is a, c, g, or t
  modified_base (276)..(277): a, c, t, g, unknown or other
  misc_feature (276)..(277): n is a, c, g, or t
  modified_base (282)..(282): a, c, t, g, unknown or other
  misc_feature (282)..(282): n is a, c, g, or t
  modified_base (284)..(285): a, c, t, g, unknown or other
  misc_feature (284)..(285): n is a, c, g, or t
  modified_base (288)..(342): a, c, t, g, unknown or other
  misc_feature (288)..(342): n is a, c, g, or t
tcagagtcgagagacacgaccggtgctcgatttagctacgactgcagggacccgccaccctgaccatcagccgggtcgaagacggggatgaggccatattactgtcaggtgtgggatagttggtagtgggtcgtccgttcttcgggagctggggaaccctaggggtccaccgttcctaggtcacgcccaaggcccaaaccccntcgtacacttcttcgttccccgccctactctctctcgactctgagcggctggcaaggcncaatgcnnnancannattcntnnagnnnnnnnnnnnnnnnnnnnnnnnnnnnnnnnnnnnnnnnnnnnnnnnnnnnnnnn

SEQ ID NO: 135408 - DNA, 282 bp, Homo sapiens
  misc_feature: GYAE6OF01BM7LF.49.11.A11.1.454.CMB.1.raw
  modified_base (243)..(243): a, c, t, g, unknown or other
  misc_feature (243)..(243): n is a, c, g, or t
  modified_base (250)..(252): a, c, t, g, unknown or other
  misc_feature (250)..(252): n is a, c, g, or t
  modified_base (254)..(282): a, c, t, g, unknown or other
  misc_feature (254)..(282): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccatgtcactctgttcccacctcctctctctcgactctgagcgggctggcaaggcncagtagnnngnnnnnnnnnnnnnnnnnnnnnnnnnnnnn

SEQ ID NO: 135409 - DNA, 905 bp, Homo sapiens
  misc_feature: GYAE6OF01BQEV1.49.11.A11.1.454.CMB.1.raw
tcagagtcgagagacacgaccggtgctcgatttagctacgactgcgaggggggcctaaggaagcagcacgtggtggtgcctcagccatcggcctggacccgttctccctcctcggcctcctctctcactgcagagtactctgtgacctcgtatgtgtctgactcgacgccctacccgtcggttgtccgtacggtccggccccgttagggacgacggtaccggaccgtaaggtaccgtttacccggtaggggtaaacgggaaaccgtacgttaggtaaaggtaaacggtaacgtcgtacggtacgtaccgtaacggttaccgaacgacgacgaaacggaccgaccggaccgtaccggccggtaccgtgtccggtacgttcggtacgtaggttaggtacggtcggacgggtccggacccgggtaaccccgtcgtaagggtaccgtcccgttacggaggtaccgttccgttaacggttccgtaccggtacccgtacccttaaaccggtacccggttacccggggaaacccccggacccccgtacccgttaccccggtaactaacccgtaacggtccccgggaacgggggtaacccggtaaacgggacggggacggttacgaccggtaccgggttaacccttacgtttaacggttacggtcggtaacggggttaggtacgggttaagttagggtaggggttacggtttcgggttcggttacgggttccggttcgggtttaggacgggttcgggtaaccggtaccgggttaaccgtcccggttaacggtccgtacgggtaccccgaacccgggtaaacccgtacccgaccccgttaacccggtgttaaccgtcccgttaactccccgtttacccaccctccgttccgtacgtcctaccgcgtcggtacgg

SEQ ID NO: 135410 - DNA, 858 bp, Homo sapiens
  misc_feature: GYAE6OF01ETNC9.49.11.A11.1.454.CMB.1.raw
  modified_base (822)..(822): a, c, t, g, unknown or other
  misc_feature (822)..(822): n is a, c, g, or t
tcagagtcgagagacacgaccggtgctcgatttagctacgactgcgagggggggcctaaggaagcagcactggtggtgcctcagccagtggcctggacccgttctcctccgtcggcctcctctctcactgcacagactctgtcgacctcctatgtgctgactcacgcccgtacccgtggtcgtcacggtccggcccgtaggacgacggaccggaccgaaggtacttaccgtagggtaacgggggaaaccgactagttagggaaagtaagtacgtgtacgacgtacgtcggtaaccagaccgaaggacgaccgacgggcccgacgggtcccccgttggtccggtacgttcgggttccgttacgtagtttcggggtagtacggtcggggtacccgggacccgggtcccgtccgggtaaccgggtccttaccccgtaggaccgtcggttactttccgtcgtccggtacctaacccggtacgttaccgggacccggggtacccccggaccctaccgtaccgtaaccgtacgtccggaaccggggtccggggtaacggaaacggggtaccgggtacgacgggtaccgggtaccgtaacgtttacgtttacggacggttacgggtagggttacggttagggtagtttacggggttgggttaacggggttcggttaccggtttcggttaccgggttcgggacggtacgggtaccggggtaccgtaccgggttaccgtacccggttacggtaaccggtaccgaccggaacccgtaaccggacccctaacccgtacgtccgtacccgtaccttcccggtccccttaccccnccccgttaccctcttaccgtcctaccgtcgttccgg

SEQ ID NO: 135411 - DNA, 249 bp, Homo sapiens
  misc_feature: GYAE6OF02G19X5.49.11.A11.1.454.CMB.1.raw
  modified_base (248)..(249): a, c, t, g, unknown or other
  misc_feature (248)..(249): n is a, c, g, or t
tcagagtcgagagacacgaccggtgctcgatttagctacgactgcaggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccacctcctctctctcgactctgagcgggctggcaaggcgcatagnn

SEQ ID NO: 135412 - DNA, 249 bp, Homo sapiens
  misc_feature: GYAE6OF02F6KSQ.49.11.A11.1.454.CMB.1.raw
  modified_base (248)..(249): a, c, t, g, unknown or other
  misc_feature (248)..(249): n is a, c, g, or t
tcagagtcgagagacacgaccggtgctcgatttagctacgactgcgggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccgcctcctctctctcgactctgagcgggctggcaaggcgcatagnn

SEQ ID NO: 135413 - DNA, 251 bp, Homo sapiens
  misc_feature: GYAE6OF02F1GFD.49.11.A11.1.454.CMB.1.raw
  modified_base (251)..(251): a, c, t, g, unknown or other
  misc_feature (251)..(251): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagn

SEQ ID NO: 135414 - DNA, 250 bp, Homo sapiens
  misc_feature: GYAE6OF02GRD0D.49.11.A11.1.454.CMB.1.raw
  modified_base (249)..(250): a, c, t, g, unknown or other
  misc_feature (249)..(250): n is a, c, g, or t
tcagagtcgagagacacgaccggtgctcgatttagctacgactgcaggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccgccctcctctctctcgactctgagcgggctggcaaggcgcatagnn

SEQ ID NO: 135415 - DNA, 253 bp, Homo sapiens; identical to SEQ ID NO: 134746
  misc_feature: GYAE6OF02I8LOQ.49.11.A11.1.454.CMB.1.raw
  modified_base (251)..(253): a, c, t, g, unknown or other
  misc_feature (251)..(253): n is a, c, g, or t

SEQ ID NO: 135416 - DNA, 251 bp, Homo sapiens; identical to SEQ ID NO: 134740
  misc_feature: GYAE6OF02GU433.49.11.A11.1.454.CMB.1.raw
  modified_base (251)..(251): a, c, t, g, unknown or other
  misc_feature (251)..(251): n is a, c, g, or t

SEQ ID NO: 135417 - DNA, 257 bp, Homo sapiens
  misc_feature: GYAE6OF02H5G49.49.11.A11.1.454.CMB.1.raw
  modified_base (251)..(257): a, c, t, g, unknown or other
  misc_feature (251)..(257): n is a, c, g, or t
tcagagtcgagagacacgaccggtgctcgatttagctacgactgcagggaacccggccaaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctctctctctcgactctgagcgggctggcaaggcgcatagnnnnnnn

SEQ ID NO: 135418 - DNA, 160 bp, Homo sapiens
  misc_feature: GYAE6OF02F3S1R.49.11.A11.1.454.CMB.1.raw
  modified_base (160)..(160): a, c, t, g, unknown or other
  misc_feature (160)..(160): n is a, c, g, or t
tcagagtcgagagacacgaccggtgctcgatttagctacgactgcagggagcttactgactaggccggccttaattaaggtcagcctaaggctgccccagcgtcactctgttcccaccctcctctctctcgactctgagcgggctggcaaggcgcatagn

SEQ ID NO: 135419 - DNA, 250 bp, Homo sapiens
  misc_feature: GYAE6OF02GN940.49.11.A11.1.454.CMB.1.raw
  modified_base (249)..(250): a, c, t, g, unknown or other
  misc_feature (249)..(250): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccacctcctctctctcgactctgagcgggctggcaaggcgcatagnn

SEQ ID NO: 135420 - DNA, 249 bp, Homo sapiens
  misc_feature: GYAE6OF02G4YDM.49.11.A11.1.454.CMB.1.raw
  modified_base (249)..(249): a, c, t, g, unknown or other
  misc_feature (249)..(249): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtattcggagctgggaccagggtcaccgtcctaggtcagcccaaggccaacccactgtcactctgttcccacctcctctctctcgactctgagcgggctggcaaggcgcatagn

SEQ ID NO: 135421 - DNA, 254 bp, Homo sapiens; identical to SEQ ID NO: 134747
  misc_feature: GYAE6OF02JBRNM.49.11.A11.1.454.CMB.1.raw
  modified_base (251)..(254): a, c, t, g, unknown or other
  misc_feature (251)..(254): n is a, c, g, or t

SEQ ID NO: 135422 - DNA, 269 bp, Homo sapiens
  misc_feature: GYAE6OF02G5ENY.49.11.A11.1.454.CMB.1.raw
  modified_base (204)..(204): a, c, t, g, unknown or other
  misc_feature (204)..(204): n is a, c, g, or t
  modified_base (252)..(269): a, c, t, g, unknown or other
  misc_feature (252)..(269): n is a, c, g, or t
tcagagtcgagagacacgaccggtgctcgatttagctacgactgctagggtaacccgggccaccctgaccatcagccgggtcgaagacgggatgaggccgactattacgtcgtcaggtgtgggataggtggtagtggtgtcgtcttcggagctgggaccagggtcacgtcctaggtcagcccaaggccaacccactgtcactcngttccgcctcctctctctcgactctgagcgggctggcaagcgcatagnnnnnnnnnnnnnnnnnn

SEQ ID NO: 135423 - DNA, 252 bp, Homo sapiens; identical to SEQ ID NO: 134755
  misc_feature: GYAE6OF02HREIA.49.11.A11.1.454.CMB.1.raw
  modified_base (251)..(252): a, c, t, g, unknown or other
  misc_feature (251)..(252): n is a, c, g, or t

SEQ ID NO: 135424 - DNA, 253 bp, Homo sapiens; identical to SEQ ID NO: 134751
  misc_feature: GYAE6OF02IC58A.49.11.A11.1.454.CMB.1.raw
  modified_base (251)..(253): a, c, t, g, unknown or other
  misc_feature (251)..(253): n is a, c, g, or t

SEQ ID NO: 135425 - DNA, 252 bp, Homo sapiens
  misc_feature: GYAE6OF02GDYT0.49.11.A11.1.454.CMB.1.raw
  modified_base (250)..(252): a, c, t, g, unknown or other
  misc_feature (250)..(252): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnnn

SEQ ID NO: 135426 - DNA, 253 bp, Homo sapiens; identical to SEQ ID NO: 134759
  misc_feature: GYAE6OF02HWAWC.49.11.A11.1.454.CMB.1.raw
  modified_base (252)..(253): a, c, t, g, unknown or other
  misc_feature (252)..(253): n is a, c, g, or t

SEQ ID NO: 135427 - DNA, 273 bp, Homo sapiens
  misc_feature: GYAE6OF02ITIE0.49.11.A11.1.454.CMB.1.raw
  modified_base (232)..(232): a, c, t, g, unknown or other
  misc_feature (232)..(232): n is a, c, g, or t
  modified_base (253)..(273): a, c, t, g, unknown or other
  misc_feature (253)..(273): n is a, c, g, or t
tcagagtcgagagacacgaccggtgctcgatttagctacgactgcaggaacccggccaaccctgaaccatccagccgggtcgaagaccgggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgancgggctggcaaggcgcatagnnnnnnnnnnnnnnnnnnnnn

SEQ ID NO: 135428 - DNA, 254 bp, Homo sapiens; identical to SEQ ID NO: 134802
  misc_feature: GYAE6OF02IYE4M.49.11.A11.1.454.CMB.1.raw
  modified_base (252)..(254): a, c, t, g, unknown or other
  misc_feature (252)..(254): n is a, c, g, or t

SEQ ID NO: 135429 - DNA, 164 bp, Homo sapiens
  misc_feature: GYAE6OF02H9NGN.49.11.A11.1.454.CMB.1.raw
  modified_base (161)..(164): a, c, t, g, unknown or other
  misc_feature (161)..(164): n is a, c, g, or t
tcagagtcgagagacacgaccggtgctcgatttagctacgactgcagggagcttactgactaggccggccttaattaaggtcagcctaaggctgcccccagcgtcactctgttcccgccctcctctctctcgactctgagcgggctggcaaggcgcatagnnnn

SEQ ID NO: 135430 - DNA, 272 bp, Homo sapiens
  misc_feature: GYAE6OF02H4WOQ.49.11.A11.1.454.CMB.1.raw
  modified_base (253)..(272): a, c, t, g, unknown or other
  misc_feature (253)..(272): n is a, c, g, or t
tcagagtcgagagacacgaccggtgctcgatttagctacgactgcagggaacccggccaccctgacccatcagccgggtcgaagacgggatgaggccgactacttactgtcaggtgttggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnnnnnnn

SEQ ID NO: 135431 - DNA, 251 bp, Homo sapiens
  misc_feature: GYAE6OF02HM9NF.49.11.A11.1.454.CMB.1.raw
  modified_base (250)..(251): a, c, t, g, unknown or other
  misc_feature (250)..(251): n is a, c, g, or t
tcagagtcgagagacacgaccggtgctcgatttagctacgactgcgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccgccctcctctctctcgactctgagcgggctggcaaggcgcatagnn

SEQ ID NO: 135432 - DNA, 253 bp, Homo sapiens; identical to SEQ ID NO: 134759
  misc_feature: GYAE6OF02GXLDV.49.11.A11.1.454.CMB.1.raw
  modified_base (252)..(253): a, c, t, g, unknown or other
  misc_feature (252)..(253): n is a, c, g, or t

SEQ ID NO: 135433 - DNA, 262 bp, Homo sapiens; identical to SEQ ID NO: 135141
  misc_feature: GYAE6OF02HV6RY.49.11.A11.1.454.CMB.1.raw
  modified_base (252)..(262): a, c, t, g, unknown or other
  misc_feature (252)..(262): n is a, c, g, or t

SEQ ID NO: 135434 - DNA, 250 bp, Homo sapiens; identical to SEQ ID NO: 135419
  misc_feature: GYAE6OF02I9CET.49.11.A11.1.454.CMB.1.raw
  modified_base (249)..(250): a, c, t, g, unknown or other
  misc_feature (249)..(250): n is a, c, g, or t

SEQ ID NO: 135435 - DNA, 252 bp, Homo sapiens
  misc_feature: GYAE6OF02JEUWB.49.11.A11.1.454.CMB.1.raw
  modified_base (251)..(252): a, c, t, g, unknown or other
  misc_feature (251)..(252): n is a, c, g, or t
tcagagtcgagagacacgaccggtgctcgatttagctacgactgcgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnn

SEQ ID NO: 135436 - DNA, 267 bp, Homo sapiens
  misc_feature: GYAE6OF02IZ4IA.49.11.A11.1.454.CMB.1.raw
  modified_base (248)..(267): a, c, t, g, unknown or other
  misc_feature (248)..(267): n is a, c, g, or t
tcagagtcgagagacacgaccggtgctcgatttagctacgactgcagggaacccggccaccctggaccatcagccgggtcgaagacggggatgaggccgactattactagtcaggtgtgggatagtggtagtggtgtcgtcttcggagctgggaccagggtcaccgtcctaggtcagcccaaggccaacccactgtcactctgttcctcctctctctcgactctgagcgggctggcaaggcgcatagnnnnnnnnnnnnnnnnnnnn

SEQ ID NO: 135437 - DNA, 253 bp, Homo sapiens; identical to SEQ ID NO: 134809
  misc_feature: GYAE6OF02H0J9T.49.11.A11.1.454.CMB.1.raw
  modified_base (252)..(253): a, c, t, g, unknown or other
  misc_feature (252)..(253): n is a, c, g, or t

SEQ ID NO: 135438 - DNA, 254 bp, Homo sapiens; identical to SEQ ID NO: 134802
  misc_feature: GYAE6OF02IYSZ7.49.11.A11.1.454.CMB.1.raw
  modified_base (252)..(254): a, c, t, g, unknown or other
  misc_feature (252)..(254): n is a, c, g, or t

SEQ ID NO: 135439 - DNA, 270 bp, Homo sapiens
  misc_feature: GYAE6OF02FXGSD.49.11.A11.1.454.CMB.1.raw
  modified_base (255)..(270): a, c, t, g, unknown or other
  misc_feature (255)..(270): n is a, c, g, or t
tcagagtcgagagacacgaccggtgctcgatttagctacgactgcagggaacccggccaccctgaccactcagccgggtcgaagacgggatgaggccgactattactgtcaggtgtgggatagtggtagtggtgtcgtcttcggagctgggaccagggtctaccgtcctaggtcagtcccaaggccaaccccactgtcactctgttcccgccctcctctctcgtcgactctgagcgggctggcaaggcgcatagnnnnnnnnnnnnnnnn

SEQ ID NO: 135440 - DNA, 251 bp, Homo sapiens
  misc_feature: GYAE6OF02HAYMW.49.11.A11.1.454.CMB.1.raw
  modified_base (248)..(251): a, c, t, g, unknown or other
  misc_feature (248)..(251): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtctaggtcagcccaaggccaaccccactgtcactctgttcccacctctctctctcactctgagcgggctggcaaggcgcatagnnnn

SEQ ID NO: 135441 - DNA, 269 bp, Homo sapiens
  misc_feature: GYAE6OF02HA1SQ.49.11.A11.1.454.CMB.1.raw
  modified_base (252)..(269): a, c, t, g, unknown or other
  misc_feature (252)..(269): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctgggcaaggcgcatagnnnnnnnnnnnnnnnnnn

SEQ ID NO: 135442 - DNA, 255 bp, Homo sapiens
  misc_feature: GYAE6OF02HI2U3.49.11.A11.1.454.CMB.1.raw
  modified_base (251)..(255): a, c, t, g, unknown or other
  misc_feature (251)..(255): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnnnn

SEQ ID NO: 135443 - DNA, 296 bp, Homo sapiens
  misc_feature: GYAE6OF02G32X6.49.11.A11.1.454.CMB.1.raw
  modified_base (264)..(296): a, c, t, g, unknown or other
  misc_feature (264)..(296): n is a, c, g, or t
tcagagtcgagagacacgaccggtgctcgatttagctacgactgcgtaggggaacccggccaccctcgaccatcagccgggtcgaagacggggatgaggccgacgtacttactgtcaggtgtggggatagtggtagtggtgtcgtcttcggacgctgggaccagggtcaccgtcctaggtcaagcccaaggccaaccccactgtccacctctgttcccgccctcctctctctcgactctgagcgggctggcaaggccgcatagnnnnnnnnnnnnnnnnnnnnnnnnnnnnnnnnn

SEQ ID NO: 135444 - DNA, 160 bp, Homo sapiens; identical to SEQ ID NO: 135418
  misc_feature: GYAE6OF02F0IU3.49.11.A11.1.454.CMB.1.raw
  modified_base (160)..(160): a, c, t, g, unknown or other
  misc_feature (160)..(160): n is a, c, g, or t

SEQ ID NO: 135445 - DNA, 252 bp, Homo sapiens
  misc_feature: GYAE6OF02GSKZU.49.11.A11.1.454.CMB.1.raw
  modified_base (250)..(252): a, c, t, g, unknown or other
  misc_feature (250)..(252): n is a, c, g, or t
tcagagtcgagagacacgaccggtgctcgatttagctacgactgcgggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcatagnnn

SEQ ID NO: 135446 - DNA, 255 bp, Homo sapiens; identical to SEQ ID NO: 134799
  misc_feature: GYAE6OF02HQMGW.49.11.A11.1.454.CMB.1.raw
  modified_base (252)..(255): a, c, t, g, unknown or other
  misc_feature (252)..(255): n is a, c, g, or t

SEQ ID NO: 135447 - DNA, 254 bp, Homo sapiens; identical to SEQ ID NO: 134793
  misc_feature: GYAE6OF02FSSGK.49.11.A11.1.454.CMB.1.raw
  modified_base (251)..(254): a, c, t, g, unknown or other
  misc_feature (251)..(254): n is a, c, g, or t

SEQ ID NO: 135448 - DNA, 253 bp, Homo sapiens; identical to SEQ ID NO: 134759
  misc_feature: GYAE6OF02HABIP.49.11.A11.1.454.CMB.1.raw
  modified_base (252)..(253): a, c, t, g, unknown or other
  misc_feature (252)..(253): n is a, c, g, or t

SEQ ID NO: 135449 - DNA, 252 bp, Homo sapiens; identical to SEQ ID NO: 134755
  misc_feature: GYAE6OF02GBZK7.49.11.A11.1.454.CMB.1.raw
  modified_base (251)..(252): a, c, t, g, unknown or other
  misc_feature (251)..(252): n is a, c, g, or t

SEQ ID NO: 135450 - DNA, 251 bp, Homo sapiens
  misc_feature: GYAE6OF02HP3NP.49.11.A11.1.454.CMB.1.raw
  modified_base (249)..(251): a, c, t, g, unknown or other
  misc_feature (249)..(251): n is a, c, g, or t
tcagagtcgagagacacgaccggtgctcgatttagctacgactgcgggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccaccctcctctctctcgactctgagcgggctggcaaggcgcatagnnn

SEQ ID NO: 135451 - DNA, 258 bp, Homo sapiens
  misc_feature: GYAE6OF02H4BP6.49.11.A11.1.454.CMB.1.raw
  modified_base (249)..(258): a, c, t, g, unknown or other
  misc_feature (249)..(258): n is a, c, g, or t
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaacccactgtcactctgttcccaccctctctctctcgactctgagcgggctggcaaggcgcatagnnnnnnnnnn

SEQ ID NO: 135452 - DNA, 161 bp, Homo sapiens
  misc_feature: GYAE6OF02GRB27.49.11.A11.1.454.CMB.1.raw
  modified_base (160)..(161): a, c, t, g, unknown or other
  misc_feature (160)..(161): n is a, c, g, or t
tcagagtcgagagacacgaccggtgctcgatttagctacgactgcagggagcttactgactaggccggccttaattaaggtcagcctaaggctgccccagcgtcactctgttcccgccctcctctctctcgactctgagcgggctggcaaggcgcatagnn

SEQ ID NO: 135453 - DNA, 161 bp, Homo sapiens
  misc_feature: GYAE6OF02IEXBU.49.11.A11.1.454.CMB.1.raw
  modified_base (161)..(161): a, c, t, g, unknown or other
  misc_feature (161)..(161): n is a, c, g, or t
tcagagtcgagagacacgaccggtgctcgatttagctacgactgcagggagcttactgactaggccggccttaattaaggtcagcctaaggctgcccccagcgtcactctgttcccaccctcctctctctcgactctgagcgggctggcaaggcgcatagn

SEQ ID NO: 135454 - DNA, 290 bp, Homo sapiens
  misc_feature: GYAE6OF02GHIAP.49.11.A11.1.454.CMB.1.raw
  modified_base (254)..(254): a, c, t, g, unknown or other
  misc_feature (254)..(254): n is a, c, g, or t
  modified_base (256)..(290): a, c, t, g, unknown or other
  misc_feature (256)..(290): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtccactctgttcccaccctcctctctctcgactctgagcgggctggacaaggcgcatagntnnnnnnnnnnnnnnnnnnnnnnnnnnnnnnnnnnn

SEQ ID NO: 135455 - DNA, 300 bp, Homo sapiens
  misc_feature: GYAE6OF02GJ6NF.49.11.A11.1.454.CMB.1.raw
  modified_base (259)..(300): a, c, t, g, unknown or other
  misc_feature (259)..(300): n is a, c, g, or t
tcagagtcgagagacacgaccggtgctcgatttagctacgactgcagggtaacccgggccacccttgaccatcagccgggtcgaagacggggatgaggccgactattactgtcaggtgtgggatagtggtagtgatcatgtggtgttcggcggagggaccaagctagaccgtcctaaggtcagccctaaggctgccccctggtcactctgttcccacctcctctctctcgactctgagcgggctggcaaggcgcatagnnnnnnnnnnnnnnnnnnnnnnnnnnnnnnnnnnnnnnnnnn

SEQ ID NO: 135456 - DNA, 255 bp, Homo sapiens; identical to SEQ ID NO: 134817
  misc_feature: GYAE6OF02G2V4N.49.11.A11.1.454.CMB.1.raw
  modified_base (252)..(255): a, c, t, g, unknown or other
  misc_feature (252)..(255): n is a, c, g, or t

SEQ ID NO: 135457 - DNA, 504 bp, Homo sapiens
  misc_feature: GYAE6OF02HIQNA.49.11.A11.1.454.CMB.1.raw
tcagagtcgagagacacgaccggtgctcgatttagctacgactgcaggggggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctattgtgatggcgaccggccctcagggatccctgagcgattctctggctccaactctgggaacacagccactctgaccatcagcgggactcaggctatcgatgagctgactattactgtcaggcgtgggacagccgcacgtggggtattcgggcggagggaccaagctgaccgtccgtgagtcagtccaaggctgcccctggtccactctcgttccctcccg

SEQ ID NO: 135458 - DNA, 253 bp, Homo sapiens; identical to SEQ ID NO: 134759
  misc_feature: GYAE6OF02GZOYR.49.11.A11.1.454.CMB.1.raw
  modified_base (252)..(253): a, c, t, g, unknown or other
  misc_feature (252)..(253): n is a, c, g, or t

SEQ ID NO: 135459 - DNA, 271 bp, Homo sapiens
  misc_feature: GYAE6OF02GVR0H.49.11.A11.1.454.CMB.1.raw
  modified_base (251)..(251): a, c, t, g, unknown or other
  misc_feature (251)..(251): n is a, c, g, or t
  modified_base (256)..(271): a, c, t, g, unknown or other
  misc_feature (256)..(271): n is a, c, g, or t
tcagagtcgagagacacgaccggtgctcgatttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgcctcctctctctcgactctgagcgggctggcaaggcgcatagnttttnnnnnnnnnnnnnnnn

SEQ ID NO: 135460 - DNA, 264 bp, Homo sapiens
  misc_feature: GYAE6OF02GJK0I.49.11.A11.1.454.CMB.1.raw
  modified_base (253)..(264): a, c, t, g, unknown or other
  misc_feature (253)..(264): n is a, c, g, or t
tcagagtcgagagacacgaccggtgctcgatttagctacgactgcagggaacccggccaccctgaccatcagccgggtcgaagacgggatgtaggccgactattactgtcaggtgtgggatagtggtagtggtgtcgtcttcggaggctgggaccagggtcaccgtcctaggtcagcccaaggccaaccccactgtcactctgttcccgccctcctctctctcgactctgagcgggctggcaaggcgcatagnnnnnnnnnnnn

SEQ ID NO: 135461 - DNA, 253 bp, Homo sapiens; identical to SEQ ID NO: 134759
  misc_feature: GYAE6OF02HOIGL.49.11.A11.1.454.CMB.1.raw
  modified_base (252)..(253): a, c, t, g, unknown or other
  misc_feature (252)..(253): n is a, c, g, or t

SEQ ID NO: 135462 - DNA, 298 bp, Homo sapiens
  misc_feature: GYAE6OF02HNTL4.49.11.A11.1.454.CMB.1.raw
  modified_base (253)..(298): a, c, t, g, unknown or other
  misc_feature (253)..(298): n is a, c, g, or t
tcagagtcgagagacacgaccggtgctcgatttagctacgactgcagggaacccggccaccctgaccatccagccgggtcgaagacggggatcgaggccgactattactgtcaggtgtgggatagtggtagtggtgtcgtcttcggagctgggaccagggtcaccgtctaggtcagcccaaggccaacccactgtcactctgttcccaccctcgtctactctcgactctgagcgggctggcaaggcgcatagnnnnnnnnnnnnnnnnnnnnnnnnnnnnnnnnnnnnnnnnnnnnnn

SEQ ID NO: 135463 - DNA, 161 bp, Homo sapiens; identical to SEQ ID NO: 134917
  misc_feature: GYAE6OF02IYBFN.49.11.A11.1.454.CMB.1.raw
  modified_base (160)..(161): a, c, t, g, unknown or other
  misc_feature (160)..(161): n is a, c, g, or t

SEQ ID NO: 135464 - DNA, 253 bp, Homo sapiens; identical to SEQ ID NO: 134751
  misc_feature: GYAE6OF02HW76N.49.11.A11.1.454.CMB.1.raw
  modified_base (251)..(253): a, c, t, g, unknown or other
  misc_feature (251)..(253): n is a, c, g, or t

SEQ ID NO: 135465 - DNA, 254 bp, Homo sapiens; identical to SEQ ID NO: 134802
  misc_feature: GYAE6OF02GJ85A.49.11.A11.1.454.CMB.1.raw
  modified_base (252)..(254): a, c, t, g, unknown or other
  misc_feature (252)..(254): n is a, c, g, or t

SEQ ID NO: 135466 - DNA, 253 bp, Homo sapiens; identical to SEQ ID NO: 134809
  misc_feature: GYAE6OF02H05MX.49.11.A11.1.454.CMB.1.raw
  modified_base (252)..(253): a, c, t, g, unknown or other
  misc_feature (252)..(253): n is a, c, g, or t

SEQ ID NO: 135467 - DNA, 255 bp, Homo sapiens; identical to SEQ ID NO: 134799
  misc_feature: GYAE6OF02G7KRL.49.11.A11.1.454.CMB.1.raw
  modified_base (252)..(255): a, c, t, g, unknown or other
  misc_feature (252)..(255): n is a, c, g, or t

SEQ ID NO: 135468 - DNA, 253 bp, Homo sapiens; identical to SEQ ID NO: 134746
  misc_feature: GYAE6OF02FQOKD.49.11.A11.1.454.CMB.1.raw
  modified_base (251)..(253): a, c, t, g, unknown or other
  misc_feature (251)..(253): n is a, c, g, or t

SEQ ID NO: 135469 - DNA, 254 bp, Homo sapiens; identical to SEQ ID NO: 134762
  misc_feature: GYAE6OF02F9CZW.49.11.A11.1.454.CMB.1.raw
  modified_base (252)..(254): a, c, t, g, unknown or other
  misc_feature (252)..(254): n is a, c, g, or t

SEQ ID NO: 135470 - DNA, 251 bp, Homo sapiens; identical to SEQ ID NO: 134740
  misc_feature: GYAE6OF02G3SFK.49.11.A11.1.454.CMB.1.raw
  modified_base (251)..(251): a, c, t, g, unknown or other
  misc_feature (251)..(251): n is a, c, g, or t

SEQ ID NO: 135471 - DNA, 255 bp, Homo sapiens; identical to SEQ ID NO: 134799
  misc_feature: GYAE6OF02G35JP.49.11.A11.1.454.CMB.1.raw
  modified_base (252)..(255): a, c, t, g, unknown or other
  misc_feature (252)..(255): n is a, c, g, or t

SEQ ID NO: 135472 - DNA, 252 bp, Homo sapiens; identical to SEQ ID NO: 134773
  misc_feature: GYAE6OF02IIGM0.49.11.A11.1.454.CMB.1.raw
  modified_base (252)..(252): a, c, t, g, unknown or other
  misc_feature (252)..(252): n is a, c, g, or t

SEQ ID NO: 135473 - DNA, 273 bp, Homo sapiens
  misc_feature: GYAE6OF02HM7CW.49.11.A11.1.454.CMB.1.raw
  modified_base (253)..(273): a, c, t, g, unknown or other
  misc_feature (253)..(273): n is a, c, g, or t
tcagagtcgagagacacgaccggtgctcgatttagctacgactgcagggaacccgggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatagnnnnnnnnnnnnnnnnnnnnn

SEQ ID NO: 135474 - DNA, 250 bp, Homo sapiens
  misc_feature: GYAE6OF02HPDWE.49.11.A11.1.454.CMB.1.raw
tcagagtcgagagacacgaccggtgctcgatttagctacgactgcagggaacccggccaccctgaccatcagccgggtcgaagacgggatgaggccgactattactgtcaggtgtgggatagtggtagtggtgtcgtcttcggagctgggaccagggtcaccgtcctaggtcagcccaaggccaaccccactgtcactctgttcccaccctcctctctctcgactctgagcgggctggcaaggcgcatag

SEQ ID NO: 135475 - DNA, 254 bp, Homo sapiens; identical to SEQ ID NO: 134822
  misc_feature: GYAE6OF02HA3SZ.49.11.A11.1.454.CMB.1.raw
  modified_base (251)..(254): a, c, t, g, unknown or other
  misc_feature (251)..(254): n is a, c, g, or t

SEQ ID NO: 135476 - DNA, 253 bp, Homo sapiens; identical to SEQ ID NO: 134746
  misc_feature: GYAE6OF02FT9EG.49.11.A11.1.454.CMB.1.raw
  modified_base (251)..(253): a, c, t, g, unknown or other
  misc_feature (251)..(253): n is a, c, g, or t
